United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 23

SEQ ID NO: 92677 - DNA, 337 bp, Triticum aestivum
  unsure (1)..(337): unsure at all n locations
  Clone ID: PAT_TA_92677
ctcgtgccgaattcggcacgagctaactcgtacaccattgttggatgaacggcaggggttttggatcagcagcgagtgggcaacgcgttggtgggcagtacatgcagctcatgcgtcggctatgaacgcgacgacgcggtccatgagccgcttggcgttgtcgcactcgagcttcccaaggaagaacacgtggccctccccctccagctccagccacgccgccctcccgcgccacccgctcgcggccacggcctcgtagtacgcgcggttccgcgccgcgagcccgtcctcgagccccccgtgtaccaagcatcctcgcgnacccgngnctctccag

SEQ ID NO: 92678 - DNA, 533 bp, Triticum aestivum
  unsure (1)..(533): unsure at all n locations
  Clone ID: PAT_TA_92678
gaaaacaatagccacgaggcaaaaggccagtagaaccgccggagcggtactaccgctcgtcctcacggtactaccacaaatggtagcggtactactgcttgcaagcggtacaaaaaaaatacttccgtgcctacctccgctgagcaaaacacgagattttggtccggagtggtactaccgcttaggagccgcggtagtactactctggagcggtactaccactcaggagccacggtagtaccgctctggagcggtagtaaaaaaattacatcccctctagccatggtagtaccacagcagcctttaccaaaacagccacaacttctgcaaacggacaccgaattcaacgaaaccaaatttgttggaaagctaacgacatgggctaacacaatcttgatagaaatatcaataagaagaaaatgagaaaagggccataagaaaatggtgagaaaccttccttggntaagactggtaaaanctccaacaacgagnncatcatagaagatgcatgtgaactccgtttttcatgaacn

SEQ ID NO: 92679 - DNA, 521 bp, Triticum aestivum
  unsure (1)..(521): unsure at all n locations
  Clone ID: PAT_TA_92679
cgatccctctgtctctccgtaccatagcagagacactttcatccatccgtccatggcggccaccgtcggcaaggagagggaggaggcggtggtccacccgaacgcgaggcaggggggcaagctcttgtccaggctgctgacgagggacagctcggccgccgcgccgtccttccgggtctactacggngtgtcctccgccggcgcggtgccgttcctgtgggagtcgcagccgggcacgcccaagaacgccatctccgatgccgcgatgccgccgctcacgcctccgccgtcctactacgccgccggcggcaccgcctccgccaagaatcacgcggcgcgcaagggcaaggtcgccgggggctacangttccggacgtcangcatcctggggctccatcctcatggtgacgcgntangngggggncgggcgacaaccgttngggctcgcccanctcgtccttctcctncggngtccaaaantcctcctcctccgtcnacctcctcnnacgntcatctttccg

SEQ ID NO: 92680 - DNA, 554 bp, Triticum aestivum
  unsure (1)..(554): unsure at all n locations
  Clone ID: PAT_TA_92680
ctcgtgccgaattcggcacgagccgaggtccaagtggagctactagcggggaaatctggagaagcttcggatgtgatgcggattaactcgtacgaagatttagttcggcagtgtcgactagaacagaaggtcttgcaggatatctcagtatttggctctcgggagtatgagctagaccgcgctgcagaacggctaatctgcataaccactattttgcgaaacctctccttctacgatacaaaccatactcagcttactgaaaagttagtactaaggttcttctgcacagccattcgatatcttggaacccgaaaattgctcctacgtaccagctctaatacgctagacttcatgaaagacgccgtcatcttcctatccaatctagcgcaagaaattgaactctcaggaaaggaggaagcgctgtatctgctcattttattctcgcgtttgcaacctatccgncaactaacaatgctaattctagcaataaccgtnnttttcgccatacgaacctgctatacatccgatttctactcctgccgtanaacagcttg

SEQ ID NO: 92681 - DNA, 416 bp, Triticum aestivum
  unsure (1)..(416): unsure at all n locations
  Clone ID: PAT_TA_92681
agaatagtctcgagtttttttttttttttttttttttttttttttttttttttttttttttttggcctggctagatcccaagaagaaatacatgtacacatactanctcggaacaaacggnggaaatgtttcacgcacgtttcaaaaacacgggtttttttgtacagtaatttccatctattttgcattgctacacgngcatctattccccgctatcgctcctgaaagacgntgggactagatcgccaggcccttcagcgaaatcganccaaacccttcantctggtcttcagncgatcccancacccccggagcggtgcgtgttccaattccgtaattagatcggcgtaataggttggnttaccaaatggcttcanggagggacccttttaanggataattcctgnanaaacgat

SEQ ID NO: 92682 - DNA, 362 bp, Triticum aestivum
  unsure (1)..(362): unsure at all n locations
  Clone ID: PAT_TA_92682
ctcgtgccgaattcggcacgagcagcacgcgacgtggncagcgtgagcaccgcgcacgggcgcaccgcccccgtcttctgcacacgccgcgatctcgactcaagcaacgcancgagacgagaccaaaccatggcggccaaccaccacctccgncgcctcgcctccgcgtcggcccccgctctctcccgcctctccaagccccctccctcgccgctcctccgccccgcgttctccaagctccgcctcccccgcggatcaacacggcggcgggcggngggcgccgcttaagccganaaagggnanncccaaaaacgcttnaaggaangnngatcaagcgnnaaggntgtggtgctntgacacca

SEQ ID NO: 92683 - DNA, 547 bp, Triticum aestivum
  unsure (1)..(547): unsure at all n locations
  Clone ID: PAT_TA_92683
ctcgtgccgaattcggcacgagattgacggtaaatgtatccgtaatgttaacttctctgcctttggggtgctttgttagtaccctgaatttagcacaggcaagagattgtagagtacgctgtaactccaaatcaactagtcctgtgacttgctgtatcgtggaatatgataggggatccgaaggcttaacattattaaataagacaagaactattgcttgaaaggcagagactaaaagttctttcgctcctttgttaaactgagccttgatgacacaatgagctagggaatttttccacgttaaacgacgaccagagtgttttttggtataaaagttatcaaatttctcaacatgaactgccacttcagggggtaggttaactacaacttcgggatatgaaggccaggcagcttcataaagaatatttacttgaagatcgataagtttccttcttagaatttttaagtgacttccggtangcagcatcccanccccaagaggttccaaaaccctaaacaattggtccaagaatccggaggganggtn

SEQ ID NO: 92684 - DNA, 543 bp, Triticum aestivum
  unsure (1)..(543): unsure at all n locations
  Clone ID: PAT_TA_92684
acagctctaaggttatgtccaaaagctggaacgacttgtgggaagaagaggaggaagaggaggctgcaaggaaaattaaactgcgacaaatccagaactcgcgaacatggagtcatgagagtgaacttgaagttcgctcaccacagaagcactgccctgtagatcagctcagaattagagatccttcaaaaagtgatgcatttcttgaggagaaaagaacggatatcgacggagattcgattgccgacggtttcttttttcaggatattcctagcgattacacggccccacaattatctcctcgatattcacctccgtacaaacgtaacgactcagacaagtggctagcccttggagaacgtcgtcgggcccatcccggatcacaagaatctggaaatgggttcgagtttgtcaaagaagtatattcctaaagctataaatgggataaatggtccctgctgggagcaangacacttgctgggaatcaataaacggaacttaacnaagaaattggtncaaaagnatccggcaaaagcnntcctc

SEQ ID NO: 92685 - DNA, 559 bp, Triticum aestivum
  unsure (1)..(559): unsure at all n locations
  Clone ID: PAT_TA_92685
atcacgtctgaccgatcgatcgaccgccgactgcccgactcctaccgtccagcagccgccggccgggctccgcttctacgatcaccgagcagggaacggcggaggaagcaaccccgccccgggctcgccatggggctccaccagcgggacgacnccgggggaagcagcgacaaggggaaggccgcgctctgcgatgacggcgcgganccgggggcgcccgcgcacgcgaccggccgcgtgccgccgtggacggagcagctgacgctgcgcggnctggtggtgagcgtggccgtcggcaccatgtacagcgtcatcgtgatgaagctcancctcaccacgggcctcanccccaacctcaacgtctcngccgcgctcatctccntcgncatgctccggggctggaccaaggccttggcccgcctgggccgagtcgtctgcccgctcacccgncanggagaacaaccttctngnanacctgcgcctnngcctgctacaacatcggcgccgcccggtggnttcgngtcctactgntccgggttcaaaaggaagacctaacgnn

SEQ ID NO: 92686 - DNA, 328 bp, Triticum aestivum
  unsure (1)..(328): unsure at all n locations
  Clone ID: PAT_TA_92686
ctcgtgccgaattcggcacgagctcgtgccgaattcggcacgagaaaaacctctataaatagagataaccagtccttcaatttgtatttatctagaacatttgtgtagttaactttttcgcacaagcccacccacaacgcaagagtaaatgcagcttcttcgtcagaggcagtgtaagtttttcgcatgtaggctgttgagttagtcttgcttaagtttgtgatcttactgcccgccttaaacactgcgctcaaaaaaaaaaanaaaaaaactcgagggggggcccggtacccaattcgccctatagtgangtccgtattacgcgcgc

SEQ ID NO: 92687 - DNA, 155 bp, Triticum aestivum
  Clone ID: PAT_TA_92687
ccgacttcggcctcgccaagctcatcaaccccaaggaccaccggcaccggacgctcaccagcgtgcgcggcaccagggggtacctcgcgccggagtggctcgccaacctgcccatcaccgtcaagtcggacgtgtacagctacggcatggtgctg

SEQ ID NO: 92688 - DNA, 474 bp, Triticum aestivum
  unsure (1)..(474): unsure at all n locations
  Clone ID: PAT_TA_92688
gagtaattgacatcaaggtctgaacaaccagcagacctaggagaggctggctactcgttcaacaagtatgttcacagtcaagggcactgcgattcgagcatcacgcccccttacggtgggtgccacacgggcccgcctatcgcggtgtcgtgccgagtcgaccgcctcatctacttcggccttggcctacaaggccattcacagtcgcattcatcctctccctacgcccgagacgccttcgtcctggtcagcgcaggcggccgtttccaacattctctacgaaactccgtcacccgctatcacgcccgccaagcgtcacatactcaattgtctagttcagaatgagccaagcgtgctctcccgtctatcgggaantctcgcggcggcgtggcttcaacattgactcgttaancgtctggcaaaacngagggttgaagatctaancccggtangnctaatggcccncnccgggca

SEQ ID NO: 92689 - DNA, 565 bp, Triticum aestivum
  unsure (1)..(565): unsure at all n locations
  Clone ID: PAT_TA_92689
ctcccacaatcaggacgacacaataaacagcaaaatttaaacactttattagttatcaccttatccaaaatggtcaacgtcccgaaaactcgacgaacgtactgcaaggggagagattgcaaaaagcatactcagcacaaagtaacgcaatacaaagctggaaaggcgtcactcttcgcccaaggaaagcgtagatatgatcgcaagcagtctggttatggaggtcaaactaaacctgtctttcacaaaaaagccaagaccacaaaaaaagttgtattaaggttagaatgcacgtcctgtaaaacgaaggcacagctagcacttaaaagatgcaaacatttcgagctaggaggagacaaggaaaacaaagggcgcggntctcgtggtttagacttgcattcctaaatttaataaatgaactcctcagaacagtcatcttaacctatacactggtcgtggtttcaagntcnagacatgcaatttaagttccaanccaaaatagacgcaaagntcgacctatcaatccatcnantcanatagattatgcactaaggtaccggttann

SEQ ID NO: 92690 - DNA, 575 bp, Triticum aestivum
  unsure (1)..(575): unsure at all n locations
  Clone ID: PAT_TA_92690
ctcgtgccgaattcggcacgagcttagccacaaaccaaaggcatccctaaaacaacgatgctgtctgccatcagccagaaccttttaaaacgagtcacatctactcggctcaagaaaccaaataatgctctttatggctaccgccagacaaaccattcaaagatatactttgctagcaacaaattgagtagtataacagtgttgtgtagtagaaattcttattctacttcacgtatcaaatcatctccaaaggttaacagcgtcaaaattacaggaaaggacagccgtagccgagtgattgaaaatgcgttgcgtagaagcatcaagcctaagtcatcgcgacttttaatttccaagaggcctggaatcaaatcatttaagaaatcagncaaacctcgcgggaattatcttacaccacangaaaggttgcgcctaaagtaagagangctaggacgaagagtncaaaagctcctaaaacccttccccggtacaaggcngcttaanttacatggaaaagaaccttacanggacaggntaaacaactaaanccgtatcnncgaggntccgtcaagtgg

SEQ ID NO: 92691 - DNA, 573 bp, Triticum aestivum
  unsure (1)..(573): unsure at all n locations
  Clone ID: PAT_TA_92691
ctcgtgccgaattcggcacgaggcgacggacagcattccacactccccagcgatccgtcgccggtgtacgtagccagccagccagcgagcgatcaagcgtagcgtgaaccgaccatgccgatgatctccgtggcgccgccgccggccctggccttcccgaggctgaccacgctcacgatgccgccgcccatgatcgcgctcccggaccgcgcccatgccgacgcgccgcgcccgcccccgccgctcgtggtccgccacgccgccgccaagcacaaggccgtcgtcgtcatgggcgccacgggcaccggcaagtcccgcctcgccatcgacctcgcgctccgcttcggcggcgaggtgatcaactccgacaagatgcaggtctaccaaggctccgacgtcgccaancaacaaaggtcctcccccgggcgagtgcgccggngtgccgaacaacttgttcgggcttcgtcaaggaaccccnacaaggaccttttcggcggcgnatttcgncgaaaaggcccaagcgncccgcgcaaggcgccgcnncgggtnagttcccgttctncccggggntcn

SEQ ID NO: 92692 - DNA, 408 bp, Triticum aestivum
  unsure (1)..(408): unsure at all n locations
  Clone ID: PAT_TA_92692
gaattggtgaagcgggcgggtgcggatccctttccgagtcagcggcgggacgatgcacaaaatcccgctatccttgacgatctgggcgagcaagaatttggagtggactcaataatacgagcgagaacagtgagacgtggccgtggtagtttcaggcaagccctagttaagtggactggctgggcagaaccaacttgggagcccattgaatacgtggcagacaccgaagctttaaaaatatttgaggagacctatggtcccataacttcaaatgatggcccttcggaaatatactcaggtagatacgttggccaggccgagcctcatgtccagaaaacgcggagggaacgacgaanaaaaaaaaagcattaataagaaaatttaataaaatatttacccacattagga

SEQ ID NO: 92693 - DNA, 571 bp, Triticum aestivum
  unsure (1)..(571): unsure at all n locations
  Clone ID: PAT_TA_92693
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactgggcaantgtggaagcttgcctaatgtttcggggtggcaccgacgccaacgcaaggtgattaaccanggtgggagggaggtcaacgaaaggattacctgnacccttatgtcgnaanaatcggnttcgacnacatggcgncaagtgnaantgcntcagnntcaacgcctnaaaccaccngggtgcnaaggagtcng

SEQ ID NO: 92694 - DNA, 564 bp, Triticum aestivum
  unsure (1)..(564): unsure at all n locations
  Clone ID: PAT_TA_92694
ctcgtgccgaattcggcacgagggacaacacgcagggcatcaccaaccggctcagcttcttcatcttcaccgtctgcgtcttcttcttctcctccaacgacgccgtcccggccttcatccaggagcgcttcatcttcatcagggagacctcgcacaacgcctaccgcgcgtccgcgtacgtggtcgccggggtgatcacgtacctgcccttcctcctgctccagtccgccgcctacgccctcatcacctggtgggccatcgggctccacggccagttcgtctacttcctcgtcatgctctacgcctcgctcctctccaccaactccttcgtcgtcttcatcaagctctatcgtgccaaacttcatccttgggtacgcggctgtgatcgcgttcacggggctcttcttcctcttctgcggntacttcgtggacagccacagcatcccgcaagggtggnagtggatgaacaacgtgtccaagatgaagtanccgtacgaggggctcctaatgaacgagttcggcgggaccgcaactttccgtcgacccgccgctcgaacggaaagg

SEQ ID NO: 92695 - DNA, 573 bp, Triticum aestivum
  unsure (1)..(573): unsure at all n locations
  Clone ID: PAT_TA_92695
ccctagctcgcctcgctccgctgctcgcatcgccgccgctcgcctctctcttgctcgcgtcgccgccgccatctcgcccgcgtcgacgtcgatgctcgcctccaccccacacgcntcgccgccgncgacttcctgtgacgtcttcgccgctcnctctcacacgcgtcgcctacaccagcgaagtcaccacaagattgtttttgttaccaaagcggcggcnaggagnagctggagagttgtanccatggctggatctgaagtgtctggacgtccccgngatgaggatgagtgggaggagcangagcacatctgaagatggtgaggagtggaggcgagtggntctgaaatttgaagatggtgctgtgaggagtancngggaggagcaatcgncngaaggactggctgcatggnggtaaggcctccccnttcaactcctangggaatcatggtcaatcttgctcgaacgacgtnnnatcggctcgagggacatcatgnctcgatgatntcctncttcggnaagaacttctggggggttgtaangaggagangtcctgggcncaaaagaantggttg

SEQ ID NO: 92696 - DNA, 203 bp, Triticum aestivum
  Clone ID: PAT_TA_92696
ctcgtgccgaattcggcacgaggagagaactagttcgagttttttttactttgatcctcttgttatgtttgttgtcgatcatacagagagccaggcaggctacatgtttcaattaagtatgttcatttaaatgtcaataaaattattaagagcctaattttggggccgttaaaaaaaaaaaaaaaaaaaaaaaaaaaaaaaaa

SEQ ID NO: 92697 - DNA, 477 bp, Triticum aestivum
  unsure (1)..(477): unsure at all n locations
  Clone ID: PAT_TA_92697
ccagaatcgacgggctgcacgcgcactcagcgtcgtgccacttctcagtcttatagcctacatccccacactagtggtgcgcgccacggcctggctctcgctcctcgccatctcttcgctccttgcgacggcctatttgctgctggccctccctttcgaccatcccactggcctctccatgctcacaccttccctacgcccacgcccgcgctcgtctcgctcgccacgcccgccctacctcggacccgtcttgcagcatttgcccgccctcaacctcggccttgtccttatcctcgctgtcgctgggagtctagcacgtcgacgcgtccccaagtatctggcttggatttggctggctaccagccgccatctacgcattcgtagncctctttctttgtatcatgggggagtgtttaatcccgaggaaagaactaaanccgtctccgctacaatngcaagggaagcngtaaaggcttc

SEQ ID NO: 92698 - DNA, 448 bp, Triticum aestivum
  unsure (1)..(448): unsure at all n locations
  Clone ID: PAT_TA_92698
gatgaaggaatattaataagaataatagtaaccataanaaaaagaataatagnatgtataatcgtgcttagnataaggcggggaaaattaaacaaacgaactttgcttcacatgttacattctacgtgtaattctatctcaggctcgcttccttccttccttgttcggctcgtcgacgggagggagatgggnccgggccggagcaggtggctcaggagcactcggcccagccctcctcggctggggcggngacggcggcccggacagcgntgcgcgccatccacgacnccaccgtgataaccagcctcgccggnacgtgcgagcttgcctccaaccngcggngcaacgcggactccgcgcagtcgngatacggcgaactcngaccaaganctcggnggccatcgtcacccggtccgggactcngagaggcnggtgacnncacggncca

SEQ ID NO: 92699 - DNA, 552 bp, Triticum aestivum
  unsure (1)..(552): unsure at all n locations
  Clone ID: PAT_TA_92699
cctatttcaaaattttaaaatcgcaagttctatatgctgcgttgtaactagatctctaaattcaacgatataatgtgatcacacaactacgaagccttccctaacggagattcagcatggaaatttccaacccaaacccgtatctagcaatacacctagttcatatttagaatacgtctaacttcatcagcttagctcgcaattttctatctaatgctgaccaaatcacaggtgaaagtgtctcatcagacttgagaatcagaattagtcacagatccaggtacttgaacaaaaatcgagcgttgatgatccaaccagacatgagccaaaaatactatcagaatatctctatcctagcggcacggagtaatgagaatagctccatttatgttgccgactgcagagtcgcgttgtgtgacgcgaaccagctgctgggtttgcgaggttaagtcatggtaaanggcgtgagctgcaacgacngcncttgangttgtagggntcacaanggccgnaaactcaaccncggttaaangnggaattgncccngcanaa

SEQ ID NO: 92700 - DNA, 559 bp, Triticum aestivum
  unsure (1)..(559): unsure at all n locations
  Clone ID: PAT_TA_92700
caccactcctaagtactcgaaggctcgttatgaggaaattgtcaaggaagtctcttcgtacctgaagaaggttggctacaaccctgacaaggttcccttcgtccccatctctgggtttgagggtgacaacatgattgagaggtccaccaaccttgactggtacaagggccctacccttcttgaggctcttgaccagatcaacgagcccaagaggccctcagacaagcccctgcgtcttccccttcaggatgtttacaanattgtngggnattggcactgtgcctgttggacgtgttgaaactggcgtcatcaaagcctgggnatggntggnacctttggacccactggtctgacaactgaagtcaagtctgttgngatgcaccacgangtcctctgctggangcgcttcctgggtgacaacntccggnttcaaatggtcaaagaacgttngctgntaaangatctgaagcgtgnntttgttgcatccaacttcaagggtgaccctnccaaangaagnggcaaccttaactcccanggcaacantatgaccaccctgggn

SEQ ID NO: 92701 - DNA, 560 bp, Triticum aestivum
  unsure (1)..(560): unsure at all n locations
  Clone ID: PAT_TA_92701
ctcgtgccgaattcggcacgagcagtaagtgtaattcgttaattgcccaatttaaaatttaaatcatccaacttatttattttctgctcttgtcacataaagtcagcgtatcgcaatcgaaaggatggccatccacaccattacaagtctagatgaataccacaagcttgccaagagtcacgacaagattataattcggttcacggaggagtgtaatggtccctgtaaaacgattgcccccctctatgaaaagttatctgagacacataaagatatctttttccttagtgtcaatgtgggacaaatgtaaggacgtagcaactgaatttangatcaactcgatgccaacatattttgctgttaagactagaaaaatttgtaaagtcctgggccgggagcgaatttttacgggttaactaaaccttggttggcgaagcttcaaataaaccttggggccgggtttggaccaagttccggtggacctggccaagntttaaagaacgtcaaaattggctcaatnacaactccgtnaatttcaaagggggggncccggnncccaa

SEQ ID NO: 92702 - DNA, 560 bp, Triticum aestivum
  unsure (1)..(560): unsure at all n locations
  Clone ID: PAT_TA_92702
ctcgtgccgaattcggcacgaggtctccacttgacagaattgttccttctgaccatcaaaagacaattgaatctttctatgactaaggaataatttagtccatgataggagtgacacaggaagacccaggtctttcatggttccgagaagttgatccttggctacatggtcaaatgcacccttgatatcaagaaacagtgtagttgtcttcctgttatgctgcttttgggattggatctcatcagcaaggagtagtgctgcatccactgctgactttctcaaccttcctcctatctgggaagagtggangaagatctgttgtttcagctagtccactaagtctcttagctatgattctttctagcactttccccaggcagttcaagaagagatatgactctgtaagccttgggaagctgcataatctagcttatttggctttctgagtatagctccagttgctctctccaacacctgggatggnatcctgagtttgatanagatgagtanacctctaagaacaaantgggaatgggctcatatgcttcnataanaaggnn

SEQ ID NO: 92703 - DNA, 568 bp, Triticum aestivum
  unsure (1)..(568): unsure at all n locations
  Clone ID: PAT_TA_92703
gctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtgggaggaggtcaagaaggagtacctgacgcctatgtccgcatcatcggnttcgacaacatgcngtcaaggtgcagtgcgtcagcttcatcgccttcaagcaacgggcttgcgaagaagtccggaaaggcctaaacnagntcantcacgacaggcaatatttaaagggcaatngcanttttgcaaatccggnaattgcnttgggtttccttccaantaacnttt

SEQ ID NO: 92704 - DNA, 511 bp, Triticum aestivum
  unsure (1)..(511): unsure at all n locations
  Clone ID: PAT_TA_92704
actccgcccacgccatggaggtgtccaaccaggcgtcctggcccgacgacttcctctgccccatctcgctcgaggtcatgacggaccccgtcatcctcccctccggccacaccttcgagcgccgcagcatccagcgctggctcgacgggggccaccggacctgccccgtcaccaacctgcctctcccccctgaccccacgctcatccccaaccacgcgctgcgccgcctcatagcggccgtttccgtttccccggcggccgtgtccgcggacaaggtcctcgcgggggactgccaggagcaaggggtggcgccgccgtcgtcctcctccgtcttggggatgctcaggctggtcangtctgggccggccggccggnatggaggtgctggnagtccggcgcggtcgcggtgctgctcaagaaggccgccnccggnggaccangcngcggncaagggagtcctgtngttcagcctcnaacggcgacnangcgcnccgtccggtctcgntggcgg

SEQ ID NO: 92705 - DNA, 564 bp, Triticum aestivum
  unsure (1)..(564): unsure at all n locations
  Clone ID: PAT_TA_92705
cataccttcttcccagaatcagaaaagaatccttcgaaatgtgtaacgtccacatcaccctcaccacttacacctgcaaccatcaaatccgcaggattttcctggctcctgatatggctaaaagcatgtgtcctacctgcattagtatcgtgcgatcagcacgtgaagcagccctgtcaaatcctcggtgaatttttaaaggatttagagctagccaatgataggagaggaaataagtgccattttgagatagagagtcgagcccgtttttattcagctattaagtttctaccttacttatttttgatcgtcgaagacaggacgtcagatcattgtcatcaccttggtatttgagcggcatcattttctatctgatgatcaacgtcgatatgccattctttccaagccgtnaaatncaaaatataanctataaanttagtggggggaaatttgtggctgtgactgggnccaagnaaanttcaagtngaacgattganaactcctgactggaaatttcaatttttttccaaaagnttagcttcnattancaattattaantattg

SEQ ID NO: 92706 - DNA, 570 bp, Triticum aestivum
  unsure (1)..(570): unsure at all n locations
  Clone ID: PAT_TA_92706
tcagcaatctaaaaagttctatattatccaatcttcaaccacaataccaccatccccatccattagtcgctgcaaaatatcaccagcttattgagtaccaatcagaccgagacgaaaaaagtcactaagaaagctattttaacaccttcaacaaagaagcaagagaccccttcttgtcttcctttcggcacgtcgaaaggcattcgagaagagatctcaatctgaaagctcgtcaatctggactttgacgctcgcgtcccgatccctttcagcgtttttccctcgtcgtaccggggcgaagagaagcaggaaccggctccggcagagggtcacaacgaagctgagcaccacaacagcagcccagagcaagccgcctcctgtttcgcacagtacagcgcctccaagctcctcaatcagttgctccatcaagttgctccgtcagttgctccgtcagtaagtgangaagagattangatcacgcacgangataaatacacggcatcaagntcacacaagngnacactcaatttcctganggacgaaggagatacanccaatcaanancacaca

SEQ ID NO: 92707 - DNA, 551 bp, Triticum aestivum
  unsure (1)..(551): unsure at all n locations
  Clone ID: PAT_TA_92707
aaacggaaaaacaattactgatagcgttgatctattcgttgagatgaatgctatcgctcgtcgtcacggggttggcagaattgacattgtcgaaaatcgattcatcgggttaaaatctcgtggctgttacgaaactcctggcttcacctgtctacggtcagcccacatcgacctagaagggctggttcttgatcgagaggttcgtgcgcttcgcgatcaatttctcacggtcaattattcgaagcttctatacaatggattatacttttctccagaacgtgagtttcttgagggctcgattgccgttagtcagaaaaatgtcaatggccaggtgcgctgcagagtctacaagggtagctttctagtgctcggacgaagttctgataccgagaaactgtatgatgaaagngagagttctatggaccaagataggttctttctctcccgttgatacgacgggctttatccgctgtacaagccatcccgttaaagaaatatggggaagncaagggtggcaanggatganncactcctaggcacganacttctag

SEQ ID NO: 92708 - DNA, 563 bp, Triticum aestivum
  unsure (1)..(563): unsure at all n locations
  Clone ID: PAT_TA_92708
gtaaaatcaggattgacgtgttgtaggtgtgccaagcgtgttcccttgagaagcaaaaatgttgcttgttagttatgcaagagtgggtagaaaccctgaaacaaaaaagctctagtgcttcccaccatgaattgtgtgcggcgacctcagtaaacaatcggttcgtcccaccgctctgcagcaacagcggttctcagatatatagcccagaagcttgtccgcgaaggtagacatcgccacttcgcaacttcgcctaatttcagatatattttccaacatgtgtgcattatgttcttccaaaatggtcataagcgggtggtctgcaaatgacgggtatttcaagtcggagatggttggagaaatcttcttgtccaagtttcagtgaagctgcttcgtaacatgggaagtaattgggttgtgttgggtgctttgtgccaacaaaaactggggcatgatgggggcaagtcaagaagctacatctgggccgtgantgtggcttttcgtaatggactccgggagtaacaaacatcttgaacgcgncctaaaactagctccancgaatg

SEQ ID NO: 92709 - DNA, 466 bp, Triticum aestivum
  unsure (1)..(466): unsure at all n locations
  Clone ID: PAT_TA_92709
ctcgtgccgaattcggcacgagctcgtgccgaattcggcacgaggcggagtccatgatgggacaagatctccgacaagttccacggcggcggggactcctcgtcgtcatcctcggactcggacgacnagaagaaggggtcggnggcgggcgtcaaggccaagatctaccgcctcttcggccgcnagaagcccgtcnacgccgtcctcggcggcggcaagcctgctgatcttgttctatggaggaacangaagatctcaggaggggtgcttgctggcgctacggccatctggctgctgttcgagatcatggantaccatctgctcaccttggcgggggcactgcctcatcctctccctgggcaactcctcttcctctantccaatgtctgcatttttcgtcnacaagtctcccccgaagatncctgaggnggaaantttcaatangacaatgactgtaaacattgga

SEQ ID NO: 92710 - DNA, 422 bp, Triticum aestivum
  unsure (1)..(422): unsure at all n locations
  Clone ID: PAT_TA_92710
ctcgtgccgaattcggcacgagctcgtgccgctcgagttttttttttttttttttggtaaataatcggccggagacgagaatacgtctatcgttaattcatgcgccactgttttcatctattttagcccacaaggcaggctgaatgaatagatgtctgcccttgctactcaatatctaacgatctaaacaagtgatgaatcaacgagatacgtttaaaattcgatcataagttcaattttctacagaagcttcccaagtgaacaagcttgtagtaatttaatataaattgaatggtgaaatcatgcggtaatggttcaagcggntcaagttaaggngaatccttggnctccacaagaaatgnttttaataaataaggnttaaaaaaggggggtaaaagattttaaatgggntttggcaagtt

SEQ ID NO: 92711 - DNA, 532 bp, Triticum aestivum
  unsure (1)..(532): unsure at all n locations
  Clone ID: PAT_TA_92711
ctcgtgccgaattcggcaccaggttcccctctctctctcgcccccgattgaaccctagccgccgctcgccgctggccgtcctcgactagagagggagggcgccgccatcgccaccagtccaccatggccgcctcctcctcgctccggatccccgcaccaaccaaccaccccgccgctccgcagtctcctctgcctccgccacctcctccccgcagcagccgccggcaccgggcgacggcgacgacgccaacaggcccaccggtgtgcccgtgccctagcccttctcccgcgacgccgggtatcacgctgcctcggccgttgacgagcacggatctgatggggcangccagggggaaggcctcaggttcgcttaccaggggtgcccgggcaccgcggatctgcaggtcgagccttctcctcctctctgctcctcttatgggagattggccaatgagtgccttttttatgtcttgctcctggtagagagtaagactattattctctctgtgcgcttaattttggncgttcttgc

SEQ ID NO: 92712 - DNA, 482 bp, Triticum aestivum
  unsure (1)..(482): unsure at all n locations
  Clone ID: PAT_TA_92712
ctcgtgccgaattcggcacgagccccatcgggctgctgcacgagttcccggaattgcggcataccggtggcatcagatgcgcgccctgggcgcagccggcagggtacaccgtcgtcgcgcccgacacgaacaggtacgacggctccaactttccccacgtcatgcaggaccagtacaccgtgctgcatgtcgtcggcaacatcgtctgcccatcgaatccctcggcgagaagcacctcttcgtggtggcacatgaccgaggcctgatgataagctgggagcatgtgcttgttccggcaggacatggttaaacgttggncgcgttagccgtgggcaactncaagtccttggtnaaaagactcaaatntggcggantcaagnncaagactggaagctggantnaacnggcgaatggnacaactgggancgccccaaanaacaagagcatgttactatacnggtgcattatngngttctttggga

SEQ ID NO: 92713 - DNA, 505 bp, Triticum aestivum
  unsure (1)..(505): unsure at all n locations
  Clone ID: PAT_TA_92713
ctcgtgccgaattcggcacgagcaccttccttcctcccccgtcgtcgcggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatctggtctcaagaagagtgggaagaaatgagtctgcccacccttacgtaatgcccaagaaaatgataatctatctatctacctatctgtgtcgcgcttcantatctgtgggtgttaaaagactaacttcaattgnggttgagcaataaacaattgnccgaatcngttggtgaaacctaagggaattngangaagctcctccggntanccgggattcaaaattggccctaanctaaa

SEQ ID NO: 92714 - DNA, 295 bp, Triticum aestivum
  Clone ID: PAT_TA_92714
ggcaagtttacattatatccctccattaataacctgtaaacggttgcatgtagcaatgattttctatatagattatatccaatcaactattcgagattacttcgagggaatccctaacttttttcaactccgtgccgatcaagttacgtagcccagtctgcatccacaaaggccatcctcgaattgtcgttccgtaattaagctttggtggtaacacaatttggccaccttttccggccatgacttgatcaacgataatatttacgacgtagtctggctccataactgggggggg

SEQ ID NO: 92715 - DNA, 560 bp, Triticum aestivum
  unsure (1)..(560): unsure at all n locations
  Clone ID: PAT_TA_92715
ctcgtgccgaattcggcacgagtctacatccagcagaacgtcagttgggcgctcggcttcgggatcgccaccgcctgcatcgcggccgcctacgccgccttcctgctcgccacgcccatgtacaagcgcaccatgcccaccggctcgccgctcaagagcctctgccaggtcgtcgtcgccgcctgcaggaaggtcagcctctgcctgccctctgacgccggnctcctccacgaggccagcgacaaggacgacgagcccagaatcgcgcacancgccgagttcagcttcttcgacagggcggncgtctactcggaggctgggacctggcgagaggatcgaacgggaagcgggctcggtcctggaaagctcctgaacgtnaacgcaagtcgaaggaactcaaagatnctggctccgggntcctggcccgtcctgggacgaacaagcaatcaatcgtctccggtgggaataatcccaagatgaacaacaacttcatccaacaaggggaagcggcaatgggcaacaaagtgctgnctctctncaataaccgcggggtccctggn

SEQ ID NO: 92716 - DNA, 433 bp, Triticum aestivum
  unsure (1)..(433): unsure at all n locations
  Clone ID: PAT_TA_92716
acggaatcgagcgctagggttgccgcgccgccgccggacccgacctcgccgccgcccctcttcctcctattctccaggcancggagccgcccgccgcctctcacgggaaaggggaaggcccagagcaatggcatcctgcgcgacgacgccgccggcggggaagcggncggcgacgggcgggcgggagggcgaccagatggtgatcaccccgctcggcgccggnagcgaagtcgggcgctcctgcgtccanatgacgttcaaggggcgcacagtcntcttcnantgngggatccaacccgcgtactccggcatggaggntctcccanatttcgatnanatngaaccctccggcatccaagtcctgctngtcaaccaattncanctggatcaangccgnctcgctggcaatantccttgataaaaanaacttcaa

SEQ ID NO: 92717 - DNA, 376 bp, Triticum aestivum
  Clone ID: PAT_TA_92717
ctcgtgccgcatgcggtacgaccggctgcgcagcgtggccggcagggtgcagacggtggtgggcgacctggccatgcagggggagcgcgcgcagtcgctgctgagctggcgcgacccgcgggctacggccatcttcatcaccatgtcgctcctcgtggccgtggtgctctacatcacgccgttccaggtggtggccgtcgtcttggggctcttcatgctccgccacccccgcttccgcagcaagcagccgtccgtgcccttcaacttctacaagcgcctccccgccaagggtgacatgctcctttgaccatgtttcttttctcttcttttttgcgtagaagtcctcgaaaattaatttcaagtacatatatattca

SEQ ID NO: 92718 - DNA, 456 bp, Triticum aestivum
  unsure (1)..(456): unsure at all n locations
  Clone ID: PAT_TA_92718
ctcgtgccgaattcggcacgaggtcacattcatctgcagccattcttataaaggctattacctcggaattagctctctggattagatagtgacaaacagagattgggacctcaccatcttagaacatcgcctatcaatttacaccatcacctgagttaatatcttctacagcatgtctctctctcgggcattcacagtcagaaggtcgaataagttatcaagattcgagtcccgctggcccttcgagaagcttgacaacaaagcgctcacacattggtggcacaattcgtcataagatatcggnaccaatggnacttatttcaaccacgaatatgatttcttacaatgcacctaacgttccacagcgagctacctcgctctcttcaatttcaagcgaatcggntagctctccantggnatcaatctcancaatgtcanccatagactcanactctg

SEQ ID NO: 92719 - DNA, 502 bp, Triticum aestivum
  unsure (1)..(502): unsure at all n locations
  Clone ID: PAT_TA_92719
ctcgtgccgaattcggcacgagctctattcgacatcatcattatctncctcgacacaagtttgagctatcnggnctaaancangctgtccactttgtgttatgcnacgacctcccttttcttcatcntgttccannanaccaattttctctaaagnttgcatannttttcggtcgacacttcnacttgcgnagacatggtgtgcatggtcgagatccacgagtgcgaggtcgagcctcgtgccgaattcggcacgagtcgagntttgggggagcagtacnaccgaagtagagatgggttgagttgtgtncgncttgagtggngcgagnntttctccgttgnttnttcttttgtncaatacattgctgcgtgtattatttccgtcncgagngtcgtcggntacaatatgctgnngatttcactgaagaattcgctgncaggnacgnactgntcgagggttccggcgnggnccagtgcccangggccccaaaaaanggncggag

SEQ ID NO: 92720 - DNA, 525 bp, Triticum aestivum
  unsure (1)..(525): unsure at all n locations
  Clone ID: PAT_TA_92720
gaactagtatatttcctagttagcccgctcactggcatttgactgagggtgatacgccgttgtcagtcgctgcgaaatctttgttaactcacagaatgccttccaaaaatggcttacccagtcgctgccgcggtaactagttaggtatctaggaaatccgtggtagcgatagtatcggtcaacaaacactttggcacattcttctgacgtcattgagtttgtaccaaacatgaaaacttccttcgacaaacgatcagttattaccataatattggtacacccatttgacgggggcagatcagtgacgaagtcaatcgtaagttcacagccaaccctttctggaattggtaacgaccgaagaaacccagcttttgcttccctccaaacagttgagcgtccacaaacgtcacaattccgaacaaaccgacgcaacgattccctcaatttgggccaaaaccatctccgtagtangatanctaacaatggggtctctccctgggatgtcctgcaaagaatggntatcng

SEQ ID NO: 92721 - DNA, 536 bp, Triticum aestivum
  unsure (1)..(536): unsure at all n locations
  Clone ID: PAT_TA_92721
ctcgtgccgaattcggcacgagaagaaaccccacattcctcccaaagcacacaagcagctgaaactccgataatggctaagatactacacgaggtcctatccattaaaacatccattgctcacagcaatcttcccactcgagtccaagaaaagtccagggctaacgtcgcaagtcagccgcagtcaataggtagccctatatggatacaaagtgaagacgaaaagaaggaaattgccgaactctcgagtaaagagttggtgagaaagattggattaagggaataatcggggtaagtcatctgtcaaacggacaagttaaagtctactatgtaggacagaatacgaaagaagtcacggagaaacaaaaggagtgaacgaaaaagtaggaacaacagtgcaaataagccttcctaactaccaggtttctagtccgcaatatgcctctatcctacanccccganggaccangacaatatnangacttaaagggggaaatacccnttaanancaaggaattcgggtaaaaaaanggccgt

SEQ ID NO: 92722 - DNA, 541 bp, Triticum aestivum
  Clone ID: PAT_TA_92722
ctagcgtgcacatcaaatcccttccgcatctaattatgtcttcctttactcgagctttccggccagttttattcagatcaaaaattccaaggtgcagcaaattcacaccttttgtacggtgttctgcagctcggaacttctctgccactcctatcatcagagcaaagaaatttacaaaagatcatgaatggatcgaagtttctgaggatgggaaaaccggcactatgggaattacagaatatgcatcaaagtccttgggagatgtagtttatgttgaacttcctgaagtaaaacttcaagcagtcaagggtgaatcaattggagctgttgaatcagttaaatcagcttccgatattaatgcacctgtcgcctgtaccatcacagctgtcaaccaatcgctggaagattcccctaaaataatcaacgatgaaccagaaaaaagtggctggctcgccaaggtggaattgagcgaatctggaataaatgaaatgcatgatttgatggatctccaggaatacaaggactttactgagaaggatgt

SEQ ID NO: 92723 - DNA, 529 bp, Triticum aestivum
  unsure (1)..(529): unsure at all n locations
  Clone ID: PAT_TA_92723
cattcatgggatttgtcgagcagggtgatgaggttattgttttcgaaccatttttcgatcaatacatcagtaacatcgaaatggccgggggtaaagtagtttatgttgcgctacaaccacctgcttctggagactcaaagaacacagcggcagccgattggagcattgacttccaagagctcgaggctgctatcacgcccaagactaaaatgatagttcttaacactcctcacaatccaatagggaagattttttccaaggaagaactcactcacattggcgaaatttgcgtgaagaatagtattttaatcttatcagatgaggtatatgaccgactattctatgtaccattcactagaattgctactatttcaccagaaattgagaacctcacactgacagttggatctgcgggtaagagtttttgtgccacangttggcgaagtaggatggctgataaggccgtcacacctaatccgattacgtggcgggaagcacacactcggatttgctacaactccgggccggg

SEQ ID NO: 92724 - DNA, 531 bp, Triticum aestivum
  unsure (1)..(531): unsure at all n locations
  Clone ID: PAT_TA_92724
ctcgtgccgaattcggcacgagctcgtgccgaattcggcacgagtatggcggcctccagcagaacggacatcactcagcagggcctctggcgaatggtcacacgcctggacattactcttctcagcagagtggctatggctccattccagggccatctccaggccattacagtaaccaccaaataggttataatggctcgtttagtgccgggggctacagccgtgcacaagcaacagtaagtcctcaatggagcgcatcaccagttcaaagctttggaaatggatatgctggatatcaagggtaggaatcttcatatatcagacgcatttgattggtcagctgtctcaaagcttgctacatgcggattggtagcaactctacacttgagctcggatcgtgcttttctgtcttgtttatcagataaaccatcccaatctttctcgtgaaatttcgttgggaaattgttttaggcataatgttttccactagattatttctgtattgagttattttcgggaaggtatgttttn

SEQ ID NO: 92725 - DNA, 159 bp, Triticum aestivum
  unsure (1)..(159): unsure at all n locations
  Clone ID: PAT_TA_92725
ncgcaacaaggtggccggcttcaccacccatctgatgcnccgcatccagcgcggccccgtgcgcggcatctccctcaagctgcaggangaggagcgtgagcgccgcatggacttcgtgccggagaagtcggcgctcgaggtcgacgagatnngcgtcga

SEQ ID NO: 92726 - DNA, 525 bp, Triticum aestivum
  unsure (1)..(525): unsure at all n locations
  Clone ID: PAT_TA_92726
ctaactgcattagcantgcataatttgcagaaaacacatacgccaagggatgtttcatataacaaagccacccttcgagattcatataataaagcagtacatctgcagagtttacatgcataacttgcagagcttcattgcatatacaccagaccggaccatatgtcacactgactaacatcatcgtcctcccgagaggcccgagatcgtgccgatgctcgtgctctcgagctgcaggtatggcatggatcctgctttgccttgcatccaaggcggcatgctgaagcccaaatgtgttggtgccaactccggcagtggcacgtcattatcaaggtactggagcacccgtcgcatgctgggccttgaagcagggaaaggatgcaagcacaggagacctacttttaacacaagacagacctcatctttgactgtgccgcaatccgccttgtaacctcctgtccgncgtctccatgagcgaccaattgggccaatgttgaagaaccangttgacagnatgagccggtt

SEQ ID NO: 92727 - DNA, 473 bp, Triticum aestivum
  unsure (1)..(473): unsure at all n locations
  Clone ID: PAT_TA_92727
ctcgtgccgaattcggcacgagcaaaaacgataaatttccctcctccgctgcatttgatgcaatcaataactctttcaagagctcagaggctgaccgaatcaaggccatcaaagaagccaagtcggtcttcgccttcaccctgaagaacaaggctggtgaaactgagagctggcatattgacctactgaaaaagggtgaggtggggaagggacttggngaatctcccacagncactctcaagatgtcggacgaagattttggcagattagtcaacgctactgaagacccacagaagttatttatgtcaggtagactaggggttgagggagatataatgaaggcaaccaaattgcggaatttattcanaaaatctcangcggtcaagtcaaaagttataatatgttgtcaaaataatttattcgggccgtagntaatttttaatacgattaagtgggctttcctcaagaaaaaa

SEQ ID NO: 92728 - DNA, 536 bp, Triticum aestivum
  unsure (1)..(536): unsure at all n locations
  Clone ID: PAT_TA_92728
ctcgtgccgaattcggcacgagctcgtgccgaattcggcacgagagattagattgacaaggagagaaaaagctgtgcaaaaggcatctttacataaatactttatacgatagcttcattgcctttaataatccatgatacacgcccattagtgaccacttcacttgttcatcccacgtcccaagtcccagctgcctattcatcctcaagaggtgaagccgcattagagtgatgttcccacgtagaccaagatccgagctttgcatatcatgacttggtttcctccttgctagtatacacagcatcgtaactttatagtggaagatggccagttttgagtgaggcaaattcccaactgctattcagttaacttctttatcggttgtagagacgaggttgtgtagcaagattgaggtanaggagtcgcgtgaggaatggttggtcggacatttgtatttgaanttggggttggaaaatttgacccggcacgagggggggcccggtaaccaaattcggcctataagtgagtcgtantag

SEQ ID NO: 92729 - DNA, 523 bp, Triticum aestivum
  unsure (1)..(523): unsure at all n locations
  Clone ID: PAT_TA_92729
atgatattgtagaacattatgaatatcttcagatcggtctcaaattctcacctgcccttacaatgttatagcagtactcgcacaaccattcatagaaggattcatggagtcggcaagcgatgcctgtcaaatattgctcgaaaaccttcaactgctcagaaaatagggttaatattttctgttaccataagcagcggattcttaataaattatgctggttatatgggtatgcttcatgcagaagctatccagttaccgacggtggaggaatctgatcaacttcaagcaaaatctcttcaaaaaagaggtgatatattgagctcttcgcaaatccaagccatgaatggatgggaatatcctggagtctatgcgtggggaaataatactgggtcgtgttattgaggactcaagatgagcctttcgtcaaaacnggctaaacggataccttaatttggatgggaaactatttcgcgntatgaaattggntaaaaacttcggggcaacaattgctgaaaacggngat

SEQ ID NO: 92730 - DNA, 162 bp, Triticum aestivum
  Clone ID: PAT_TA_92730
ctcgtgccgaattcggcacgagcgggattcccgacgattgagaaggaacgatgataatgaccaaagcatttttttattgctggtgctagtggcgtaattattaggcagttattttgagatcatctgctctggttaaccatcattatacaaaaaaaggggggg

SEQ ID NO: 92731 - DNA, 462 bp, Triticum aestivum
  unsure (1)..(462): unsure at all n locations
  Clone ID: PAT_TA_92731
ctcgtgccgaattcggcacgagctcgtgccgaattcggcacgagggggattgggaggcctcgagtcgaagccacctcccccgtccacatccccgcgcctgcctccctccctctgcaattggctcgatttgggcggttttcttggtctcttggttggagtctagggccagcgccaccaccaacctgcgcgtctcgtgtgaaattcgtgttcttggctctgcttctgctgggttgagttcttggtttgcttccggcgaattggttgccttcgagtgagggaggggatttttctggaggntgttgtcctcatgaggacggacgtnaggaggggcncggcgtgcgacnnngatggaccanttcctgtcggcatgcgggtcctccggcngtggacnacgacccggnctgcctcaaaggtgcttcnagaacccncctgccgncgctggccaagtatcaanttgacggg

SEQ ID NO: 92732 - DNA, 561 bp, Triticum aestivum
  unsure (1)..(561): unsure at all n locations
  Clone ID: PAT_TA_92732
ctcgtgccgaattcggcacgagcaagctcagactgatggtgttgagacattggcgtttgcaccattaccgctgaccttattggctgctggcagtgtcgatggtagtatcgtactttatgactcggcccatcgattcgctgtgcgaaaacatatcaaaaatgcgcacgatgaacatagtgtggtcaaagtagactttgtgtcgcagccagacaataaatatatactgacaagctgtggtatggatggcgttgttcgaagatgggattctcgtggcggcaatagtgcggccaattctggacttctgcgggaatggaagggtcaccgaggcaatggcgagggcggcggagttcttgattttgtgcaaggagatggcacgagaattgtgacggcgggtgatgatggtatctccctggtcctttgatgcgtccatgacatgagacactggccgctcaatttgcatgactttccaacaaaacttcctcccaaatccangcgcctaatccaatttggnantaatatgcacaaaaccaattgggaatcccttngagggcccaacccaaa

SEQ ID NO: 92733 - DNA, 387 bp, Triticum aestivum
  unsure (1)..(387): unsure at all n locations
  Clone ID: PAT_TA_92733
ctcgtgccgaattcggcacgagatcccccggaaccctccgccccttcncccctaaatctctccgccccctccgccgcctcgccaccctcacctcagcctcaccctcgccgccggnccccagcanctctcccaaacccctgcccgatgacgtccccggcgccagcgccgccagcggccgctgcggngcagtccccgcctccccgcatcggnctcgccggcctcgccaccatgggccataacctcgcgctcaacatcgccganaagggcttcccgatctccgtctacaaccgcanngccgccaangncgactccangctctccccgcgcngccgncgagggtcgngctccccgatgatcggtcaccgggacgctncgncaanttcgtcg

SEQ ID NO: 92734 - DNA, 461 bp, Triticum aestivum
  unsure (1)..(461): unsure at all n locations
  Clone ID: PAT_TA_92734
gtcggcaaaaaattgcctgaggaaggaagggtattgatcctcgacaatagcctgccgtatatgccgcataagggtcaacatgtgccatacattatgtagggtgaggagatgagcaccaacggtctctctggtagccaggtgatgaacaaaggaccgcgtgatcccaagaccgctcccgccatcctcaatgtcatcgccagcggagacaggccgacaacaaacacactggcatccatcttctaaaggcgtcaagtcggcggcatatttggcatttcgtaagttgatgactccatgacttgtaatggcattcccaaaacgagctgtgcgtgtaggccagacgcagtcaaacatatctgcgccaagtgcgacactgacgacaaagatncacgggattaccaacccccattacataacctgggttggtcnncgggtaaaaggcctggtgcaagtatcaacaactc

SEQ ID NO: 92735 - DNA, 535 bp, Triticum aestivum
  unsure (1)..(535): unsure at all n locations
  Clone ID: PAT_TA_92735
ctcgtgccgaattcggcacgagctcgtgccgaattcggcacgagagagaacaagccgcagtatctagcggaaaacagctaatcgagaaagtaaacgagaattgctttgaaaaatgtattccgaaacctggcagcgtgctttcgaatggngaaacatcgtgtctcactcaatgtatggaaaaatatatgatgatgtggagtgttatacatcggcaatatactcatcggatatcagtcgagatgagcaaaagtggtgcaatgggtacacagcaaacttaaatcagataatctagactgtcgacgaatcaaaattcatgctacagactcagattgattgttcaaaaaattggnacctggataaanaggtaagacttgattaagaaagaggatgaagggcgcaatattcaagatagtactactccttatgtgagcaactgtttaaaactaccaatgtgcgaatttatgcnggatcatttgcctcagaacgagtncnanttcaaatcgacccaaacgaggncttatcaaannanggaaag

SEQ ID NO: 92736 - DNA, 330 bp, Triticum aestivum
  unsure (1)..(330): unsure at all n locations
  Clone ID: PAT_TA_92736
cccgtatatgcgcccggctctctaaagctacggcggcaccccattttctacgcctccggaacgtgcgcagtctcctgacggctaagtgtgcggccgcggcaccgcccgcttttgaacactaccactgcgtgatctgaataatctacggctaagcgtgccaataatatcaccggttagattatcaatcatcctgcctgtaggagtagattaggctgctgtgctgtggactgtctgtggaggctggctggctggcggctaaggccgaacaaggcaataaaagcgagcgcagttaggtaaagggtgtanaaaagaaagggnaaaanggggcgg

SEQ ID NO: 92737 - DNA, 422 bp, Triticum aestivum
  unsure (1)..(422): unsure at all n locations
  Clone ID: PAT_TA_92737
ctcgtgccgaattcggcacgagctcgtgccgaattcggcacgagctccaaatttcgccatggttgaactgcgaaaagcgttcgctaagccaaaattctctccctttctgggtcctcangatttctatgantcgggcgnagcaggatccacggnaacagcaancacgcactttcatcaatcgcctcctcattccgacgacgattctttatctgagtcttccatctcatccgcatgcaccatcaaaccaccccangatcaaccgccagaggaaattcgcccagtatctanaatcaagcaatcgatnagncccatcccatggnccaactattttgnacgcganatctacagtcaatctgnaatttggnnctgaaacaatcctccaccatggntatttgacctgnccagtctagngttgcaccatt

SEQ ID NO: 92738 - DNA, 594 bp, Triticum aestivum
  unsure (1)..(594): unsure at all n locations
  Clone ID: PAT_TA_92738
aacctcaatgactgaggggtcattatttcctaaataggttatgacctcggattgtcgctcgcgcaataacgttgtatctcccggagtttgatactatcttcgttatgggcaagcagaagggcatatgctctacttgcgccaaattaatccaactaggaggctgtcaccttcttgaacccaagacaaggccatcgcctttgagttgcaatctctaaagaaaattgaacggccgtcgcctgagaagacgggaggttatcgccttcgttagggaaagcacaggtcaagtactgaagataaggggtcgctgcgaagcccttgtgaggattgatggttccaaaacgcaccagtagccaagcccgtcgatggactctaagagagagagcccacgggtcaaatgagtcgacccgaaaggaacaagnaagaaagaacataaacctagcagctacagtacgaaaagctggtaaattaaattcctncgactctctcccgaagtttgtcgaatctaaactgacaagttcctaacccgaaaagctgtcgcaaaaatcccantggctgaattccgatagcaantcgantcaactcaattagctnccc

SEQ ID NO: 92739 - DNA, 592 bp, Triticum aestivum
  unsure (1)..(592): unsure at all n locations
  Clone ID: PAT_TA_92739
ctcgtgccgaattcggcacgagttttttttttttttttttttttggacgagtaaactgtttgtcaaggctattatccgagcgctgacagcagaccctcctctccctccaaacgacgcattattcgcagatcggcccaaaattacggtaaaatcgccatcgaaacaagcatatttcgcccaggagagaaaatgcatgacgcacaatccgaattttatgctcctagcttttcccattggctccaacgcccctaattcgtcacatcgtgccagcaaaaggtgaatcaatggtataatcaaactccgtctcctgaccctccgcggcccagatcacggcgggtcacccctaattattgacgcggtggtcttgttttgaatttaaaaattatcttgaaagtgattagctgcgacgaaaacggtcaagctcaagctgggtgatggtaatggccgattgtctgggcaatttaatgatcgcgcaatggncctttgtagctttcgcctgttaacggggcgaatgttgagcgcgggtaaatcctgctcaattgatgggttgcaaattctccaagtagaatatccancgccggngaatggaaca

SEQ ID NO: 92740 - DNA, 578 bp, Triticum aestivum
  unsure (1)..(578): unsure at all n locations
  Clone ID: PAT_TA_92740
ctcgtgccgaattcggcacgaggagagagagaactagtctcggtttttttttttttttttttttttttggggcaagctaaggcttctgttcgttgtctgttgatctattctagaaaagctttgatacttattctccgtggaattaattatcaagagaaaagaattgttccccacaagaacttgcctttcatcaatcgaacgagaaatacttgctttgtggcaagttacaagttcgatttaatcattttggtggcactagcctctttgtttatggttacttcaccattattttctccattcccaaagaagataacctcaactgtcagatcatctcgatatcttcttgagtatggagcagttagtgatagtaatgcagacaccaagtcactgttgtttcccccaagggcgtttcgaactagatgcgttgcaagcatttttgtcctgtacaacaaatcctttcatttcagtcttgataccccattgcttttgccaaacggggtcntctgagaantaagggtctgactgncaatattcagcgtgatgggcanactaaatttcncgcctttttganttccgtt

SEQ ID NO: 92741 - DNA, 575 bp, Triticum aestivum
  unsure (1)..(575): unsure at all n locations
  Clone ID: PAT_TA_92741
aacaaatccccacccaatctcgtctccgatcgacccgaggctcgtcgaatccccaccgcctcaagatgcagatatttgtgaagacactcacgggcaagaccatcacccttgaggtggagtcgtctgacaccatcgacaatgtcaaggccaagatccaggacaaggagggcattccgccggaccaagcagcgtctcatcttcgctggcaagcagcttgaggacgggaggacccttgctgactacaacatccagaaggagtccacccttcancttgtcctgcgtttgcgtggtggcatgcagatcttcgtgaagaccctcaccggcaagaccatcactttggaggttgagagctctgacaccatcgacaacgtcaagggcaagatccaggacaaggagggcattcccccggaccaagcaacgccttatctttgctggcaaagcaagctggaggatgggcgcacccttgccgactacaacatccagaaggagtccaccctcaactggtgctgcgcctgcgtggtggatgcaaatcttcgngaaganccttacnggnaagacaatcactctggaggngg

SEQ ID NO: 92742 - DNA, 571 bp, Triticum aestivum
  unsure (1)..(571): unsure at all n locations
  Clone ID: PAT_TA_92742
cttcccgctatcatgtcgtatttaaatatctattatttacaaattactagtttaagtagctgcaagaagctatttatagtaataagctgtaattcggttagggagttcgtttgatcccctaaaagttatgtatctaggggttgagccggagcgttacctttaaaatttcatcatgagaagattagcaacgcttggcttcccgttccgctttcctgagagctctttgtcggatgccttcatgcatttgtctgttcttttcaacaaccaagcttgtaccaaggccgacagtgttgtttaaccaccaatgcattattccatggccccagaatggtgtggatgtgtaagccatatcctgggctccgccactgcgtccaatcttacttagaacgcttctgacaaaggtcttcgggttcgggatcagtaaacttggttttcttanctttgacatagctgatgtgacgagatagctgataacaaggtccacgtcgacgttggatgactttaattctccccctaagngccgttgaccaangttgcaagaangcntttggnggccaagaatatgncnctn

SEQ ID NO: 92743 - DNA, 593 bp, Triticum aestivum
  unsure (1)..(593): unsure at all n locations
  Clone ID: PAT_TA_92743
ctcgtgccgaattcggcacgagccctccccccgccgcgtctttgactccatcgcctcctccctccccctccctcctcgtcgccggccagccaggtagttcgtagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagagaggtatcaccattgatattgctctgtggaagttcgagaccaccaagtactcgtgcactgtcattgatgctcctggtcaccgtgatttcatcaagaacatgatcactggtacctcccaagctgattgtgctgtgcttatcattgactccaacactggtgggttttgaggctgggaatctccaanggtggcaagacccgtgagnangntcctcccttgnnttcaatccttgggggtgaancaaaatgatntggtgctgnaaaaagatnggttcn

SEQ ID NO: 92744 - DNA, 585 bp, Triticum aestivum
  unsure (1)..(585): unsure at all n locations
  Clone ID: PAT_TA_92744
ctcgtgccgaattcggcacgagcgattttcgaaagtgtggtgatgactgcatcagctccttcaaccatatcaattggtaaataccctgccctgccaggatttttctttgtaggcccatttttgcttggctcaccctttctctttgagcctagttggggggtaatgtcaaatggttcagtagctatatgttcaccaaaaccattcagcctcgggaattcagagtcatggngatctacacatttttcctttcctttgcgagtgtttgattttacaggctcttccatggctgattggtctggttggtgtgtgtatgaaatttcggacatattgtcaggatctaaactcataagttgtctctccatatttgcaaagtccgtcagtaaaaggatctgggcgaagcttgactggnctcctaaatctctcaatttcgaantgcttttttttaattaatangtantttttttccaatttaatttaanttaattggtnatttccctttttttaaatcaaagtcacgggatataaacacgtgatcacgtgacctggaanttaatncccngaaattgacgcntgaacgacccaatt

SEQ ID NO: 92745 - DNA, 573 bp, Triticum aestivum
  unsure (1)..(573): unsure at all n locations
  Clone ID: PAT_TA_92745
gagagtatttgacaattagccaggcctgctagtcagggcagttagacagtctggcaataggttttcaagtcgtacttggtgtgtctggtttgagcccaagccaaaccccaccaaatatttggcttaggttttgcctgcccatgttttggacactgttggcaagataattgaaagtgggctaaggagcatggtcatgccaaatttttgtcagctatccaagcaagaaccaaaacttcagtcatgaccaaagcattcctatagtcgatgttaagacctcttttattgcgcacagaattgaattgctgacataaatctctggggcatttcattcttgaacagtattaccattgcatatatatttgtagaagcaagttaagttattagactaaaaaactgctggnctcctgaacaagctgcatcancancaanggaacttggaactgtgatgcgcccccctgggggaagaaccccactgagggnaaancttcangntaatggtcaaangnaantggttgctgatnggaaatnggaaccaattggcntttcccggggttccctaaaccgnngggaccc

SEQ ID NO: 92746 - DNA, 575 bp, Triticum aestivum
  unsure (1)..(575): unsure at all n locations
  Clone ID: PAT_TA_92746
aggagggataagcatttccttgaggcagttaaagagactggcaacggaatattcctacccaagtcatctatcctcccgatctgctgatcgagatacttgtaaacatcgccaagagttgtccactcggcttcgcaaattttccccaggctaaaacttggattctgaattgggattgctttgtaattgatatggagtaaattttgggaaaagaaagcttcgcgtgatcctgagatttcgtggtaacgcacataataattttctttgaggataggcaggttgttcaggagataaaatgtggtctttaggccttggtcaatggatagcgcgtaagtgaataagtagatacagtacatggttaggcacgtaatgtcggagtcagaattagggtttgagtcgaatgtagaaaggtggatagatatgcctgcgaaacgtgaaggcctcgaaatctagaagcaaaaanagtatgggaaaccggaagnaagaacnagcacacgggaaaagtgagtganagaatgattgancncanagccccatngaaggattaggnntaggcattagaanctttcaggnggggc

SEQ ID NO: 92747 - DNA, 564 bp, Triticum aestivum
  unsure (1)..(564): unsure at all n locations
  Clone ID: PAT_TA_92747
ctcgtgccgaattcggcacgagctcgtgccggttttttttttttttttttttctcccattaattgtgaggttagtattaatgcgctttgacgtaaataccaaccactagattttattattacaaaatataatttatatagcactctgtgtcctagtgggagtaattaacaactctccacgacagatttacagactcctttactttcccactcgcttcaccaagtgatacaatctgtgcctaacagccacaagcttttgcaaaccaatccgctcaacacattctgctacttcgtgagtaccagaacacttttcacatcgctgtcctttgacgcagtttctttttgagtgaaaaccccagcaacgttgacatttctcgatggagcgtcgacgggagaacggtatagctggcccattctcatcaaaaagtctaaatcggaggtttagtggcacttgtttgaagtgtattatccagctagcggagtagcttcctaattttttgtcgtttgggtgcacctgtattggtgtgacctcacaaactacctgatattctgtttttancatttc

SEQ ID NO: 92748 - DNA, 583 bp, Triticum aestivum
  unsure (1)..(583): unsure at all n locations
  Clone ID: PAT_TA_92748
agagaagatgcttcctgttggaccaaagctgctgcgcaccctttcgatacattacttggaaaacaatgactatgttctgaatggtcagtcagctgccaatggtgacggttcttcacacggcgctaaactgtcaccaccaaatgacaccagtacaaacttgcaacaggatacgttaagcaacctggatggttctggtactgaccatgtgaaacggaagagccaccgtagcatctccatggatggggttcttcataaggncccctatgggcanaggctttctggagataacattagacaagaacttcctcgatcagcctctggcacatatgacanggatggtctgaaaccttacattgggactgctgcaaagagacatgggaacagcggttttcgggcgttcgcgttccctaactgaatcactggagagctactctcacttgcttgantccatttcaagcagtgnatccaaaagggggtctaacaagctcgaaagtccactaagggatcactcccttggatggccctggtgtaacaactgcaactgganaagaacntccaaanttccaagctcaagatnaaanaa

SEQ ID NO: 92749 - DNA, 556 bp, Triticum aestivum
  unsure (1)..(556): unsure at all n locations
  Clone ID: PAT_TA_92749
ctcgtgccgaattcggcacgagttgcaatcctactggctacaggagagaaatcgctgtacacagatcgtctagttatcaccaatgatgcaacatcaaattcacactatggcgtgtacagtccccgaggaaaagggtttcctgaaccaagtgcagactcagctatttttatgactaagagcaatgtgaaaatcaatggcacacacgtcaaggcttattgctccctcagtattccaggtcacgagatagctgagaaaatggccaacggtttgactaatattaccaaacacgcccatcgaaattttggcaccactccccaggcagaagaggagtgtatgaattcaattaaatctctgtccaagagggctcttttttacgaatccaagttagcatgaaatcctgcaaaagaaagtgatagctggctcctcctggcgctgataancaatccaagcctatcaaggacaaggtttaagtgcgaacaanggtccggccgtttggacctttcctttaataagaagaataaccccggttgtgccggntgatntntacccatggaaa

SEQ ID NO: 92750 - DNA, 566 bp, Triticum aestivum
  unsure (1)..(566): unsure at all n locations
  Clone ID: PAT_TA_92750
cctttcaatcagataatatccgccaacataggaaatcctcaacagctcggccagaagccgataactttcttccgtcaggttctcagcttacttgaataccccactctcttagagaatgaagatgtactccttaaacaattaggatacaaggtagatgttattgaacgagcaaaatggctgttaaaatctgtaggcgccattggtgcctacagcgctagtaatggtgcacctgccatcagagagagcatcgcaaattttatagaaagacgagatggncatccggcagatcccaaggatatttatctttcagctggcgcctcttctggagtgaacaccttgctaagcattatatgcgcaaagcctacaacgggagttttggtgccaattccacaatatcccctgtatacagcgacactttcaagtcttaggtgccaaatgcgttccatactatcttgacgaatcaaagggatggggaaccgntgttgaagctatcaaggntgcatatgagcagggcaatttctgagggcaaaagacgtgagagctantggcattantaaacctggaag

SEQ ID NO: 92751 - DNA, 565 bp, Triticum aestivum
  unsure (1)..(565): unsure at all n locations
  Clone ID: PAT_TA_92751
tacaaggctaaatagtgatacctttttacgcatgcgtcatgcgcatcttccattgcaatttcattagttacgcgaaaacaatctaccaaacatgccgcccgctatatttcctgcaaatccgcttgatagcatcgcgctgcccgcaatgttggatgcctggctgaatttatcacacctagaaaatgccagcgtattcgtgaaggctaagcaaagcgcgattacgaccagagtgagccatataaattcaaaactgaatatagctaggaaagcaagggcgatccaaagtataggttgtgtgtatagagctatccaaaagaaccgactatctgttgcatttatcactttagtagcaggatcagcgctttcaaaaacccaatgtgaatctccagtttgcgtgtttacttcattccaacaagcgaanggcgactaagggtcctcccaacgatgtttttgagggaataaaaagtcggcgggcgaanaagttangatgggaacaattaaagataaagtacaaaggtttggggtaaaaattaaaccaaataantacactnagaagagaagcgtt

SEQ ID NO: 92752 - DNA, 239 bp, Triticum aestivum
  unsure (1)..(239): unsure at all n locations
  Clone ID: PAT_TA_92752
ctggaagtcaaagagatcgcggacataatgctgcaggaggttttcaccaaggctcaagaccaaggacatcaacctgcaggtgacgganaagttcaaggagcgggtcgtggacgaagggtacaaccctagctacngagcgcngtcgctgangagggncatcatgangctcctgggagggacancctccccggagaaaaatttgggcgggngaagtcaaaggagggcgantcctgtcaaac

SEQ ID NO: 92753 - DNA, 383 bp, Triticum aestivum
  unsure (1)..(383): unsure at all n locations
  Clone ID: PAT_TA_92753
ggacattgccggtgatttatgctagaagaaatacagctgtatacaggaagagggacttaagtgtgagaagaaactaccctgcacttgtactaaactgaatatcgtacatgattatggaaaaactttgtttttgcccattttgcttacgccactctanaanttgacatcttacttttgtcactcttaacttttgacaatgcatcgcaagtgccattccaaggcaatgtcanataattttatttcacttttgccactctaagcttttgngaatggancacanttggcactccattttttttgcttttgccacggnatggcnattgngaaatattgncaaaggctaagnntgggaaaagtgnaaggccaaattccaanggggaatt

SEQ ID NO: 92754 - DNA, 345 bp, Triticum aestivum
  unsure (1)..(345): unsure at all n locations
  Clone ID: PAT_TA_92754
gttttttttaaaagaaaacaaatgntccttcnacgggcaaatnncaacgnttttcaaaanncaagggcncttcgggancaagggacaacanggatattcaaacagcaatcnnacagggancggnaagcanctgacgaactcnaggngcangnataatctaatccancctggccttgggcaatcgctcttgaacttcggtcggtgtcacaatcanancatancctccccacacactgtggggagtcacggtnaactgtcgacancacaagctttgtgntatgggcnctaaaaggttccncaggggtcaacgtttgggttngtcaangggtnaaaacccgtggcgga

SEQ ID NO: 92755 - DNA, 364 bp, Triticum aestivum
  unsure (1)..(364): unsure at all n locations
  Clone ID: PAT_TA_92755
tttctctacaactatttctcaatctcttctattataagactttgaatgccttcggggcctgcagcacttgaatatctcttaatgggcttaccatcttttgatacgagccacttttcaaaattccacttgaccctcttcattcccattatgccaggtttctccacttttaaccactcaaaaagcggctctgccgtatcaccattcacattaactttgcccaacattggaaacgtgacgccataattgatgcgacagaagttctgtatctcatcatttgatcctgggatcttgtccaacggaattgggttgcaaggnaaacccaagaatccgtgaatttcccccgggtggtgttggatgaaaattg

SEQ ID NO: 92756 - DNA, 558 bp, Triticum aestivum
  unsure (1)..(558): unsure at all n locations
  Clone ID: PAT_TA_92756
ctcgtgccgctggtgttaagagcatcaaaagccatgggcagcgggagaaaagtgtggcatttgagatcgagagtgacaatacagatgaggaggaaatgaacattttggccgcaagaaatcataacgcagggagagctgcattatctgaaaataatctaccacatcacagatccgggaagaacattaaaagaggaacgaacgaatccatagaaacttcagactcgtgtataagtctagctcaacagacatcgagagaaagacaangttcacatttacagtctgcgctttcccgaatacgtccgaagctcaggagaagggaaanaacgatgtcaaactcaacaagggaagagctaagtgctctagaaaanaagaanggagcaactncaaaatancgcaagggccaanggttaccaaagagagtgaagcgaacattagcaaagtnggacaattgcagnnccactttcaacaagcattatntcaaggcaaagcgcaatggnatatcaacnaaaganattanttnagaattatgggggctcnaaaaccnatcagcttctagcn

SEQ ID NO: 92757 - DNA, 555 bp, Triticum aestivum
  unsure (1)..(555): unsure at all n locations
  Clone ID: PAT_TA_92757
atttccaaagactcgcagattagtacttctgttcaatcaatcgacatttgatcattagcttgcaataacaaaccgaatctatatactagacaattcagaccttagccacaatgcattgcaccctcgcgtttcttctgctcacgacaggcggattgaaaaatagtaatcttttagccttgggcaacaactacgaccaaaattcttactataatgtctatgaaatccgaccacgtcaaaaaatttcccgcactgggtggatggaacaaaccatatttaggacaattacggttaataanggttgacggaangtaggttgaaaaaaatggtccggaangnncaatgggggnaaaaattatgggngagagtnngccagggcncaaaaggggaaattntggggtttcaaaggggcaaagggggnactncgggggaatcccagggnccccgtgtgtcccgtngggaangngttcaagtcaaacnggggggncaccaaannaanaaaccccatgggataaanggcncagaatttttcnaaaaaaacnccgggtttaaagntcn

SEQ ID NO: 92758 - DNA, 327 bp, Triticum aestivum
  unsure (1)..(327): unsure at all n locations
  Clone ID: PAT_TA_92758
ctcgtgccgaattcggcacgaggcctcaagagcctcgccaccagcatcaagtccatcaacatgggcaaggtctccggcgtgcccggcaagtgcggcgtcagcgtgcccttccccatcaagcatgtccaacaactgcaacaatgtcaactagttcaatatataatccttcctacgtgcatgcatggacgcgcttgcgtgggagcttaatttctacgttgatggagtgctcatacgangttgagctactaaaaattaaantgaagttgcctggggngngtaatttcagtagggngncaangccggtacctggcaaananacggnggggg

SEQ ID NO: 92759 - DNA, 561 bp, Triticum aestivum
  unsure (1)..(561): unsure at all n locations
  Clone ID: PAT_TA_92759
gtgggcgggacgctctaagaactaagtgggatcccccgnggctgcagggctccgtgccggaattcnggcacgaaggttggttcaacactaagagttttggtattttgaacctgggnactttaattttttttaaagaataacttgataacttaactaanaccaagggcaantgccatccaaggaactcaaggaaancccttacttggctcctcctgggaagcctcngtacaaggtaagcccgcgatgactacagctgcccgcaantgctaccccaactgggactctgtgcaagtacaacaagcaagntgaaacaaccngantttggtaaatgctgggncactgatcccgtgggngtggaagccaaagntcaaaaaaggtttcttggggngantcaagnggaagcccttngangaaaaggaacccncngccttttggaanaaaagccccaaanaggggncnaaaattcannggttaatcccaanaannggccttttnantaagggngcnttcnaaaanaaccttnctgagtccccctttcangtagcccaaaaaaagtatgga

SEQ ID NO: 92760 - DNA, 559 bp, Triticum aestivum
  unsure (1)..(559): unsure at all n locations
  Clone ID: PAT_TA_92760
tcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgaagttcagcaaggttgggtttatcttccgtgagcacaacgcatcccctgggtactacgatggccggtactggacaatgtggaagctgcctatgttcgggtgcaccgacgccacgcangtgatcaacgaggtgganggaggtcaaagaaaggagtaccctgacgcgtatgtccgcatcatcgggtttcgacaacaatgcgccaagtggcagtgcgtcaagctttcatcgnccttcaagccaacgggctgcnaagagtnc

SEQ ID NO: 92761 - DNA, 415 bp, Triticum aestivum
  unsure (1)..(415): unsure at all n locations
  Clone ID: PAT_TA_92761
acacaatctaaattacaaaatatgaactacatatctaaattacaccacatctaatctaacaaataaatctatgaactaacaaaaaaatttaaaaaaaatctaacataatatgaacaaattaattgcacaatctaaattacacaatatgaactacatatctaaattactacaaatctaatctaacaaataaatctatgaactaacaaaanaatctaaanaaatctancaaanataanataaagttgctcacggccggcgacggcgacggcgaggtgcagtagggcgggcggcgacgtcggggtggggcggcgacggcgtcggtgcggcaggggccggcggcgacggnagctgagcnggggcggtgacgngcgcgcnccgggggaggcagtnggacnngtgtnggggcggngcggcg

SEQ ID NO: 92762 - DNA, 537 bp, Triticum aestivum
  unsure (1)..(537): unsure at all n locations
  Clone ID: PAT_TA_92762
ggcttgggatggtagcgctataggtttgttggctagtgatcctgaatctgttcgtggaggaaatccggtgaagtgctggtcttttcctgtagttgaaggttttcctcctaaatcagcttctgagcaagtggttcataagtttcctttcctcaacactatggcttggcctgatgggttgtgtgaagaggtgttcagggtttctaacgtagttccggaattagtgggtaatcatgctctcgcagaaattgggaaaaccgttatatctggttatatcactaaggaactgtggaggaataagattccgcatgacggttggtctgccatattgacagagatgttggatgatcaggctatgtctaggaaagctagagaaactgatttgacaagacaatgtcgatttttccaattttaggattactgggactaaccgttaccgacgatgcaaaaatattgcttgcttaataagtgcancatcngtcgtggagactcaagaaactatagacatgtcaaggactggttggggttcctaaaaaaaaa

SEQ ID NO: 92763 - DNA, 509 bp, Triticum aestivum
  unsure (1)..(509): unsure at all n locations
  Clone ID: PAT_TA_92763
ctcgtgccgaattcggcacgagggccaattgatgtgaccacagctaatgagtctagcacgttgcatcgattgccactggagccctcatggcgggcatcaccctctatccaacgaacacattacatgctgaatcaccacaagaagcaaattcaaggaaaccaatttatgacgatgcacctgctcaatcgatgacctccgtaacctcatcaatagagaggagagagacaactcctggattaagatcgcagtctgttacagatcttcttgcgaaaaaagttggtgtagctaggttgttcctctattctcatgtcccgaagaatggnaagataaagtcaacgacttcatgggactcctggccttttgagctgggaagaacaacttnaaccaagcaacaatcccaacctttgggtccccggcggccaaaaaaaagggngaaaggattatggcaagtttaatccaaggtggnatccccgntaaggntgggancaaantgncccnaaatcnggata

SEQ ID NO: 92764 - DNA, 478 bp, Triticum aestivum
  unsure (1)..(478): unsure at all n locations
  Clone ID: PAT_TA_92764
ccgcgctgccccgcacgccgatggtagtgccatggtgggaggtctagtgctcccccaagccgcagcaccaggccgccacgccaagaaccgccgccccggcgccggcgaccacgacgcaagcgctggagcaggcgccatgctgcgccacggtctcggcgcggctcgtgcgtggcctggacgaggtcaggaaggcgcacgcgaggaacttcaagctcggcctcgaccgctccccgccgcacttgcggccgctcctcgcggcgtgcgcgctcggggagtggccgggcagcatggagtacgcggcggncatcttcgccacgctcgacgagccggaggcgttcgactacaacactctgattcgcggtcacgtcgtcggtggccgcnaacccngcggcggcctggcgggtgttcgtccaaatgcttcaaaaaggggtcaaccccaacggtnaancttcccgttnaanctncaagggttgggaaa

SEQ ID NO: 92765 - DNA, 435 bp, Triticum aestivum
  unsure (1)..(435): unsure at all n locations
  Clone ID: PAT_TA_92765
agaaatgggctccgcgtcggcccctaanccgccggntcgccgggttcctaancctggcgggcaagcgcggangggtctctgatnccggggntcccggacgangtcgcgggcgtcancctctgnctgntcangttccccgaccantcccgnctccgcgncaactcccgcgcgtggngggtcctcctctccgncgngangcttcttccgntccgccgcanantccgcctggcttnccgccaactcgtaangcttttncccanngagccaancctttggntccccannctggtcgaaaccgctgngcccaaaggctgggggggcctcccgccnattcccggtccncggaaatatanagggntccncaaattttccgctaatcngcgtccgggaggnaactctaaaaccnccggggggtntcaaattttanacccgggg

SEQ ID NO: 92766 - DNA, 551 bp, Triticum aestivum
  unsure (1)..(551): unsure at all n locations
  Clone ID: PAT_TA_92766
ctcgtgccgaattcggcaccagcaggacaaggtgaagggtggactccttctggatgttgtagtcagcaagggtcctgccgtcctccagctgcttaccagcaaagatgaggcgctgctggtccggcgggatgccctccttgtcctggatcttggncttgacnttgtcaatggtgtctgagctctcaacctccagagtgatggtcttgccggtgagggtcttcacaaagatctgcataccacctcggngacgcangacaaggtgaanggtaaactccttctggatgttgtaatcaagcangggtactgccatcctccagctgcttgccagcaaaagatgaggcgctgctggtccgggggaatgccctccttgtcctggatcttcgncttgacattgtctatggngtccgaggactccaactcaagtgtaatggtcttgccaattagggtcttcacaaagatttgcatgcctnctccaagacgcaagaaaaagtgganggtggactccctccggaatgttggnantcaagaaanggtncttgcgtnctcaactt

SEQ ID NO: 92767 - DNA, 534 bp, Triticum aestivum
  unsure (1)..(534): unsure at all n locations
  Clone ID: PAT_TA_92767
cctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaaagctgcctaagttcgggtgcaacgacgccacacaggtgatnaacgaagtggganaggtcaagaaggagtaacctgacgcgtacgtccgnatcaaccggttccacaaaaagggccaagtngantgcgtcaagttcaacgncntnaag

SEQ ID NO: 92768 - DNA, 561 bp, Triticum aestivum
  unsure (1)..(561): unsure at all n locations
  Clone ID: PAT_TA_92768
ttttttttttttttttgttcacgattttatgttaattttaaaacgtccacgtaaattagtggccccactagctatggtcttgtgactttgaatccgtcgacaggattcctgactgctcgaatgacaaaccatgagctatgatgcgccctactctatctcgccctgaatcgcgccaaatatcagctcttctcagcaaactctgtttttctaatttgaagttgtaccacactaaaattacacttgatgcccgtcaaattccctctaagaaatttcgaggcttaattagttttggattttagctcggaaaggtcctcttcagattcatcatcggatangtccttctcttcaaattcgtcatcggaaagatccttctcttcagattcatcatcgggaaagttctggcctccgaaggggatcaacataaggaaaagttcggccttcctnggttcaactttcgataaatggccgcaagtanctttttttggcggncccaaacccaagcccaatatnancaagggtaanggtttttgggggaaaaaattngcccggggataaaaaatc

SEQ ID NO: 92769 - DNA, 518 bp, Triticum aestivum
  unsure (1)..(518): unsure at all n locations
  Clone ID: PAT_TA_92769
ctcgtgccgaattcggcacgagtatgggtggtctactcatggnattatccgactcttgggtgcgtaaatcaaaagcatttgctggncttccggaaatcgacgaaaaagatcgtaaaatgtacttccagcttgccggtcgcgttctcctcatttttctatttgttggatttatcttcagtggtacttggaccatttggagaataatagtggctatgtttggagctgtggcgtgcctaatggttgtcgtcggcttcaaggccaagttttcggctatcatgctagtggtgattctcaagtgttttcaatatccttgtcaacaacttctggactctccatgaacaccacccacacaaagacttcgcaaagtatgatttcttccagatcctttctattgttgggggactccttttgctggtcaacagtggaccgggaaaatacagtattgatgangangaaaaagggttattaagctcaaagaccgtccgattgggcctgaanctgggtaaacccantnctac

SEQ ID NO: 92770 - DNA, 543 bp, Triticum aestivum
  unsure (1)..(543): unsure at all n locations
  Clone ID: PAT_TA_92770
ctcgcctcgtctccctcccagcaagtagcagcagcctccgattccctcctcccgccgcctcctcagatctgcgccgccgcgccgcctcccggccaatccgtcgtcctcatccccgccgccagccgaggagtggcggccgccgcttggttgcttccgtccggggccggcgctatcggcggcggaggctgccgggccttttccggaccggcaaatggttccggagctggggcttggaggcttccggttccgtgtggtctgctgattgggcccagccggggtacggttggctctgccggcgcgaattggaggttctgangttacactgaattttgtttcgccggaggagctganttggngaagttgtttcaggcgggcgactgaattcntgggggaacaaaaagttgcntcttttgatttcctccgngctnaggttaaaatnanagancgtttctggatgaaacggtanatttacngggtcaaaataccgaanttcggccttgggtgnnaaaaccttntccgcaagaaaaaanggattntgaattt

SEQ ID NO: 92771 - DNA, 558 bp, Triticum aestivum
  unsure (1)..(558): unsure at all n locations
  Clone ID: PAT_TA_92771
ctcgtgccgaattcggcacgagctcgtgccgaattcggnacgagagctgacaacgaantgaccactcgcaaataagctaagctgcctgccatggagggttggttagccttatgttttatagccctatccacgttactggtcctttggctctccggcagcaanagcaannccaataagcacctgcctcccgggccatggnctctcccgatcatcggcagcctccatcacgtcatcctcggcacgctccctcatcgcancatcactgatctgtgtcgncggcatgggncactgatgctcctcaagctaggcgaagtccccaacggtgggggnctccagcnccgantgcngtggaggnggtnatgaagaccaacgacgtcgncttctngaaccggcagaccaacgaggtgcagganatcatgggcntccggcgggaaaggcatcatcttcgcccctacggcgaacaatggcgccaantgcncaangtctgcatcntggagctcctcaactccaaagcaagtgaagcgcaaggaggggatcaagggcngnggaggtgggggg

SEQ ID NO: 92772 - DNA, 539 bp, Triticum aestivum
  unsure (1)..(539): unsure at all n locations
  Clone ID: PAT_TA_92772
gcattcaaaagcttacattttgatccatcaagatcgcaaatttccagtttcggaggcgcagtcgcggttgcaggtgccgttggaccattgttttgggtaccgctcgaaatttcgcgatcctgagcggttactgcgtttaccgctaccccatggaaaacactcataccaagcaaaaaaattcgagtttttttgaaatttgaattcaaacgatcactctgctgttaaataagcggcatctctcatgtagcaacagcgctcacattggcatagtgacaaaggcttgctttgtggagttgcaggtcgcgggttcgagtcttaccttccacactttttctttcttttttagaatgcgaaagtaaaaaactaacagagttgaaaaattctgggagccgcaggagtcaaactcgaaatctctgaccaagcggcatcggtgggtgcgtgtgttcaaccactacactaagagaaagactgtgatgtcaaagaagttaaaagattatcctatatcaactttggaataattgaattcaaaaanttgnttt

SEQ ID NO: 92773 - DNA, 489 bp, Triticum aestivum
  unsure (1)..(489): unsure at all n locations
  Clone ID: PAT_TA_92773
ggccgaggtgctcttcccggactggctgcaattcggatggataaccccccgattttctcgaagcgttagtcgaaccgtcgagtattccttgaacgatttttctgtcgcacaagttgcaaaaggcattcagccagcaagttacgacaagtaccttaaacgttcagcgggttggcaacgtatctggcaacacgatctctacagtttaaattacactgggtttctggcaccactatttgccgatggtgcaaagagaccccaagtatactcctgcaggctgcgatantgcttgcgaagggtatcaagctacaacttntgaanncgttaccaatggggaataccaatgggactgtcccaacatggacaatgcaaacctttggattccttcaanggtnggtgaaaattatgatggngtccnctccaaaaacgcnaaggttaanccaaagnnggaaacaaaacngnggtccgnggttgggggaatnacnggatccg

SEQ ID NO: 92774 - DNA, 203 bp, Triticum aestivum
  unsure (1)..(203): unsure at all n locations
  Clone ID: PAT_TA_92774
ccccgcgagctgcatcgaattcgggacnaggcattcaaaagcttanattttggtcnatcangatcgcaaatttccannttcggnggcgcagtcgcggttgcacgtgccgttggancattggtttgggtnccgctcganatttcnngatcctgancggttactgcgtttancgctacnccatggnnancactcataccaagcag

SEQ ID NO: 92775 - DNA, 551 bp, Triticum aestivum
  unsure (1)..(551): unsure at all n locations
  Clone ID: PAT_TA_92775
tcatggctggcgtgtacagaggagcttgtccccggtgtttgctggctcatggccgcatccaaggacccccgccggccggagctccgccaaccgcctccatcgaccggatccgggtgtcctcagtcgcccctacgccgtctgcctctgtatccgcttcaagcaccggcgccaagctccagagatcgagcggatcgattgatccgtcgagcatctgcaccccaatcgacgcagacctcgccgccggcgcctcactttcctccgcaggccccacaagcttcagcccccgtggttgccgcggctgggtcgagcangaggccatggtcgtcagtacgatngcccgacgcctccttcgcctcgtccctggccaagagcaactggcgtcacatccgacgaagtctccggtggnaactgggcgcgtgcatccaagggaatgagctcctccaacaaaacaagaggacctnaggacgcccaatgaaaggttggccccaaccanggggtccagcgtcccggnaanacgggcgaggaacggcaagggaatcccgggtggcgcn

SEQ ID NO: 92776 - DNA, 569 bp, Triticum aestivum
  unsure (1)..(569): unsure at all n locations
  Clone ID: PAT_TA_92776
ctcgtgccgaattcggcacgaggacaattccaaccccaaccccctgtcctcgtcgtcctcccccgtcctcctccgtagtggcgagcacgcctccgcctcgcctcgcctcacctcgcccccagtaactcgccaccccctccccctcccccgnccatgggcggatgattgacgggcccgagcccgaccgaccaagcgcaaccgcnagnggcggtcagcgacagcatccgcanctccgcaccacnattcgacnacgaccggcccctccccagcacaccttctcttcgctcttgangcaaaagccannaaggactaagtccgccgagatccaggggtactatggcgatttcaatgagggatgtagatcctgcctttcaaggggctggtcanaaagatggnctgggnaatatggnngattgagaagtttgcaagccgttccctggtcccannagaatcacatggaaaaattttttgcaggagantcctacatactactanagacaactggccgttaaaaatgggtcctttcaagaatgatanccattattgggcttgggaaaagntacaagtcn

SEQ ID NO: 92777 - DNA, 564 bp, Triticum aestivum
  unsure (1)..(564): unsure at all n locations
  Clone ID: PAT_TA_92777
cttcatttctatgcaagatccaatattttctcttctgaagaactcttaaaatctataccacgctttctcaaaatactctagacctcaacaactctacatcaactgtagcgacaggaagagagactgccatgctgcattattcatctaaatgagtatacataaattgaaacatgcaagttgaatacattaattccaagtacgcctttactgaggtaacacatcaaaatgaatcgagcttccattcgcagatcaaatagtacgaaaaaataaagaaaaaaagaggccacaataacagtgctgctaacatcaggtactctcaagggacatcggttcaagacttgtaggtaagccgaatgattgaaataatttaatttacgtttaagaaaaaatatatcctatagaggtggagtggttaatggnaccaatttgggcctaaggatatacaagctaggtttataagggggccaatcntaaggatgggttccactggnaactataccggctantacccnggnnttaaaggtnggatnaangatttttcccccccnccggaaaaaaaaaaaa

SEQ ID NO: 92778 - DNA, 511 bp, Triticum aestivum
  unsure (1)..(511): unsure at all n locations
  Clone ID: PAT_TA_92778
ctcgtgccgaattcggcacgaggagacagcgggagtagtatgaactgtcttcatacactctggaccccaaatcccagcttcttttgttcgttctctagcccccaattccaatctactccaggagtgtgatctcagaagtgtgatctcaaaccgagatcgatcgacgatggcatcggagccagttgcgctactggacgacgccctcgcagaggtcctccggcgtctcgcgccgcacgtcctggccgaggcccggcaggtctgcaaggcgtggcgcgacgccgtcgacaaccgcctgcgcggcaacatgctttcgcgctcggtgcgtggcaatcttcaacaactttaaggngtgggcactttctcggttctnggagttcttcctccggccctcnaagggggccgggcgattcaccganggntctaattcctggcgtncaatngncgtcaaggncacaanaccantggnaangggcntttggcnttggccgngagtccaanccaccggngcaat

SEQ ID NO: 92779 - DNA, 553 bp, Triticum aestivum
  unsure (1)..(553): unsure at all n locations
  Clone ID: PAT_TA_92779
gacgactaaatctaatgcaatggagtggctcgttattttaccggatctcccgggaaaacaggaagctcgaatggcagtgagaccacaacatatcgaggaccttaaaaaggatcatgagaaaggattttggaagatgggtggagcgtatttagaagacgttcccaaaggctcggaagatttgaaaatccagggaagcgcagtaattgcgtgcgcagagagccgtgaggaggtcattgaaaagcttaaaaaaagatgtttacgccgaggcaagtgtttgggattttagtaagggccaaatccaacccttcaaatggccaattccnaatggccgtntaaaccggcaatgaaagtcccgaacgtaattcaaaattcccaaaaccgtttttgntcaaccgctattaaaaagtaaatttgggctggtacaattaagaaantncaacnattaagagncaatanggaacaatgggttaaaatcccaaaantttggattcgcttaatgggtaanccccaaccaatggctttccctggngaagcaatgacaatnaatgcaagc

SEQ ID NO: 92780 - DNA, 503 bp, Triticum aestivum
  unsure (1)..(503): unsure at all n locations
  Clone ID: PAT_TA_92780
ctcgtgccgnattcggcacgagctcctcctagcaagctatatacctacatagtacagccatggcccccaccgtgatggcctcgtcngncacctccgtcgctcctttccaggggctcaagtcnaccgccggcctccccgtcagccgccgctccaacggcgctagcctcggcagcgtcagcaacggtggaaggatcaggtgcatgcaggtgtggnccatcgagggcatcangangttcgagaccctgtcttacctgccaccgctcagcacggaggccctcctcaagcaggtcnactacctgatccgctccangtgggtgccttgcctcgagttcagcaaggttgggttcatcttccgtgaagcacaacgcatctcctgggtactnacgaatgggccggtnntgggcaaatggnggaaactggctaaggtccggtngaactggnngccaanacaaggtgatnaaacgaaggttggacggncggtcaatnaangganttcccctgac

SEQ ID NO: 92781 - DNA, 446 bp, Triticum aestivum
  unsure (1)..(446): unsure at all n locations
  Clone ID: PAT_TA_92781
ctcgtgccgaattcggcacgagatacttcacaacagctcgctcgcaccaagtagtgccaataccttccacatcgtacgtcggttcgtgactgctgtctcaacttattctcatgccgaaaccacgccatctctgcgcccctatctagtgcggcgaaccccctcgaagcaacttcccatttaccatgtcaccaagaacggggggaacaaaaagctcacaaagattggcaaagtcgagggcgatacggccgctctgacaacagaactacgaactgtattggccttggacgaaaaagaatgcaggataaatcccctaaccggncaagttcttgttaaggggcaccggaaaatcaaaaatcataaagttcttggnggaacctanggtttgactaacaaagacgaatttacggtcaancaatccggngggnaactaaaaacaatttcacaaa

SEQ ID NO: 92782 - DNA, 415 bp, Triticum aestivum
  Clone ID: PAT_TA_92782
ctcgtgccgaattcggcacgagatatgttcctctacaccggtgaatcacctgtcaatactccatacatgggactacagcgccttttaagacaaggatctcccaacgacaatcccgtttaacccccttacgattattatattatgataatggaaatacaataatgtgaataggcttgacgtttcatagaggtggaatgaaaaattatgacggcgcagaaggacatgataacaaatttggaattattagacaagtgggttgaggcatctatgccgtgtaatcaaaagagacatagcagggcatatatgcgagaatgaagggagagctagtctgataattctatagggaaaaggggttagtctagatataagataagaaaattaccgccaaataaaagttaatgggaatcaaaaaaaa

SEQ ID NO: 92783 - DNA, 196 bp, Triticum aestivum
  Clone ID: PAT_TA_92783
gaaaatggtaaattgactaagccgatgcatttgataggtctagaatggagtttatattgggcattttttccttcacagccttgcgataatgtacgaaataaatcaggtagtataaccaatagtaggcctgctcctgtcgctagatggagtcaaagagattgaaggaactgaaaaaaaaaaaaaaaaaaaaaaaaaa

SEQ ID NO: 92784 - DNA, 557 bp, Triticum aestivum
  unsure (1)..(557): unsure at all n locations
  Clone ID: PAT_TA_92784
ctcgtgccgaattcggcacgaggtgacatggccataggaactacaactgcatcccgaggtttccaaaccaggtgaccaatcgggcatgactctcgacgaaaaaccgggagtaaacggaactcaaatcatgtcgatatgggatctcatagcaccagggtaccactccaaattggctccgctcatccatgccccgactccgcctagggctaacttttaagtcctacgtacttcagaagattacaaggcatgctttactagcacaatggcctgacaaacatttggaccttttcccatgctaccattcccaatcaactagatgcgcgtagggtgcgtatcggagaaggaataacgtacgacgtacaagtctcttacgggtgacaaaggtaaaattgtcaaaatgactggggttagattccctgtacattttgccttaatttggtatgatcttcaagcangnccatgtcctaagtaattcgactagttatgcaagcaangggganctatccaatgacaatcccgtgaaagtctaaattatggggatgggttttgaactcaat

SEQ ID NO: 92785 - DNA, 223 bp, Triticum aestivum
  Clone ID: PAT_TA_92785
gattatctctgttgtcggaattggaggattgggcaagaccactcttgtcaaaacggtgtatgacaagatcaaaggagattttaagtataaggcttttgttcccgtcggtcaaaatgccaccgtgaagaaggtttcaagagacatcctccttgatattggcatgtatccaagtcagttaaccatgttggatgaaagacagctcatcaacaaacttcggcaaata

SEQ ID NO: 92786 - DNA, 513 bp, Triticum aestivum
  unsure (1)..(513): unsure at all n locations
  Clone ID: PAT_TA_92786
gtcgatcgatccgagtacgcccacagcgcactcatggaacacccagctgactgtccttgaacaagatgttcttgatgagtacgcacgactagatgagaacctaagaacgcttgcctgtaagctggatgaacttgcgaactgtcccacgactgagataatggatggcctgcgccagcttgagcgcaagtcaggcctcgtttataccctacttaaggcgagcgtctacagtattgtcttacaacaagaaatgtacgccgttgataacgccgaaacgccatgatgattaggttaaagcttcattggttaagaaaatgaggcttctgatatgattaacganatcatcgaccaacgtacttatcatgaggataagacttctttggnaatgaaggaaccaagtctaangcatacaagtagaagaaaacaggaagcnntagcattattagtgcaaggngttacaaantttnacaanaantacaatatggcctcaaccantaatttagganacgganccac

SEQ ID NO: 92787 - DNA, 530 bp, Triticum aestivum
  unsure (1)..(530): unsure at all n locations
  Clone ID: PAT_TA_92787
ctcgtgccgaattcggcacgaggtgaaaggtatgagtggtgtgaacgtagtggatacaaggagaaaaattcaaggaaagaatatacgagatgcttccaaaggcagcaaggcttggatcctaggcaaaaaagaacagatggaacggaaaggaaaagtcgtaaagaactcttcgaaatatactggaagaaaacgaagaatagttttttagtaagcagaattttgttataggaacgggcgttggagtagtcacaattcacatacgcaagtaactgaaagatgtacatcatcacattaatatatctctacattccttgntgcagaaagctccggactaagctcaattacatcttancggtcanctagcgagatttangnaaaacaattggncaacatntcncatcancggattacaatctncccaaaagtcacatcnattntgatgcccntgctgaaactgggacaatcantggaaccttcnggaaggttcnnagncaattttagcntggnnatttccggggctanttgcgtta

SEQ ID NO: 92788 - DNA, 248 bp, Triticum aestivum
  unsure (1)..(248): unsure at all n locations
  Clone ID: PAT_TA_92788
ttgttacaagagaggaggagataagctacggaagagagaaagaatagagtttgttgagattacaataggtagttctatctctatttctaacactgcggntgtccccgaatgtcgcgactatcctgccgtccgtaaggttggtgaanaagctcgggaggtcacggatcaccatcggagggaggcccggcatanacaccgtgaaccccggctcggcaagcgtgctccgtcacnagcctctcgtacccatg

SEQ ID NO: 92789 - DNA, 555 bp, Triticum aestivum
  unsure (1)..(555): unsure at all n locations
  Clone ID: PAT_TA_92789
ctcgtgccgaattcggcacgagctaatatttcggtcccccaaagagttcaaaggaaaagactatcggcgcctcttggcattgtaactaagaacaggtatttgacgcagtgcgcgaatttgggttggtcttagtactgcaaaatcaacgttgtcaaaatggcagataaattacgtgcgcaacaacaactagaggcgttacaggctagatatgttggtacaggccatgcagacaccacaaaatttgagtggacatcaaatattcaacgcgatagccgtgctagttacattggacatccaccgatgttgagttacatggcaattggccttggagagtgtcgcgaaaaagttagagctcagatagttgagaaaatgatacagcctgtgggaaagccacctgaggtacaggattaactctagaataattgagtggaattcctactgcgttagcattgtgttattccaccaagcacgttttgatgatctgttcaaaggtaactttcaccatgaatgagacaaagnttactcctaaaagtcccaatttacaagggcaagggt

SEQ ID NO: 92790 - DNA, 528 bp, Triticum aestivum
  unsure (1)..(528): unsure at all n locations
  Clone ID: PAT_TA_92790
cctcccctcgcgcgctcctccccacccccagagccccgtcgcctagctagggtttttgactccccgccgccaccgccgcgcgcgcgcgagagagagaccacagcgaggacaacatggtggagatccgcaagaaccgccgcgaggagagcctcctcaagaagcgccgcgaggggctccaggcccaggctcctatccctgccgccggcgtcgagaagaagcttgaaagcttacctgctatggttggtggggtttattccgaggataacaacctgcagcttgaggcaacgacacaattccgcangttgctttctatagaaaggagccccccaatcgaagaagttatccaatcaggcgttgttcctcgatttgtgcaagtttcttactanagaggatttcccccaactccagtttgaaagcagcgtggggcactcacaaacattgcgtctgggaacatcaagngaagtaccaaagggttgtcaantgatcatggggganttccaantagtttgtaaacttccttgnatccgg

SEQ ID NO: 92791 - DNA, 557 bp, Triticum aestivum
  unsure (1)..(557): unsure at all n locations
  Clone ID: PAT_TA_92791
ctcgtgccgaattcggcacgaggtgatttcgaggtcgatactgataatgttgacgcctacactgaagtagaggtcaagtttgcagagatacgagatcgtcattcctcagctgttgcaacatcaccttacggaagatcgctacataatgtgaaatcaccacttgagctggttaccgtactgcgtgatgccatcaaggctcactggtcattgatgacgaaagcaaaaatattacaccgtgatatctctgcgaataatatcatcatgactggatctgaagcccacaaagactggaaaggatatgtcattgacctggacctagccgtcttgcttacggatggcaaagctcaagagaaaagacaggctatgaccggtacaatggagttcaaggcgctggagatcttgagtgggaattgtgaaagcncaggcgtcattgtgggngcaatcataacgncatganctcnaagtcaatcctttaaggcctggctttggnaaatggcttaagctgtggatgggaaagatgataaaaagccgaacaaangataccttcaaaaatnggg

SEQ ID NO: 92792 - DNA, 251 bp, Triticum aestivum
  unsure (1)..(251): unsure at all n locations
  Clone ID: PAT_TA_92792
ctcgtgccgctccgcacagatctcgcactcactcactgctagttagctagctngcanngattgcagccctaatttgacgatagtgcaaacataccatttaactagtctgcnactacgctatctacgtgnanganacgaatangcttctacgtattgnggtcanataaacatcaccatggncttgacaagtctcactncnatgtggtgggccatanctcttctttccattactgtattggacaccaagatca

SEQ ID NO: 92793 - DNA, 566 bp, Triticum aestivum
  unsure (1)..(566): unsure at all n locations
  Clone ID: PAT_TA_92793
ctcgtgccgaattcggcacgaggctaggacaagggagaaaatgatgacaatggcggagaaggtgccggagatggtggtccagacacttgtggacaaagccgtgaatagagccgtctccttcgtgttcggactccgcggggagaagcgctctcaggaggacctcatgaagaggctggtgaccgcgcacgacgacctggagctgaaatttgagaggacgagcaggctgcccatcactgagacggnattgctccgtcgaaggatggagatcaaacaggccttccaagagtgccatggacttgctctccaacctcgagctgcagcaagaccaangggcaacctctccgnccaaaaaaggcaaagtctctcttcgccttgggcaacagnnaaagaacctgctgagaacctccggacgtcncaaagttcgagccgggtcccgtnggagaaangcccacaagggtcctanncgactttgaanggacggggtttacancttncccaataanangnctttanctcaaaccctntnggcccaaaagnttcctcaaaggnaanggcngtctggnana

SEQ ID NO: 92794 - DNA, 553 bp, Triticum aestivum
  unsure (1)..(553): unsure at all n locations
  Clone ID: PAT_TA_92794
ctcgtgccgaattcggcacgagtttactatcttactattttactaatccctcgccataacagcttttcgaacgtcactgtatagtggttctataccagtccatttctgaaactgataaagaccctgaccgcagagaatctcaagacctgggattgtgacccatcctgcttcctgagctagcagcattaaagccgttacactaggtttgtaggccatttcaatcatggtgcgctggtggctaggatcggcaggtggattttggaatagtttcgcgataatctcatacattttcggctcgatgggctgatctgcggggatagtagcaatggcaactcggggtgtatcactcaagctgctctatagcgctaacagaacttaaatccttgacgttaaactcaatggggaagcgaagagatcatggctgtaagtttcgaaggcgtgcgagaaacaacaaaaatgggtgaatggccaanggagtgcaaggcgtaaattgcggcacgtgcagtcccacangcgccaatgactactgcacttccgaggagaatgggaaaac

SEQ ID NO: 92795 - DNA, 468 bp, Triticum aestivum
  unsure (1)..(468): unsure at all n locations
  Clone ID: PAT_TA_92795
cacaagctgagcggtgcgcaaaccttcctacttcactctgaacttcaaaggncaaccgttcgttttaagaactcnaaggntgatnangttaggaactcgctcttcgtccgaagtcgcctgaaccaagctcanctttcctaaactcaataattcaatattaatcatgcagatgatgtggagattaatacaagctgttgcactgcgtctccatcggagtatcttctcaggctagttattacatagacccagcaagcgtgccatcatctctgagaggttcatggtgctctactcaagactacctcctgtcctctgctttgtctccagttgcctgggcaatcgaggcaccactttatcgaatacttgtgatcctaaaagcttgagctttaaatgtgtctgtgagagtggnnaagncccctaaattcccgggagtactcacaaacgttgccattctttatgtgtcaggaattc

SEQ ID NO: 92796 - DNA, 553 bp, Triticum aestivum
  unsure (1)..(553): unsure at all n locations
  Clone ID: PAT_TA_92796
ctcgtgccgaattcggcacgagcagaaaccatgaatgctgtgaattaccagctcaacatagcctacacctctatacctctgagaactatgtttaaataacagaaaggaatatctagctaaatatcgaccaacatagtttagctagtgagcagccttgactctagaagcggaggcatctattcctagacgtaccatgtcgaactctgctccaaaaccatcacgagaaagccatcatgcaccacttccacaaacgaaggtatccgataacaatggaactggtcctagtgaaagcatagacatgttccccactttcgagatcgagtcggcagccgttcctaatcaggcagattggtcaccaacacatgtggcatacaccgaaaatactctagtcaatagtgggagcttttcttactctgcttacatcagaggcacaacacactgggtcntgtaagtgggcctagcccatctgtcgcaagcacggtaatanaatccangaaagctccatggaaaggcaataattctcatcaaggccgtanataattccttttcgtca

SEQ ID NO: 92797 - DNA, 413 bp, Triticum aestivum
  unsure (1)..(413): unsure at all n locations
  Clone ID: PAT_TA_92797
ctcgtgccgaattcggcaccaggacgaaatcttcacgccaactttattctacgatggctaaaatctcgcgtggtgccccaggcggtaaactcaagatgacactgggtcttcctgtaggngcagttatgaattgctgcgacaacagtggngcacgaaatctttacatcatctcagttaaaggcattggagcaaggttaaatcgacttccagctggtggtgttggagacatggtgatggccacagtcaaaaaaggaaagcccgagttacggaagaaggtcatgccagctgttatagttcgccanagcaaaccatggagacgtaccgatggagtcttcttgtactttgaggataacgccggtgtgatcgttaaatccaaagggagaaatgnanngatctgctattacangaccggt

SEQ ID NO: 92798 - DNA, 531 bp, Triticum aestivum
  unsure (1)..(531): unsure at all n locations
  Clone ID: PAT_TA_92798
ctcgtgccgaattcggcacgagaaagcattctactcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgaagccccgaaatgtggcgctgcgcggatatgaaatccaacgtcgacggnaactgcggtgggaccctgcaaagaagtactggatcgggtcatgccggcatatgataatggttcggctaaaaattaattaaagctcggccaagatganaacgtcatcgtggcctagctgggtgtgtgccaacaaatngtttaacaagtagtccnggcctccgccctggggttttncnccccgagaaaaanttggggttggcttggt

SEQ ID NO: 92799 - DNA, 542 bp, Triticum aestivum
  unsure (1)..(542): unsure at all n locations
  Clone ID: PAT_TA_92799
ctcgtgccgaattcggcacgagcccatccccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcttgagaggggtatcaccattgatattgccctgtggaagttcgagaccaccaagtactactgcaccgtcattgatgctcctgggtcaccgtgacttcatcaagaacatgattactgggtaactcccaaggctgactgtgctgtgctcaatcaattgactccaacactggggggnttttganggctggnaatctccaaagggatgggcaagaccccgttgaggaatgcccctcccttgcttttaaaccttgggggtggaanaaaatgn

SEQ ID NO: 92800 - DNA, 512 bp, Triticum aestivum
  unsure (1)..(512): unsure at all n locations
  Clone ID: PAT_TA_92800
catgtcatcagtattgcgtcgcagattttcggccctcagtgacccgagctaccttaagagagctagtaaagttgtatgtgtcggacgtaactatgccgaccacattgcagagctaaatagtacaaggccgaagtatcccctcttcttcctgaagccgccctcgacgatcctgctgccgggagaaggtccggtccttcgtccacgaggcgttactctacatcatgaagttgagttggcccttgtaatgggtaaacgagtaaaggatttagatcaaaacgatactcagggtgctctagatgctatcggaggctacgctttgtgcatcgatatgactgcgcggaatgttcaaagtgcggcaatagctaaaggattgccttggactacttgcaagggctttgatacctttctgcccacctcaaagctttattcctaaatctggcataccggncccacataatgtcgaactaatcctgcaatcaataatgagcccaagccgagacaatgtgatacac

SEQ ID NO: 92801 - DNA, 515 bp, Triticum aestivum
  unsure (1)..(515): unsure at all n locations
  Clone ID: PAT_TA_92801
ctcgagtcaattcgaaactgtctctgaaattactgtcgtgggaggagctggccggccattcttctcgcctcatcaattttgctccctccaatcctcccctaaaccgcaaagtggttaacggtaacatcagaaaattgccgcagctcttcaattcatctaccgacgagccgtcaagttggataacagcctagtcttctcccctacaataatcgattgcatacaacccaaacgcccaaatcttcatccgaaatgaagtccacatcagcggtcacgactttggcgataggtctctatactactgcaaaggttttcgcagcttcagcttcgcccaaaggctgctacagctcctcgaatggcctcactctaaatggttcccaaacattcaattccattggagcctgctcacaaacatgcctggcaactaaatccgtgaccaaggcaatgcaaagantccaaatggtactggcgggtccaaaacttcccccaanaaactccctccgnttgatgacgctnaa

SEQ ID NO: 92802 - DNA, 361 bp, Triticum aestivum
  Clone ID: PAT_TA_92802
ctcgtgccgatcttctaatgtagttataacagcaggcttcagcatcaaaaatagttatctgtggcatgcaaagagattttggttaaagactgatagtagaagtgtgtatcaaattcatgaaaaaccacaataaccaggctaatgtaattattttaatttagtcaaatatttcccttaatattaataaaatatttgtatattcacgccttatactggtatttggaattttacgtttttggaaaccctaatgctttgacgtatcaattttaaacacatagactttttgaattattagtttagatattatattctcgtgccgaattcggcacgagctcgtgccgaattcggcacgagggggggg

SEQ ID NO: 92803 - DNA, 537 bp, Triticum aestivum
  unsure (1)..(537): unsure at all n locations
  Clone ID: PAT_TA_92803
ctcgtgccgaattcggcacgaggtcgatttgcttgcgccgccgtatgctccttcctcgacttgcctggcgccgccgccgtcccgactctgaccagcctcgcgccgccacggcgtccggatctgaccagcctcgcgccaccacctctccagactacgaccagtctcgcgccaccacggccttcggcccagatctacctcccgtcgccaaggcctccgaggggaggtactctacagtctgaggggccgccccgtaacctgcagaccgaggaggcgacctaccatactctgccaaggagacgccccactgcccctcttccaacaccggggacgcctcccctaactcaactgtcctaacccgtttccaaatccgggtaacggtagtgggaacaangcggctggnttaanggggnnggggncctaattccgtgangtgggcaaagcaacnaacttgaccaaatggtccaaaccgacaggttcaaaatgggaaaagcnggnnggaacaaggnaaagaagggangnccctgggtatgatgatng

SEQ ID NO: 92804 - DNA, 545 bp, Triticum aestivum
  unsure (1)..(545): unsure at all n locations
  Clone ID: PAT_TA_92804
ttttttttttttttttttaacacaattatggttttgattgactacttccacactgcaaatgcacttcaatcctatatgatttagagaagcaattgtgcttacataaccctcaaaattatgtggtgtacaacgtgtactataccactgattctgcattggctcagtgaaaaaacacatgacacagaaaaactatctaggagttgctacagatatggttatatcattaacactgtaggagtgggtagcaaaggaatcctcttcatcgcctacccttaggttgaaatatgccgggtgctttggcccccgcaggagcattgtcttgctgcttagcattgcagtaacatccaacatgttcggtcgatcagccgcattctcttgcacacataagtagtccgacgttgatgcaactcaacaatttctggctggggagacntgggaagcaatggacgcatcaacaatatcaatccaagnttccctcaacccaaaactngccaaagaatatccgangganggtgatgaaacctccacaattggtgggtaacann

SEQ ID NO: 92805 - DNA, 537 bp, Triticum aestivum
  unsure (1)..(537): unsure at all n locations
  Clone ID: PAT_TA_92805
ttttttttttttttttttttttataaaatacatgagggttttttttcttttcgataaagggcgactttaagaatacatgagggggtagagacttgaaatacaaaacaagtaataaatggtttaaacctactcgacccctactttttatctctatctttaaacacatatcatattctaacatcaagaactcacaaaaaaagaagataacaccttcaggaaagtagcaacactcgatgtgagtgtttgaaacatctgcatggcctatcctatatgcagtagtttttctttctttctgccgggaagtatatgtagtagttgtagttaagtaattaaactgaaggatttatctttgccttccttccaagatatgacgccttaatttcctggagcttgctagctgtatctctaatgttcgctctttcgccggggatggagtgtgtgcaagagactggctacttgcaacaagagacacgaaggaactggatgaancgaatcctctgactcgcantccccttttagataaatgtcaatcacttn

SEQ ID NO: 92806 - DNA, 547 bp, Triticum aestivum
  unsure (1)..(547): unsure at all n locations
  Clone ID: PAT_TA_92806
cttcacagggtgtcttctctatcaagtccgacgtcttcagctttggtgttattatctttgagatccttagtggaaaacggaattctggaaaccaacaatatggagatttcatcaatcttcttggatatgcatggcaattatgggatgagggaaggtggattgatctcgttagttcatcatcgttttccaaaagtcactcgacaaagatgatgaggtgcattaacatagcactattgtgcgtacaagagaatgcagccgatcgaccaactatggctgatgttatagctatgctaagctatgaggctatgatcatcgatgagcctaagcagccagcatatttcaatgtgagggtaggaaatgaagagacatcgactgctacagagtcatgtagtaataatngatatgaccaatatcagcaaaactcctaagatnatatttggtccgtggtacaatggttaaaatggcccaagtccaaaattggtgatacctacaactcctggnncaanttaanaagnttaaagctccgggccgaantccggaacnnggg

SEQ ID NO: 92807 - DNA, 276 bp, Triticum aestivum
  Clone ID: PAT_TA_92807
tcaagcccgacggcagcgtctccctcgacctcggcttcaagggcctcacctcgtcgtcctcctccatcaaggggtggaagatcgcgcggtactcggcgacgctcctgtcatctacattcattttcctagcattatcgacctgattgatgattactgacaaatgcaggcagattagcaagcctgcgtttacttagaacaccagaactcgcccgcattctgtaaattccaccacgattgaaaagagtgatcctctcatgtaaaaaaaaaaaaaaaaaa

SEQ ID NO: 92808 - DNA, 461 bp, Triticum aestivum
  unsure (1)..(461): unsure at all n locations
  Clone ID: PAT_TA_92808
ctcgtgccgaattcggcacgagctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgagggctgcagctgcggcgacaactgcaagtgcaacccctgcaactgttaagctgcatgcactcgtacgtagtacgtgtgatggtgtgaagagtatacgtgaataacgagcgtctgntctgganggagtcgagcaantgtgcngtgtgtgnggttaacttgtccgctctccgtcctatggnccngccctttgctggncctggg

SEQ ID NO: 92809 - DNA, 530 bp, Triticum aestivum
  unsure (1)..(530): unsure at all n locations
  Clone ID: PAT_TA_92809
ctcgtgccgaattcggcacgagtggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaacgacgccacacaggtgatcaacgaggtggaggaggtcaagaaggagtaccctgacgcgtacctccgcatcatcgggttccgacaacaatgcgcaagtgcantgcgtcaagcttcaattgcctnaaagccaacggggctngcaaggagtcccgg

SEQ ID NO: 92810 - DNA, 202 bp, Triticum aestivum
  unsure (1)..(202): unsure at all n locations
  Clone ID: PAT_TA_92810
ccactgccgctcccgtcntcccgatctcgccggctcgcggcctacctcgccggaanccgtcgncccnctgcacgcnccgccngcccggggncaccccgaccgctgtgatncagccagtcggtntncgccgctcgttnggngangcgtgatgagcaagncagcacggtagcncnggnggtgctaaggcttgtccgnnggaggc

SEQ ID NO: 92811 - DNA, 175 bp, Triticum aestivum
  unsure (1)..(175): unsure at all n locations
  Clone ID: PAT_TA_92811
agatctgcccctctctttcttttatagtggtagtagatagtagatacatcagcagnctatcaaaaccatgcattatgatgccttgccaagaaattcgacaatcagagggctctgaagcacancgcgaanggcnggncgcnggcttgaaaacggctccaancgggacgaacttggg

SEQ ID NO: 92812 - DNA, 537 bp, Triticum aestivum
  Clone ID: PAT_TA_92812
agaacttgcgcggttctctctcttcgttagagcatcagctccttcacaccattcaaggttaaaagcacgaattatcacggataatttctccaacttatcgactcgaatcaccgcgtcatttgaagagacttataacttgcctcacaatgaaaattgttcttccacatctcgctattgcgctcttgagcattgtagcaccagcacttgctgtgatatttgattgttctggggtcatcattaacggtgatgtcgtgaggagagtacaggctactggtaaccgtgctagtatttcaaaatcaagctctattcatggagattcaaccagaacatacgaatacttcgatatccatcccaatggtcaatattccagagactatacaggttttgcctgcttttcggacatatccttgcccaaacccgatgtgcgggaacatcgtgaagatgcttggtggccgtgtagttcatctgtaatttgaggagatgaagtatcttgccaaagccctaactttgtggctgtgtgttatgatgtacgataac

SEQ ID NO: 92813 - DNA, 553 bp, Triticum aestivum
  unsure (1)..(553): unsure at all n locations
  Clone ID: PAT_TA_92813
tcggttgctgccttgacatagaggtgccgatgctggtttacgagtacgtctcaaacggcaccctctaccacttcctccacggaaaggagcttaacactgacacaaccttggacactcgtctccggatagcagcagagtccgcggaggcgttggcatacatgcactcgtcggcctcgccgccgatcctccatggagatgtcaagaccgccaacatcctcctcgacaacaatctcaccgccaaagtctcggactttggggcatcaaagctggcgccaagcgacgaggttcaaatcgcaacactggtgcagggcacctgcgggtacctanacccggagtacctcatgacatgccagttgacagacacgagtgatgtgtatagntttggggtcgtgcttttanagcttctcaccgggnaagaaggcgatctacttcaagcggggccanaggacaggagcctagnggcacgcttcgtagcagccacganggccgggacacatganaagctcctgggncggcaantgaaggaaggaaatggggaccncngcactggnnt

SEQ ID NO: 92814 - DNA, 515 bp, Triticum aestivum
  unsure (1)..(515): unsure at all n locations
  Clone ID: PAT_TA_92814
atagtcaaaagtcaagccgggttaagcataaaacacttatatatatttgagatataatcccaaaaaggtctcaagttaagtaattgtggctgcaataaactttaccagagacagaataaaactttttgaggcttctgatttggatacgatcagtaaaccgttccaaaggggttaagctaagattcgaatacgatcatatagcccccagtggctttggcgatgtcgatcaagagggtatcgacaactatgttctctttggtttgaatacgacctatgttttaacaggaagcccccaaatgaccttgagagttgtttaacgacgcagattcaaatacgatccacgttgattcccaaaggggttgagctatgattcggatacgatcaagaagcccccaagtaggttcggnagtttgccaatcaaaagggnatcacagctatgttccctttgggttcaaatacgacctatgtttgaacaaggaagcccccaagtgaccatataaatttggaattgcccg

SEQ ID NO: 92815 - DNA, 539 bp, Triticum aestivum
  unsure (1)..(539): unsure at all n locations
  Clone ID: PAT_TA_92815
gtcaaatattaaccccgccgtcactttcacaaactgtgtcttccgtaaacacccatggcataaattccctgtctacttaatggctcaagtcttgggtgccttctgcgcagcaggcgtagtttacgcaaactacaaatcagctatcgatgtctttgagggtggtgccgggataagaaccgtacctggatacagccaaaatgccacagccggtatattcgccacttacccgcaaccgttcatgactcaaaccggtgaatttttcagcgagttcatttgcgccacccttctcatgtttactatttacgccctaaaggacgagaagaataggtatgccgataagtttattcctctcatcctattcttcgtaagtatttggtattggagcttgcttcggatgggaaactggcttcgccataaatatggcacgcgactttggcccaagacttatgacttactgtctcggatatggcaacgaagtctggactgcaagctggacactatttctggatanctatggtcgctccattcttangatgttt

SEQ ID NO: 92816 - DNA, 535 bp, Triticum aestivum
  unsure (1)..(535): unsure at all n locations
  Clone ID: PAT_TA_92816
ccaaaatctcagcccatctaacagtagaataacaccgtcattaattgaaaatttaatatagaataatgtcgggcggtgcaggctacgatagacacataacgatattctcggaccagggaaggttatatcaagttgaatatgccttcaaggccattactgccgcaaacatcatgtctattggtgtgcgaggaaaagattgcgctgtagtactttcacagaaaaaagttcctgataaacttattgatccttcatccgtatctcacatcttcaagctctcgccctcagtaggttgtgtcatgacgggctcaatcgctgacgctagagcttttgttcaacgcgcaattggtgaatcagcggaattccggtacaagtatggttacgaaatgccaggtgatgcgctagccaaaagaattgctaatataagtcaagtttatacacaacgagcatacatgcgtccatatggagtagctaccactcttaatgcgttagattctgagtttggtccacaagctatacaagtgcgattctgctggnt

SEQ ID NO: 92817 - DNA, 534 bp, Triticum aestivum
  unsure (1)..(534): unsure at all n locations
  Clone ID: PAT_TA_92817
gtatcgagataccaaacatgatcaattcctctcgcgcgcttaaaaacgtgtagatgaccgtggaaccatgctagtgcatattgatgtcgcatttcatacattccgtagaaagcttgtcttttccatacttctacttctagtttgatgtgtttttccgcattaatgataggcttgtcttcataagtatatgggacaaaacagcggaactccccatggacttgtacaaatctttcagaagccagcctcataatttggcttgccgtacactttgtcaagtaataaatagatttcatgctaataaaagggattggatctagctcagaggctattgagtcatcccaccacgatcttattttttcgagacagtctgtataaatatcagcctttttgattaattccaggctcgagggatgcgtcatctccgtcaagaccagatgcaatatcattcatgatgctaatcatattgaaattgcgtgaacaagtaagatgtgagcaaggtatctttttccgaaatcntgtgcggcgccattaaaa

SEQ ID NO: 92818 - DNA, 429 bp, Triticum aestivum
  unsure (1)..(429): unsure at all n locations
  Clone ID: PAT_TA_92818
ctcgtgccgaattcggnangagtacacatctcanctcantcccccanctcccgtcccgataaggnggacagcgaccgcgcgcgcgagagagaagctcccggntcgcctcctcctccctcccctgtctcctctcccgggtccatccatccagngggaggagagggcangcggaggagggacgaccgccgcangccanaggccgtacctacctacctatctatctatctatctatctaanccgccggaatggactcggngcactggntntcgcgcctgggcgccgccaancgattctangcggcgcagntcgggcacaccgatnnggcggggatggacgaagctggncatggacggngacgagaanncggggaggnccgacttntcctgggncctactgntacgnggagnaacnaanatcgcctccctcgt

SEQ ID NO: 92819 - DNA, 447 bp, Triticum aestivum
  unsure (1)..(447): unsure at all n locations
  Clone ID: PAT_TA_92819
ttttttttttttttttttttgggtacattggcttttatcattggaatagttatctcaggattttggttttacctggtccgactgtggtcaaatgatgttagcttctcgccaattcagtgcctcctttaaaagaaatgtaagagccaaaccagtcacagctatgccccatttgatcttaggatatcattataggagctgagcgattcggtatcattagcttccatgccaagattatttttcactttaattaattatgcttccgcttttaacacgaactttctttgcgggaagtgtacttcccgcttggtgatctgggtagttttcncgctttanctcccttgcncaaacgtctccntattgcacnagtccgcnttggncnaagatcgagtgggaagtacttcttgggcttatanaaaatccctaggtgagtgcgtngggttgcgctaa

SEQ ID NO: 92820 - DNA, 299 bp, Triticum aestivum
  unsure (1)..(299): unsure at all n locations
  Clone ID: PAT_TA_92820
tcggcacgaggcggctacggcggccagcgcggtggcggcggcggctacggcggcggtggcggctacggcggtggtggcggctacggcggccancgcggcggtggcggcggagactccggcggccagtggaggaactgagcctcgactctcccagttatcgatctatctaccgtgtcgtcgtcgtcgtcgtcttcgctagcaagttatcttcggtgtcgtcgtgttcctgngtcagtctgantcgncgcgtgtgtggcgtttttgatcncgagctcgaagtgtcgctctgtccggggtta

SEQ ID NO: 92821 - DNA, 217 bp, Triticum aestivum
  unsure (1)..(217): unsure at all n locations
  Clone ID: PAT_TA_92821
gttacagtatgtcttgcagctaagaggcagcggcagagccagacgcagcagcggcatctgcaggagcagcctcgtcgtccttgtgcttcaccatgcccgaatcgaccaggatgggcacctccgcagcgagccacggcgcgagcccgaggcagagagcgtggtgggcnagatcccgctgctgtcgncgcgngcgggcncccgncgacngcnatccgtg

SEQ ID NO: 92822 - DNA, 552 bp, Triticum aestivum
  Clone ID: PAT_TA_92822
ctcgtgccgctcgtgccgaattcggcacgagagagttcagggcaaggatgccaactcagttaagtttcgtgttgcatctatacagttttctagtcacttcattctcatgaagatagttcgatcaaaatagtattaagcccaccagtaggagctaacatagcttcacttatctaattattctgcccggaaactccagtcatacgccaatgaaactacaagtacgaaccacagcaaccaaatcatcgtcaacaaatctagcgagacttatctttgggaaggatattatgattggtatatcagatgggagtgtatacttgcgctagaattgcttaagtagcttgtggagagacatcttgattgatatgcaggatatcgagcgcaccaagatgtactcccaactgaacagccatgcaaattgtcctgcatcaataaccaaaatctcatactgtacacactaccaattgtattgccgttatctagagactgggatctccttcacgcgccataatgccatactgctataacagctacctatgcaccagctactagatc

SEQ ID NO: 92823 - DNA, 470 bp, Triticum aestivum
  unsure (1)..(470): unsure at all n locations
  Clone ID: PAT_TA_92823
ctcgtgccgaattcggcacgagaaactatggcacgaacatgcacgtacaatatgaatttctgaagtatctaagcttacatgagaaaggagcctctgcaagccaccattcctttccccgctgagtgtctccaagaggacgactctgaagctgtagacatcacacttcagcgtcatatcccctctccgtgcatactctggagctgcgtatccccttttcaaagaactcaacaacgttaggtacatgtctggtggtgaagttgcatatatatttgactacttacggtgaaactacaattgtttgatcaggccctgcctggtcgacgacaaacagcttggcggtgccaaagtcggcaattttaggcttccactcatcgtctaggagaatgttcccgggcttgaggtcccggtggattacactctcacccgatcctccatgtaggtacgcancaccatgcgcnatgccatgcaaa

SEQ ID NO: 92824 - DNA, 531 bp, Triticum aestivum
  Clone ID: PAT_TA_92824
ctcgtgccgcgggaatcagataagaagaactgattaagatggtaacaattataaaaacgatgaaataacgtacatggaacatggtgccgcttttgaccaaatgatgattttttctcgcctttgatgtattattctcttgtttaataccttacgcatcagccgtcaaaaatgatgatgcctcgacacaactgcataaccaacggagttctattgacgccaatattaacaaggatgagaccgacctcatcagactccaacctttctttaatgctatctcagaaaagaaaaatgagatagaaattctcaagattgcactagacttcgctcgaaacccaccatacaggaccggtctcatacaaagaagcagtcgacccacttcaactccttctctcagtaaggaaaccattcagcggggtaatgatgagttattaagctataacaccatagctccaattgtcgaacgagcctgcaagaatgaacttaatagcaaagtaatcactgggttcaacaacttctgggaaatgttttaaa

SEQ ID NO: 92825 - DNA, 171 bp, Triticum aestivum
  unsure (1)..(171): unsure at all n locations
  Clone ID: PAT_TA_92825
gaattcggnacgaggagagcttcttctttcttgcnaggganatgncagtgngcaaccagngagctacgngtcaatgnngaccatngccacgactgacaatgtctcaagcccgccaagatcacggncaggtcgncgtnntcctcgccgatcagttcaacgccagaggnggcc

SEQ ID NO: 92826 - DNA, 529 bp, Triticum aestivum
  unsure (1)..(529): unsure at all n locations
  Clone ID: PAT_TA_92826
ctcgtgccgaattcggcacgagctgggacttcgtacgataagatctctttttagtgattcgatgtcttttcttaagcgcgcattctcctcttcaagatctgttttgggacaactatagttattttctttattctcatcttccaaaatgttgagtgttgttgggaatgttcgtgcgaagatttccagcttgcgatctaggtgctcgtcttttaaatcagcctctagagcccaggttgccttccagcgttggatttcggtctccattctatgctccatctcttggaagcactcctcgcgaacctcagcttcaatttcggtgattcggctggatagtgtctctaaccgtgtttctgatttgaggcgccgctcagtttctgaacgaagctcagcacgaaggccgtcaatttcctcactcattcgggcaatttcaagggcagctatctccattgtttctcgatcaccttcgccagggttaactttgccccatccaagcatgggagccgctatgggtgangggtactgggnccgg

SEQ ID NO: 92827 - DNA, 529 bp, Triticum aestivum
  unsure (1)..(529): unsure at all n locations
  Clone ID: PAT_TA_92827
ctcgtgccgaattcggcacgagcaaagattcaaataaaaatatcacttcagtatctgaaactgttgagaacgaagaaaccaagccacatattggtacgatgcgtaactgtcccattttttccttagaagcacatgtcgatgaagtaaccgcactacactttcgaggtgatacacttatatctggatctgccgataaaacacttcgtcaatgggatctagaaaagggccgctgtgttcaaaccttggacgtcatgtgggcagctgcccaggcatccacatctttaggatctggagaaggttcctggcgtcagactgggaagtttgtctcttcttccgccgacttcgttggcgctgtacaggtttttgacgctgctctggcgtgtgggactgccgatgggatggttaggttatgggatctaaggagcggacaggtccatcggagcctggttggacacacaggacctgttactgcactgcaagtttgacgatgtgcaattagtcacnggaagtttaaatcggagtgtcaagg

SEQ ID NO: 92828 - DNA, 520 bp, Triticum aestivum
  unsure (1)..(520): unsure at all n locations
  Clone ID: PAT_TA_92828
gtcggtaacaccgactacgccttccagatgctcgacgaaatgccattaaatggggtctttgcagattctgttacatataatgccatacttgaggggctcatcaagcagcgcaaggctcgtgagactgaaggtttccttgcggagatgagcaagaacgagcagctgccctctgcctccaactgtgctgctgctatcagcttatgttgtcaggagtttaacccatctgccgcagttgacgtgtggcactgcatcgtggagcaccaaattactccggctgaggaatcagccaaagagctaataactgggcttctcgactttagcaggttctccgaggtgaagaaatataccgatcagatgcttgacatgggaattgagttgccccaagcccaccattgaaaaaatgaagcgagcattttacaaggctgagaggnaacacacatatgaccaaaattgcacgaaggttgaagccgcggtaacacatattgatgggaaaaatcattagaaccgagcaagcaaggga

SEQ ID NO: 92829 - DNA, 151 bp, Triticum aestivum
  unsure (1)..(151): unsure at all n locations
  Clone ID: PAT_TA_92829
tttttttttttttttttttctagctgaatcatcctttacagttacancccgaaacataattnaacantgtcggaacatgggtntataactttaccactggtcacttanttttccgggctcagntgctgctccccattcaccaacgcttcca

SEQ ID NO: 92830 - DNA, 531 bp, Triticum aestivum
  Clone ID: PAT_TA_92830
tcgagttttttttttttttttttttcctcgccacgattatggtggtgagtatctttccctcattacagtactagctgaatcatcctttacagttacagcccgaaacataatttaacattgacggtacttgggtatataactttaccactgctcacttacttttccgggctcagctgctgctccccattcaccagcgcttccagcggcccagtcagtcccgtcggcagctccgtcccatgaaattccagcgacagctcccgtggtagctgtagcgccggcgaaagcagctgcggggccagttgctacttcccaatctgcgtttcctcctgcaaaaccagtgtcaacagcggcgattccggcttcctctgcgccaggtattttgtcttcaagagcatctttgttttcttctgcttctgggtcacggtaaaagtataaatcgaccatgacatcccactcaagtttcacggttggcgattgagccccttaatcttaagacttcacgaagctaacatccaacaaaattagtcctat

SEQ ID NO: 92831 - DNA, 517 bp, Triticum aestivum
  Clone ID: PAT_TA_92831
acgacgctctcttggatctccgctgaaagagcgacgtgggcatcactattctacctccatctgcaatctttgagaccttcatcaactctgcaacaatgcgctgcatgcttgctcttttattgcttaatgacatcagaccgaaggataatgaccgtttaatcaccatgccattaaatggggattataaatattatcgaatatacaattcgaaaggattacgacagttccgaggcgttgaggctggcagtgacgtaattacggctgcgaggcagattaacagtcccggcacacatatagcagtctattgctctccatcccaagattcaaggtatttgaggaagtatatagctgagggcgcgactgagctacatgattcatctcaatttggctttcaccaaggatctttctcaagaaaccaaatgtctcgaacacattgaagcggaattcaagaaactcaccgggttacaacggacatcccaatcaagaaagttttcggaaaaaatagagtgcagtaaaa

SEQ ID NO: 92832 - DNA, 520 bp, Triticum aestivum
  Clone ID: PAT_TA_92832
caattgtaacgtgccccaagctgctaaaattaatgtgtaggaatctacatttatgagttgacacagagccgatgataagagattacattctccgcttgcaccactagttactttgttctcgaaatacccaataacaattttaacaaataatataattccaaattctagacatagaagatataataaaaattgtcgatggttattcactccaatacaattaaatacccaaggacaatgatgatcgtgttttgcaacacatcgacgacattgcttgcagtgcttgcttcttaaaggtcgtctgaccatacagggaacacaaaaattattttcgtcaaacttccacaaactgagaagttcatcgattactgccttctgctgagtaaggccactaagctttggtacataacccggatcatgagtcatagtacaagtgtagaagtatgcacaaaaggaatagagcacaccaaaggagagattagtgattgcatgggtcgaaaaagtggcgggaaggatagttgct

SEQ ID NO: 92833 - DNA, 514 bp, Triticum aestivum
  Clone ID: PAT_TA_92833
gcaccaccggcctccatccatgctctatccccatgcaccgccgctgccctggattccttggcgccgtcgtcggtcaccggatcccacggcgccgccgtcgggccatggatctccgcgcgacgccgcggcccaccacatccagcgccgtccctaacctcccgtttctccccatctctcccccaccttcctgtgccaccggctgcgcaccgccgccgccgcggtccacccacaccaagcaccccagcgacgaggtcaaacgggacgcacccgcacctccaccaaccaccccagtcgccggcgccttgggccccgcagctgcgacccatccaccccgtcgcgccgctcgagctccctcacctgttcctctggatgcccaccttctagcggcatcgccggatcccccaccctggagctggcgctgactttctacccacgactaatctgaacttatcgcgttgctggcttctgcctactgaagtgagctttcttcctccggcatgctgcctctgtcaac

SEQ ID NO: 92834 - DNA, 292 bp, Triticum aestivum
  unsure (1)..(292): unsure at all n locations
  Clone ID: PAT_TA_92834
tgcaagtatggctcaaaatctcatgagtaacccggaaatgttgggtaatctcatgaataatccacgtctcgctgagctcgccggtcagatgagcggcggaggcggaagtggcggcaccccagacctcagcagcatattgcaagatcctaatatcgcagaaatggcgaagaaattcatgggtggtgcgggacgaggcaattgacagtgatcttcagttttaaatggntggaataatagtgataatattacaatccttgttcaaaaaaaaaaaaaaatcaaaaaaaatnaaaaa

SEQ ID NO: 92835 - DNA, 524 bp, Triticum aestivum
  unsure (1)..(524): unsure at all n locations
  Clone ID: PAT_TA_92835
ctcgtgccgaattcggcacgagccacctcgaccttaggaacaatcgcctatccggcggcgtaccgccgctcccgatgacggtcgtgtacctcagtctcgctgggaacaggctctccggncgcgtgggcggcgtccttcgcagactgacgaggctgtcgtttcttgacctcggcgggaactggttctccggcgaggtgcccggagaagtcttctcgttccggattgggtacctgcagctgcgcaagaatgccttctctggcgagctccggccggcggggcggttgccttcgggcgccacggtggncctcagccacaacgcgctatccgggcgggtgccggcggagctggcgagcgcggacgcagtgtacctgaacgggaacaagtttgctggcgcggtgccggcggagattgtggcggcggcggagggcgggcgcatgcgggtgctcttccttcaaagacaacttctgaacggnaacancgtgcgcggcgtgccttcgaacgnaacggtattgcanaactggnaa

SEQ ID NO: 92836 - DNA, 407 bp, Triticum aestivum
  unsure (1)..(407): unsure at all n locations
  Clone ID: PAT_TA_92836
caccccgccgcccccgccttcctctccctcgctcatctttcccccagatccgatcaaggcaccgccgccacccctacccaccaccgccgacctctccaccatctcctccccgtcccccatcgctccgccatccacctcgtcgcctcccatctcctccctcccncaccatcccctttcgnccctccttccccacncccacaacaagatcgccgacgngacgacagcacatggnggcggtgtacacgggcggaggacatccacgactanctcttcanggtcgtcntcatcggagantccggcatcggcaagtccaacatgntctcccgcttcaanggcancgngttcangccttngagtccanggtccatcatcatnngggggtcnagttcgtnaccatggnccctcta

SEQ ID NO: 92837 - DNA, 516 bp, Triticum aestivum
  Clone ID: PAT_TA_92837
gtattcatcccgggtgtcgctatcattctattgcaataccatcaactccctcatatgaacggcccttggactatatctcgtcatacattcacttcgaaccctcaaacagtacgatgcctggcgccttggggtcctcttgtcatttcaaacataaacatgacacctcttcttcaagcctatctacatatccctactcatcaactctcccctcgtaccgtagcgcagtagctcaatcaacacaagatacaagggcacctaggaaccagtctttagatataacacacgaaacgtcattcacaccacgtggaatagaacttccccacgatatccacttaaataaaactgactatcaattgggactctcactttcaccactttctcaacgctccagtatctcaggctcattgtctgcacgtccagcatgtaaggacacgccgcatcttgacacatccgtcatggtgatagacagctctgatatactaagacgtatgctggagagagatattgtcgtcaaca

SEQ ID NO: 92838 - DNA, 266 bp, Triticum aestivum
  unsure (1)..(266): unsure at all n locations
  Clone ID: PAT_TA_92838
gagagaactagtctcgagtttttgagagtttttgagaaagaacgttttgagcgaatggatcgaagggcagggcagaaacaactgatgttgagacagtcgggtttgccataaatttttttcgcaatatataaattacatctgctacgcgcagctataaatttcaacttgttagaatttaaatgagaagcacactcctattctctctgtggtcaaaaaaaaaaaaaaaaaaaaaaaaaaaaaaaaaaaaaaaaaaaaaaaaaaaaaan

SEQ ID NO: 92839 - DNA, 180 bp, Triticum aestivum
  unsure (1)..(180): unsure at all n locations
  Clone ID: PAT_TA_92839
cgccgatgaananggaggggttccaacacggtgccgtcagggtcaaccgcaacacgctgntgcgggtcgccggcggtancggcggngacgcngnggccgcggcgctcgacctcnccggngtcgcctangcccgggcgccgtccaaaccgaccatngcntcnagggacanngnccggtgcc

SEQ ID NO: 92840 - DNA, 533 bp, Triticum aestivum
  unsure (1)..(533): unsure at all n locations
  Clone ID: PAT_TA_92840
ctcgtgccgaattcggcacgagcgggatcccggccgccgcctcacccacgaccctctcctccgctgccaagtctgctcgaacgccgccgccctcctcactggcgggatcggagccgccggccaccgcccacctcgcctgaaggatccgatgccactgctcttctacgccgatccatcaccggccaccggtggtgcatcacctgcttcccctgactgaagattccttgcggcgtttcgaagaagctgtgggtggaaattccggaaccgctgcgccgacggtggtgtgatgccggcgatgggtccgctggcaattcgatatgcgagtatgtcgctgccaactctagaggtgtgaccatgagtttgctactcctgccacgcgagtacaacaactgcgaacaagcatgctagtgcgtcttctgggacgaagacagtgccgagctctcgacagcgcagtcctgccaagccttcgagatctgggtatgggacacctttcgactgcatgcccatgacaacgacggntactcanagaaagg

SEQ ID NO: 92841 - DNA, 527 bp, Triticum aestivum
  unsure (1)..(527): unsure at all n locations
  Clone ID: PAT_TA_92841
tatgaaaccagttctaaatttttgctactaccatcctttgtttttgctaccaccgtcttagatttttgctaccatcccatctttttgattttgtattggatccatctgccggcagtcgcttttctccctcacgcgagatgtgtcgggggagctacgaaattcgcaaagctggaaccatcgcccaaatttgctggaaccgacggccaattttgctggaaccggctatggtgatgacgacgactatgacaggagcaacgaactagcgagggatgttgcgacctgcgggctgttttgttggaaccgacgatgctttttgctacataggggcggatagacgcggggcacgagcgatgcaaccatggngccagcgaggttgcccggcgagctgcaccggcgagcgacgccatggaggcaagaggcaagaaagccgcgggggaacgatgaacaagcagggggatttgcgtgaccggcgtcgctcgcgaagaagaaaagggacgtgtgcgaggcaatcctatggtccagggnng

SEQ ID NO: 92842 - DNA, 523 bp, Triticum aestivum
  unsure (1)..(523): unsure at all n locations
  Clone ID: PAT_TA_92842
ctcgtgccgaattcggcacgaggtcactcttttggaatcacctcatactacaactataaaaatttctacgcatcccatcaggatgtactctacaatgataaaaagagtcatcattatcacctttatgggcataggtctagtcgaagatatcactgggtctcctttgactgcgaaaatacagcacagtacaggaaatatggctgagctgaaatccaggggcacctcagccgtaggtgcgactgtcctggcaacggtgtttggtaatgcgttaggcggcatcctttccccaaaatttgtagagttgggaaagaagcacgcggaaaatgccgagaaaaaaaagaacaagagtcaggagagtctagatgaagacaatcctaggccaaaaaagagtaaatcgaaagaagaatctagctcgagtgttgagcccacctcgcggaaagaggacaaggagattgctgaagctgataacctctcgagcaaagatagcgtcacatcangagtcgcgaaagctaaacctctacga

SEQ ID NO: 92843 - DNA, 528 bp, Triticum aestivum
  unsure (1)..(528): unsure at all n locations
  Clone ID: PAT_TA_92843
gaaataacagcccataatgcaatacatatcgatataaaagcatgatgcaaaatggacatatcagcgcatctcatcatggcagtcattgccccatggaccgaacccttcctggactacctcgacaggaaagagcttcctgaggaccagaatgaggcccgatgcattatccggcgttcaaaggcctacaaggttcatgatggagagctctacaagaaaagcgccaccgtagtccttcaacgatgtatatccgaggaagaggggcgacaactcttgggctgaaattcatgccagattcaagcggtcaccaacgccacaagctcgggccctttgttagcaaagggcttccgtatagggttttattggccgacggccccgagcagatgcacaggaccttgtccaatgttgcgtcggatgccaactctttgccaatcaaagccatatgcccaacaccgccttaanacaatccccatcacttngaccctttgcagtctggggactcaatatgggctggacctctgaaagggggga

SEQ ID NO: 92844 - DNA, 279 bp, Triticum aestivum
  unsure (1)..(279): unsure at all n locations
  Clone ID: PAT_TA_92844
ctcgtgccgaattcggcacgagatgagcgggaacgaggttgagaaggccaaggctgccgccggcggnggcgtaggggagtacgggacgttccatggtccgcccagctacccgctcccgcgcccncccgtcatggcacccgtannacgccncgctgcccggcctccacggncatcgcgagcncaactcgcgccatcgcggtggttaccannccggganagctcacgntcactatcnaggtgcncgtgnacatanaccntgaccgtcttccatgctgcggt

SEQ ID NO: 92845 - DNA, 347 bp, Triticum aestivum
  Clone ID: PAT_TA_92845
ctcgtgccgaattcggcacgaggccattggcgacgacgccgtgcacggcgaggaggcctatgcgttgtggggcgatggcgagcactacgatgacaccaagcacggcgccgccgtcgtgccggtgtgattttctctgctttgttactttgcttctccttgttatgtcatgtgtgtcccttctataccgtgtcaccttttattttcactttttctgcctaaaacatgtaaatttgtagctcatgtatattcgaggataaccccggtctctacattgatagtgaaacacaaagtcatatattattaattatttaatgacgtgagaaaaaaaaaaagggggggcccggtac

SEQ ID NO: 92846 - DNA, 531 bp, Triticum aestivum
  unsure (1)..(531): unsure at all n locations
  Clone ID: PAT_TA_92846
cagaaaagggacacacagactggacttcatgtgttcgattcagtcccaaccctcagaacccagtcattgtcagtagtagctgggacaaacttgtaaaggtttgggagctctcctcctgtaggttacagaccgatcacagcggacacactggttacattaattgtgtcaccatctctccagatggttctctctgcgcgtctggaggcaaagacgggactacaatgttgtgggaccttaacgagtctaagcatctatactctctttctgccggggatgagatacacgctcttgtattctcacctaatcggtactggctctgtgccgcaacttcaagctatatcatcatctttgacctggagaagaagtcgaaagttgatcaattaaagccagaattccccactgcaggaaaaaagagccgcgaaccggnatgtgtgtccttggcatggagttcaaatgggcaagacattatttgcaaggatacactgataacatcantccgggcaaggggaatcatgtcncgggcgtaaaaaa

SEQ ID NO: 92847 - DNA, 302 bp, Triticum aestivum
  unsure (1)..(302): unsure at all n locations
  Clone ID: PAT_TA_92847
ctcgtgccgaattcggcacgaggatttttctagtcatcgccgccgngaggatttnngngcggggccaggagcngtgtcggnagtcgcggtcgcattgcttcaatcnattancgtcggngtacgggctagattgtgctccgagcnccggagggcgatcccgcaggnctgagcnangccgagtcacggccgctgagggctngctgtgtngcgctgncagngggcntnatgtcgcccgcttgctggaggagccgcgccggggnagcgcnagnntcgcgcgccgnggcttgancgtncgcaaagag

SEQ ID NO: 92848 - DNA, 529 bp, Triticum aestivum
  unsure (1)..(529): unsure at all n locations
  Clone ID: PAT_TA_92848
gtttggaatcacaatatagattgattaatccatactaaaatgtctgccgcacagcttttaaatcccaaagctgaatcaaggagaagaggagaagcgctcaaggtcaatatcagtgctggggaaggattacaggatgttttaaaatcaaatcttggtccactcgggacaatcaagatgctggttgacggagctggagcgattaaattaacaaaggatggaaatgttctcttgcnagaaatgcaaatccaaaatcccacggcggtaatgattgcacgagcggccacagcgcaggacgatatttgtggtgatggaaccacatctgtagtgcttctcgtcggtgaacttctcaaacaagctgaaagatacatttccgaaggattacatccaagaatagntacagatgggtatgaantcgcaaanatanagggctttaaagttcctangatgaatttaagatggnacgagaggtggtaagaagaagtgttactggtggtgtccnctaaagcctcctttaancaacaaaattang

SEQ ID NO: 92849 - DNA, 538 bp, Triticum aestivum
  unsure (1)..(538): unsure at all n locations
  Clone ID: PAT_TA_92849
tccgtgtctatcactgacataccatggactggaaatcctgaggccgaaatggatgctttcgttagctcccttcgccgtcagcttttccgtaagcacttagggctcatcccagctcaagacccccgccaccaaacgatgaattttcttcctcttacccacggaccaaatgaatatgactgggattccccagccgatcgtctcgtgcgtgaccctcttagtgataatttcattgagctttgggacagaactgcacgaacaaatacggaagttttctcaagagctttccacgttgttccatctgataattgcaaaaactgggaagaatacaaaaattggtacgaaaagttctttgttagttctagcaaggatgataataggagagttccgcctaagtacgaatacggtcacttagttaaagaagaatttccttgangtttgagggaagcgaaagagctacntgcattagtgaagggaactatagtcgaaatgncgttaagatttatgaagaagatgtagactttgctgttgctggtgtcaa

SEQ ID NO: 92850 - DNA, 547 bp, Triticum aestivum
  unsure (1)..(547): unsure at all n locations
  Clone ID: PAT_TA_92850
gatccactgccggtgggccatgctgggcgctctcggctgcgtcttccccgagctgctcgcccgcaacggcgtcaagttcggcgaggccgtgtggttcaaggccggctcccaagatcttcagcgagggcggcctcgactacctcggcaaccccagcctcgtccacgcgcagagcatccttgccatctgggcctgccaggtcgtgctcatgggcgccgtcgagggctaccgcgtcgccggcggnccgctcggcgagatcgtcgacccgctctaccccggcggcaagcttcgaccccctgggcctcgccgatgaccccganggnattcgcggagctcangggtgnaggaggatcangaacgggncgcctcgcnatgttctccatgttcggcttcttcngggcaaggccatcggtcanccgggnanagggccccctcgnagaaacctccgtcggncgaaccttcgncggnncccgtcaancaaccaacnccctggggccttncggcaaccaaacttttgnggccnggcaaggttacgctggcnanggtcct

SEQ ID NO: 92851 - DNA, 159 bp, Triticum aestivum
  Clone ID: PAT_TA_92851
ctcgtgccgaattcggcacgaggagagaacggtgtgggaagtgggaatacaataagatgaacaatgtggcgctttcttggtgcatggcacaaataaatttgatcaataaatggccgaagcataagaatgtttctaaaaaaaaaaaaaaaaaactcgcgg

SEQ ID NO: 92852 - DNA, 529 bp, Triticum aestivum
  unsure (1)..(529): unsure at all n locations
  Clone ID: PAT_TA_92852
cctcctagcaagctanatacctacatagnacagccatggcccccaccgtgatggcctcgtcggtcacctccgtcgctcctttccaggggctcaagtccaccgccggcctccccgtcagccgccgctccaacggttctagcctcggcagcgtcagcaacggtggaaggatcaggtgnatgcangtgtggcccatcgagggcatcaagaagttcgagnncctgtcttacctgccancgctcagcacggnngccctcctcaagcaggtcgactacctgatccgctccaagtgggtgccttgcctcgagttcagcaaggttgggttcatcttccgtgagcacaacgcatctcctgggtactacganggccggtattgggcaatgtggnanctgnctatgttcgggtgcactgacnccacacaggtgatcatcgatgtgtaggaggtcaagaccgataacctgaccgtatgtcngcatcaacggattcgacaatcatgcgtcaggtcaagggcgtcaagttcatcgccttcaan

SEQ ID NO: 92853 - DNA, 484 bp, Triticum aestivum
  unsure (1)..(484): unsure at all n locations
  Clone ID: PAT_TA_92853
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcanggagtgctgctccggcgtgcaggggctgaacggcctggnccgcagcaagcccggaccgcaagatagcgtgcaggtgcctcaagagcctcgccaccaagcatcaagtccatcancatggggcaagggtctccggcgtggccgggcaagtgcggcgtcaagcgtggcccttccccatcaanatgtccaccnanctgcaaccaatgtcaaagtaggtcaatanatnctccttcctaacntgcaag

SEQ ID NO: 92854 - DNA, 491 bp, Triticum aestivum
  unsure (1)..(491): unsure at all n locations
  Clone ID: PAT_TA_92854
ttttttttagaatgaaagtcagccatgcacaagcacaagaacatagagtatttgcatacattcaaccatacgggccacagaatgatatggtacctaattcattaatccaagatatctaaagtatttacagagtatatgtatacggatgatgaatatctatgtttggatggntggtaatggntatataatctagagtctgatatgtgcgtgtttgtcaactaatcttgggttggtggntggnggtggtgagttgatccggccgccggccggctagcgcgagatgtccggactgggcggtgagcacgccatggtgtccaccgacgactcccagctgagcttgatggcggatgcgtcctggtgcgccggcgcgtactcctccaagcggcggcagcaagctcgccgggcgtgggcgcccgcngacgaatgangngnccttggccgccgggcgacacgaaccccctccgtcaaccggccctgtccgatgaagtcca

SEQ ID NO: 92855 - DNA, 532 bp, Triticum aestivum
  unsure (1)..(532): unsure at all n locations
  Clone ID: PAT_TA_92855
cgactgtggctcggcttgcgttagacctgatggggtcagcgttgcctaacgattatcattcagagttgcaggacattgtagatgccgaagaagctagaaaagagggcatcactcaggcagaggaatttcatgatgctcagcaagaattgccgtccgaaactaatgctgcgtccgttgtcagtttgaatcatcctaccggcgcttatgtctcagaggctggtcacaccgtcatcgcagaggaagtcaatcggaggagagcttccataaaggaagccattcttgagtgcgattctgaggccaataaggttgaggcgtcatgtgcagatcaatataggattgtcatgacaggcaccaatcccaacaagcgagagttgattcggcgacaagaggatttcaagaacccagatatatggtggatagatcgaggtattatcataaaatcagttcttggcacttctgtggacggttttatacatgccgcagttttcactcctaacaacttcgaaggttgcaagntggcaagtgttatgga

SEQ ID NO: 92856 - DNA, 546 bp, Triticum aestivum
  unsure (1)..(546): unsure at all n locations
  Clone ID: PAT_TA_92856
ctcgtgccgaattcggcacgagcatttcaataaatttttgttccacgacgcagcgatataccttcgctccatccagaactcctccaaactcacgtttaaatcatccaaaaaagctacatctctaagaaattcgtttcattctagctcagcagaataatctcgacaccaaggtaccatttatgtcatcaatagaaaatctgagaacatttgaccccttcgccgaagccgatgaagacaccggagagatcaaacagtcgcaaaattacattcacattcgtattcagcagcggaatggtcgcaagactttaacgactgtccaaggcctgcccaagaaattcgaccagaagaaaatattaaaggttataaaaaagaaattcgcttgtaatggcaccattgttgttgatactgagatgggagaggtaattcaactccaaggtgatcaacgaaagggacgtacaagagttccttacaagacaagaaagaagggttagaacttgatctcaaggaccaattaaggntcatgggntttaattacacgaatgtaca

SEQ ID NO: 92857 - DNA, 528 bp, Triticum aestivum
  unsure (1)..(528): unsure at all n locations
  Clone ID: PAT_TA_92857
ctcgtgccgaattcggcacgagctcgtgccgaattcggcacgagagcaaaggaaggctatcagggtcgccgttgaagaagcaaagctagagggctttcctaccgacgttgaanaaagagaaggttactttatgcaagagattgcgaaaggagaaggacttagctctgacggntctgccagccaagaggcagccctttgtttttacaaggctttgaaagtatatccatcgcctcctgatctaatatcgatatacgacaaaacggttccgaaagcaatcctagatattctcgctgaaatgatcgcagctgactcttctatgagcgtaaaccctcttaaagctgaattagataatgaaaaaggcctggactagagtcaaactacaaacctcttcgaaacgcttcaaacaggatcaaggaaataagataggataacttattgcgccgtttaatttttgggatgcaaccgaaaacacgggcanctaaaagtgcacagtcctgtgcggtacaagtataaacttaaaattatgat

SEQ ID NO: 92858 - DNA, 533 bp, Triticum aestivum
  unsure (1)..(533): unsure at all n locations
  Clone ID: PAT_TA_92858
ctcgtgccgaattcggcacganattttctttcagcaaagtgtcaccgctactcagctgccactagcttancccaggacccacccaacacattaagctgtccgcctcctgctccaacaacgccacacattccccacatccatttcgataaggatcccagagctccagctcctcctgcgtcgcctccaatggcggctgccgctgcttccacagggaacgggagcccgccggtgggtctgctggtgctgatggtgctggcattggcggccgggtggntcgcgaacgccgtccgcccgccgncgccgacgccgtgcggtgcgcccggcgggccgccggtgacggcgccganggtgcggatgcgcgacgggcggttcttggcgtacgccgagtccggtgtgagccgggacggngcgcggttaangtcgtctantcgcacggnttctccgngtagccgcaanggactcgccccgcggcctcgcaagcgctgctgggnggaactgggccgtgtacatggggggcgttcgaccgctccggg

SEQ ID NO: 92859 - DNA, 423 bp, Triticum aestivum
  unsure (1)..(423): unsure at all n locations
  Clone ID: PAT_TA_92859
cctgattggtatagcttgtttcttcatccaatcaaattttggaggactctaactgaggtcataaaactggatacagtcagagtatctgaagagacggccgcaagaagaaaagagagggttgaagaagtaacgaaacgagcagcattcaggaaggcgcatggattaagtgaaaatgccggacttggtgcatgggtatcaagcactaacaatggtaccaatagtttagatgggcgagtaaaaatccaaaatggtgaagtcgctgatgtgccgagccaagcgtctaatttggaaagccaaacagaaataaaggaagaagtacaggaaaagagaccaattaagaaatggctagggatttggtagatattttgactccaaacaatttacatttttaataccaaaaanaaananaaaaaaaaggggggg

SEQ ID NO: 92860 - DNA, 515 bp, Triticum aestivum
  unsure (1)..(515): unsure at all n locations
  Clone ID: PAT_TA_92860
gtgacaagctgttattcgcagtgttataagcacatgacaacttggtatgggtagttgcaatgcacatctgaccttattgcacgccagcctatcctcttgttagatttctgaagtgaaaagggaattggagattttatcgctcttgtcttataaactttttatctacgatgagggcaggaaagcgacggaatttgctggcacaagtggcgcggagtgaagatttatcgtctagagaataactgcattctctgtagatcacgagttgcgttcagtcggactcaccttggaaccacatcgattggccttaccgtaagctcagcaatctcgattgtgcatagctaaaatactatggagaaacgggtatgggctaggnggcnagnattccggatggnaatgagtttaatttcanttattaattaanngnccttggnanggncctcanntggncaaaacccnagggggggcccggtaccaantcgccctatagngggcgtattacgcgcgctcatggccgt

SEQ ID NO: 92861 - DNA, 539 bp, Triticum aestivum
  unsure (1)..(539): unsure at all n locations
  Clone ID: PAT_TA_92861
gagagagagagagcagcactcagtaattcttgtcccatcaaacacccgtggtatttcaatcaagcggatgatgtctgtctacggctacgatgatgctcctcacggacacggtcacttggttttcaataatgtaaaagttccttcgagtaatcttattcttgggtctggaagagggtttgaaattgtccagagtcgactaggcccgggccggatccatcatgccatgcgttgcattggcgctgccgaaagagccatcgagtggatgctctatcgaattaacgatccgagaaaaattgcctttggcaaacagttaagcgagcatggcgtggtacttgatttgcttgcaaaatcgcgtgtanaaattgacgcggcgcgccttgttgttctgaatgctgccatcatgatcgacaagttcgggtcaaaaaaagccttgaaaagaaatcggtgaggcaaaaatcccttgtacctaagnaatgactcttactgncaatccgaaccgagcaattcaaaagctttggtggccgctggtggtcccccaa

SEQ ID NO: 92862 - DNA, 529 bp, Triticum aestivum
  unsure (1)..(529): unsure at all n locations
  Clone ID: PAT_TA_92862
actggtagacttctggcgcctcagcacagcgcactcgcaatacctcgtggtgaaaaacttttataacgcccttcanagcgacaagaccgtggaggagctcgactctactactctaggcgtgcttaacaagattttcagactctatgcactcgatacactagagaaagaggcttcagaatttttttcgtcagccgctgtcactattagacaaattcagttgacanaaacgaaggccgtaatgcaacttctcgaggatatcaggcctcatgccataagacttactgatgcttggcaattctcaagattggcaacttgactcgtcnttagggcgaaangatggcaaggcatacgaagatctcttctacagagccagtgaactgaaccctctcaatggcctaaccgttgatccgtacccgaacagcgaagtgattgttaagagagatgaaacctacgagtttaaaagtaagctttagggtaataaagagtaattccaaactatgttcgtgctaattatttaatttgaaaatac

SEQ ID NO: 92863 - DNA, 493 bp, Triticum aestivum
  unsure (1)..(493): unsure at all n locations
  Clone ID: PAT_TA_92863
tttgtttanccacagtctattttacaagctgtgtcttacatgagaaacgctganatgcaataatcaaatctccttgattggcctacattcagttattttcgtgccctgccgaaactagtgatgaaaattctaccagctcttaccgcccgagccggcacgggaggcataaacanatattcttatacngaataacttctttcatgtgatcatttcancacaatcannaaaatcattcaaaagatgcantatgcacctgttcagagggaaataccttgacgatatatacaagtgggggtaaatgcagggcgcttgcagctggnacgcaaaanagtaacaattaattaagtaatgggtatgatggttgatcagagtgttcgataaggtcgngatangacatagattctttgcgaagtataggcaacggtcaagctcatgggcgttacgaaantgattgacgcgccaacatagcaagcgcatccgcgctatgccgcct

SEQ ID NO: 92864 - DNA, 516 bp, Triticum aestivum
  unsure (1)..(516): unsure at all n locations
  Clone ID: PAT_TA_92864
ctcagattggtgacaaattcgcttctcggnatggtcaaaagggaactatcggaattacttataggcangangatatgccatttacatgccaaggaattgttcccgatttaattattaacccacacgcaatcccatcccgtatgactattgcccatttgatagaatgtcaactgagtaaagtgtcgaccctacgtggtctagaaggagacgccacgccttttacagaagttacggtcgactcagtctcgaaacttctacgcgatcatgggtaccaatcacgtggatttgagataatgtaccatggncacacaggccgaaagcttgttgcacaagtctttctangacccacatattaccaagcgtttgcggcatatggttgncgataaaatcnacgcacgtgccagaggcccagtacaagattctaacacggcaacctgtgggnangtcgtgccaagagatggtgggtctgcggntcggagaaatggnacgcgantgcatgattctcaaggggcaana

SEQ ID NO: 92865 - DNA, 360 bp, Triticum aestivum
  unsure (1)..(360): unsure at all n locations
  Clone ID: PAT_TA_92865
ttttttttttttttgcaagaagtgaacatttctgaatagtaatgttttttattaactcaatggtagcacttgatttctctgtgttaccctactcttgtatttcctgtgcttttgaaatttaaaaaataatcactacactacacgcatagagaatttgccggtcttcaaggggtagccagctcgaggtctccggtttncctcgccatctgctgctgcancagctggatcttctgcgccgccgccntcntctgcnggaacttctcgccgtacatgtaagaggnaaagccccagaggcagnncacgagcacgatacnctttatcccgtctgacataccgtngngganccattcngngaggacc

SEQ ID NO: 92866 - DNA, 159 bp, Triticum aestivum
  unsure (1)..(159): unsure at all n locations
  Clone ID: PAT_TA_92866
ctagnggatatcaacccaanggtaattagaatgctctagnctanatggaaattacaattcatgtatcagacgcgatangggaanaattantggnagatgnctaganngangactacatncatncgcagtcaaacctantatctgctcttatttctctca

SEQ ID NO: 92867 - DNA, 477 bp, Triticum aestivum
  Clone ID: PAT_TA_92867
ctcgcgctgaggatcctggaggtggtcggatgtcccactgtactgacatttgagaaaggatcaatgacaaagctcgaggtgcttgtattgcgcttttatgacgagaagtcgagcattgtcggcctcgagaacttggagatccttaaaaatgtcaagctgcatggtaggaaaggcaacccggcaatggaacgtgcggtgcagcaactcaaggctctcttcacggagtccaatcagatcgtcaaagttgtagtggactactggtgctgacgtgcgcatcttaattaggaactgctgctcctatatgttttctacagcctgaattagtgtgcttttcctttcaactgaatgattgtgcgtctgctagctaaattctgttcagactcgatcgagcattatgtgtatgtaacagcaggttgtatatactcctatgttgtaacgtgagggcaattgttcatctgttgctgttactcgtgaaaa

SEQ ID NO: 92868 - DNA, 516 bp, Triticum aestivum
  unsure (1)..(516): unsure at all n locations
  Clone ID: PAT_TA_92868
ttcaatttacatgtcacataaacgatagatctcagtcctacattaatcacaaaaatggaccccgtatctcataagatgtgtgttggaccggattacaggcacccattacaaaaacctacagccacagtctcaatacctatgcatttcgaaaacgttcacacgttaccccaaacaccacagcttatcgcccttttaactataatccgtgaccaatcaacagcccgcgcagattttatattctacagcaaccgcataatccgattgcttgttgaagaaggcttgaatcatctgccagtgatagaacattctgttactacgcctgttggtcaaacgtatgaaggtgtcaaattccaaggaaaaatatgtggtgtgagtatcatgaggagcaggtgaagccatggaacaagggctacgtgattgttgtcgaagtgtacgtattggtaagattcttatacaacgcgacgaggaaactagcctanctaggcttttttatgacaagttgcccaaagntattgc

SEQ ID NO: 92869 - DNA, 504 bp, Triticum aestivum
  unsure (1)..(504): unsure at all n locations
  Clone ID: PAT_TA_92869
atagccccattttggatacactcgtgcggacagctatttactctggtgccatcctttcacatctaatttgtattcattcggagtccgcgaaactaaagaaacaatggatttggttaatcatctcgagggtcgacttttgttcgctgtacctaaaaagggtcgacttctccaagctacattagatcttctcaaaggcgcggatatcaaattcaggcgagaaaaccggctcgatattgcacttgttgtcaatcatcccattgctttggtatttcttcctgctgcagatattccaacatttgttggtgaaggtagggtcagtctaggaattacagggcaagacacagtagcagaacatgcatcatcattacttaagcanaggaaaatacgacaggaatccctcaatgtaagtcaaagcgactacgatgatgggatttggatgtgaggagataatggnntttggggtttggggacgtgtaaattgcaagtccaagtacccgaaaangg

SEQ ID NO: 92870 - DNA, 509 bp, Triticum aestivum
  unsure (1)..(509): unsure at all n locations
  Clone ID: PAT_TA_92870
aaaactcgaggattgcatctgagaatagtgggcagcattaaagtgttgaggcatttgctgattgactatttgagatggggttgaggctggtcggggcctgtccataggtccattcggggcgtgatcacgcgcaggaccagtactaaccccacgtggagagagaccaacctcgtccatgaggcgcttataacattgagcaggttgagctttaagccgaataaggacatttctaattttctccacaacttctggacgaatactttcgtcaaaaaatggagttgtgagcactttaaaaattagggtagcgccacaagcgtgatccgaaagtatggtctcgagtgtctcatcattagacgaagaagaatagagccttgtatatcttgtctcgcgcttctggttcttgcttttggtttatccctttangaacggtcaagtaagctactttgtgcgtacanagatgtgtgaggtgaggaattaanttgaggaacaaggacggatcttctttgang

SEQ ID NO: 92871 - DNA, 506 bp, Triticum aestivum
  unsure (1)..(506): unsure at all n locations
  Clone ID: PAT_TA_92871
cctccccgtacgcatcgacatcatggagaagccagatctcgaaatcgccaatgtcatcctccagctcaccgagggcgcgccgcgcgaccaggagctggccctgcagcgctacttcttgcccgatgccggcctcatccaccccttgtgccgcgtgccgcgcttccgcgacctgccgctgccgctgctcgggcccgtcgactcgcgctgggtcatcggcatgatctatcgctggtacaaaattctgtcgccgcgcgtctcactgcaggtgcagcgggttgtctacgatgacaaggctgcccacctctactgcgaggtgcagcaaatcttctcgcccgtcttcctccctttctaccacgccagctcgcacctcaccgtcaagctacagctccaacgagacggncccgccggcanatactacatagtgacgcaagaggatctctatcagtcgacggagttgggtgcgcttctttgggcccggttactccacgctcgtcttcttcctgnaa

SEQ ID NO: 92872 - DNA, 312 bp, Triticum aestivum
  unsure (1)..(312): unsure at all n locations
  Clone ID: PAT_TA_92872
gcgtagttgagttggtancgtagaccaaggcaaaaagaantcttgatgcaaagtaaccacaaattcctcctgaacagtccgaaattaaagcatgtcctctacggaacttggattcccgtcgaaaaaatcgcataagccttcacagaatgttgatggcatgggcagggcttgaacaaatactttccaactcaaaagcctggaagagtcatactgtacatatgaaataatcaacccaggaatcttctaatctaaaccactaagatgaaatagtggatggtcaatcaaaanaaaaaaacaaaaaanaanaaagna

SEQ ID NO: 92873 - DNA, 503 bp, Triticum aestivum
  Clone ID: PAT_TA_92873
ggctagatgaaatcacctcaccgtcgagctggtctacagaatttctcatacccgaggccaaagaagttcttcaagccctaggcgcctttgttgtctgcttcagaaaacctcttgaccagccaagcttcgatcaaatcaggtccctcttgaagcattgtttgtcttgctattgcaatgccacaatcgaacactccccaactcagcaagagctttgatgattgggaaggcgtttgccaagaatttgggttcgaatttgtcgacttcgaaatgaaaggactaaatcaatacatggagtcaacaggtgtgaagaggattaaggaagcgcttgaatcgaacgattgggagggtagagatcatttggagagtgcgctacaatttgaagaccttgatgaagacgaagagaatgagggtcttggcctccgtgttgaagctgatcaaatgaagatcgaaatgctcggactaaatgaggctatccacgtagttgaaggaaatttgaatgaaaa

SEQ ID NO: 92874 - DNA, 516 bp, Triticum aestivum
  unsure (1)..(516): unsure at all n locations
  Clone ID: PAT_TA_92874
tgatatctcggtggtatccctcccccgcatagctcccatggaccggacctgtttactgggttgtggtataactaccggttatggagctgcgattgagaccgccaaaatagagcaaggttctaccgtgggcatcttcggtgctggctgcgtcgggctctcggtggttcaaggagccgtcangagcanggctagtcgcattattgtcatcgacattaatcctgataagaagggctgggccgagaagtttggagcgactgacttcctcaatccaaccgagcttaaaaaccangacaatagtggagaagctcatagagatgacagatggaggctgtgantacacatttgattgtacgggaaatgtgggcgtgatgcgtgcggctctcgaagcgtgtcacaanggttggggacaagagtattataataggcgttgccgcagctggtcaaganatttccactccaccattccagctcgttaccgaacgcgtttggnaaggatgtgcttttggcggaaacaan

SEQ ID NO: 92875 - DNA, 424 bp, Triticum aestivum
  unsure (1)..(424): unsure at all n locations
  Clone ID: PAT_TA_92875
ctcgtgccgaattcggcacgaggttttaaatggagtgtttagtctacaaaaaatcttttggacctcctgtcgcacgtctgcgctgcctttgcctcggaaaaaaggattccttaaaaggagccgtgtaacatcccaaattttcaatttggtatgttatacatagatcatcattgcatatcatgttttattgcattttgacaaatcctcgataaatcctaagcaactcaaggaccctcggagagagttggggattttctcgaattttcatatttgattttcatcaaaaaaataagacgaggattttgggttttaattattttctctccggaaaaatatttcatttaaaaaaaataaacgagaggagaaaatatgacttctccaaaacaagtgntgnncacaagcncgggnaacccaagcgaccatt

SEQ ID NO: 92876 - DNA, 523 bp, Triticum aestivum
  Clone ID: PAT_TA_92876
ctcgtgccgaattcggcacgaggagagagagacgtttgcggtgagcggcacgcccagcatcggggacttcttcccggcgcttcgctgggtcgaccgtctccgtggcgtcgaggcggcgcttgtaagcctgcagacaaggcgtgacgcgttcgtcggtgccctcatcgatgaccatcggcgaacgagcaatgccggtggccgagacgtggagaagaagggcgtaatcgacgtactcatggagcaccaagcagccgatcctgtgtattacactgacaccgtcgtcaaaggcatcgtcttggtactgctcaccgccggcaccgacacatcggcgctgaccacggagtgggcgctggcgctgcttgtgaagcacccagaggtgatgcagaaggcgagggctgagatagacgccaaagtcggcatcggccgactggttgaggagtcggacatcaccaaacctaccttacctgcagtgcgttggtcaaggagactcttcggctgtgcccccgtcgggccaatcaatctg

SEQ ID NO: 92877 - DNA, 510 bp, Triticum aestivum
  unsure (1)..(510): unsure at all n locations
  Clone ID: PAT_TA_92877
caaaggaaatccactccantccaatccccacaganatccccatctcaaaaccctagcccgtccgatcccggcgagatggccaacccgngggtgttcttcgncatgaccgtcggtggcgcgccggncgggngcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggngacttcaccaagggcaacggcaccggnggcgagtccatctacggngagaagttcgccgacgagaattcgtccacaggcacaccangccccgggatcctctccatggncaangcgggccccaanaccaacggntcccagttcttcatctgcaccgtcccctgcaattggctcgacggcaagcacgtggtcttcggcnangtcgtccgagggcaatgnctg

SEQ ID NO: 92878 - DNA, 226 bp, Triticum aestivum
  unsure (1)..(226): unsure at all n locations
  Clone ID: PAT_TA_92878
gtcccatccggacacgggacgaagtcttcaatcttgtatctgcatagtccaggagtccggccaacggtgatagtttggctatccggacaccccctaatccaggactccctcagtgacctttcgggaagtttgaccatggagtacgatttgacctgagtttaagcatattgacccgagattaagccatagtgacctgagattaagaaaaaaaaaanaaaannaaaaa

SEQ ID NO: 92879 - DNA, 515 bp, Triticum aestivum
  unsure (1)..(515): unsure at all n locations
  Clone ID: PAT_TA_92879
agcaagctatatacctacatagcacagncatgggccccaccgtgatggcctcgtcggccacctccgtcgctcctttccaggggctcaagtccaccgccggggctccccgtcagccgccgctccaacggcgctngcctcggnagcgtcagcaacggtgggaggntnaggtgcatgcnggtgtggcccatcgagggcatcaagnagttcgagaccctgtcctacctgccancgttcagcacggaggccctcctcaagcaggtctactacctgatccgctccaanctgggtgccttgcctcgngttcagcanggttggnttcatcttccgtgngnacaacgcatcccctgtgtactacnatggccggtactggacaatgtggaagntgcctatgntcnggtgcancgacttacacangtgntngaacgaggtggnntaggtcactnaaggatgacctgacncatacgtccgnnataatcgtctccganaanattttcnaggtgcattgggcagcttnn

SEQ ID NO: 92880 - DNA, 243 bp, Triticum aestivum
  unsure (1)..(243): unsure at all n locations
  Clone ID: PAT_TA_92880
tatgatacctacatantnacagccatggacctcaccgtgatntgcctcgatcggacanctccnatcgctcctttcnaggggctcattnctagcgtacggantctcacgtcaggtcgccgcnccanangaagcgtaaccatcagcaganncagcaactgtggaangatcacgtncatgcatagtgtgggccatcaanggcancaagncgttcaatgaccctgncatacctgacatcgctnacaa

SEQ ID NO: 92881 - DNA, 536 bp, Triticum aestivum
  unsure (1)..(536): unsure at all n locations
  Clone ID: PAT_TA_92881
ctcgtgccgaattcggcacgagaccatcaccaaaatggatatacatcgctgcagatttgttcctattccaccatcttcaattaacgccctcgccttttcccactcaaacatctctagcaacaagaagactgctcctctacgactggccgttggccgtgcaaacggtgatattgaaatatggaacccaattaaaggttcatggcttcaagagattataatacgtgggggaaaagatcgcantattgatggactcgtttggacacaagatcccaatgaggaaattgatggcaaaacaataattgggaagttgagacttttcagcataggctacaccacaactataacggaatgggatttaagcaccggtaaaccattaaggcaagcaagtgggaatcatggcgagatctggtgtatagctgcacagccaagttcaaatcctgcgactgtcgctttatcccanaatattgatgggcaagaaaaatgtcaagtatttaattactgggctgcactgatggagcccttgtcctcnactccan

SEQ ID NO: 92882 - DNA, 196 bp, Triticum aestivum
  unsure (1)..(196): unsure at all n locations
  Clone ID: PAT_TA_92882
actcatctcatcccatgggtcagcctccaggtancctganggacacantcacaaggccggncncangagcttcaacccttcatcattcagcggcgaagcatctggtcatcnttngntcaccaggnacggcattaacagnaggtgcntcctnaatctgntgncanccgncgcatgacanaccctgggctancgactc

SEQ ID NO: 92883 - DNA, 545 bp, Triticum aestivum
  unsure (1)..(545): unsure at all n locations
  Clone ID: PAT_TA_92883
ctcgtgccgaattcggcacgagatttaaattgcctgtgtaagggaacaaagggatatcaactcancagaaaagtctattgagtcttggaattcatcattaaaaatggttaatattacagagaaaattaagganatcnaggaggagatgaggcggacgcagaaaaacaaggcgacggaataccatctcggtctcttgaaaggaaaactcgcccgttatcgtgcccagctccttgaacctggcccaggcgctggcggtggtggaggcgctggctttgatgtgagcaaaagtggtgatgcaagaattgcccttgtcggatttccatccgtgggaaaatctacgttcctctcaaaaatcacaaagactaaatcaanaagtcgcggcttactcttttaccacccttaccgctataccgggagtgcttgagtatnggggggcaagagantcaagtantgggcttaccaagtatcatcgaaagggggcatcagnaagggcaaaaggaaggggcccgtcaaggcatctccgctgcaaaaacngagtgatttaa

SEQ ID NO: 92884 - DNA, 522 bp, Triticum aestivum
  unsure (1)..(522): unsure at all n locations
  Clone ID: PAT_TA_92884
cacccatgaactgaagcacacatgcgtgtgcagtgtgagctaagtaagctggtaattcattcgggcattgtgcatggtactcattcatatcgctgccttctcttgatcttcagtttaaaagatgaaccctcaattgtcaagttgagttaacaggggcagcggggtaatgggagtttgattgtcaaattcagaatgtcaagttcggttaacagatgtcatgatggatcacgtgacatctgttgaaattgtagtctgtaattcttgggttgttggtctaaatctggagtttctanagaatcaagtactcaaaagaaccttctagagtagacgacaacagacaaatgttacagctatatgtagagttacacttttttctgtaatccaatgatgctgaattgtgtgggaactaatctactattacctgtatctgttcttgantttctgttanaaagcttgaagaaaatatctgttgaattgttgaaaccanttactaaacagttgtatattctgaaatannttgcg

SEQ ID NO: 92885 - DNA, 157 bp, Triticum aestivum
  unsure (1)..(157): unsure at all n locations
  Clone ID: PAT_TA_92885
ctcgtgccgnnttcggcacgagcttccctcccactanccccaccaccgcgttcaccagacattgccngtcggagctaggaggnccgatnnaggacntgcatcggtgctacntagttatganggtnctgcgcaagtacngnggcgtgnggggccggcg

SEQ ID NO: 92886 - DNA, 526 bp, Triticum aestivum
  unsure (1)..(526): unsure at all n locations
  Clone ID: PAT_TA_92886
aaatattctccctgagccaagctcagtcaaatttcgcactatcaaggaagttggcccacgaggcaatgattcaagagtctcatcaagtctacaagtacaacctagtacatcctcatttcaacgaccgcacctcttgtcgactttctctagccttagctgtccgccaaatacacgcccacgccgatatttacacccgacgggagaagcaaagcgtggaacataaatctgagagatagttctttgggatggacgtgagagagattaggacaaattcaaaagatagtacagacaatggagacaatatggacgggcgtggaaatttgaatattggcaatgagttttacaaattgagctttatgcgcgccaagacttcgcttgtgagagtgcagctctcactttaaaatcaagccaacaatagaggacgccatgatctgcctcctgggtagtgatctcctggnataagttcgagtagtctgggnaactactccacttgggaaggngatgctccgggtaaaaatccgngngg

SEQ ID NO: 92887 - DNA, 383 bp, Triticum aestivum
  unsure (1)..(383): unsure at all n locations
  Clone ID: PAT_TA_92887
ctcgtgccgaattcggcacgagctcgtgccgaattcggcacgagacagtcanatncgctctcncntcctctcncctctatttcnatccacacaaatcgcaatcggaaccaagatcatcaagttcgccgtcgccatggcgcanagggcgctggagctgancctgatatcgggcaaggacctcaaggacgtgaacctcttcncggncatggaggtgtacnccgtcgtctccctctccggngacccgcgctcccgccagcgcgtcgccaccgacngctccggcggccgcaacccgacctggaaagccacgagtccgcttcaccgtctcngctatgngnncgcgggngtcnggtccacgtgctgctccgcgccgagcgcgncctcgg

SEQ ID NO: 92888 - DNA, 299 bp, Triticum aestivum
  unsure (1)..(299): unsure at all n locations
  Clone ID: PAT_TA_92888
accgcgcgtggacggggacgactctantaactacgtgggatgcnccgncctgcaggaattcggnacgagcttcgacttcctcctcccgtctcgagttcgtcgtacacaacgatataacgngtgaggtttcanggcagagccgaactancanacatgaaggaggcngtngcggagacgatgctggaggccggagtgtcngnggttccgggggccgagcctcnnngcgctgcttgcggagatntgggngccgctggtcntgatgctggaggcgctcgcgacgntgcncagcctgatcggca

SEQ ID NO: 92889 - DNA, 154 bp, Triticum aestivum
  unsure (1)..(154): unsure at all n locations
  Clone ID: PAT_TA_92889
ggacgaaccctttccacaagcgnaggnnatcccctcaanncccttgcatgcgtccccctctccgtcgattggntacgaacatcnaggagntcgccttcacctgggcgnnatgaccnagctgtgtccgatgtcccangtggtagttccaagcccg

SEQ ID NO: 92890 - DNA, 544 bp, Triticum aestivum
  unsure (1)..(544): unsure at all n locations
  Clone ID: PAT_TA_92890
ctccgccggcgtcgctccatctccgaccccccggtgcggcggcgctgcccagcctttgtcacgcgccgctgtgggcctcgccgtaggcgctanagtcagagagggctgcctgtctctgggcctcgacggcctcctcgctcctccgcggctgccacgacctagctcgccgtcggtcagcaccaacagtcccacctcgaaggcagactagactttccacgcgcggacccgccatgggcgccgaggtcgcccagatcagcgccttcgccgccttggacgcccacgcgctctgcctcgccggtctcgcagccgcccactccctcgccggacgcgngtgcgctcgtctccgaccccgcccacgcgctccgcctcctcgtggtctgtgaggcgccgcttgtcatcgtggtgttcagtccnggtccggggganaattccaaanggtgntccnttccttangggttgctggnangggaattgctttgggccttgccanntngggggcaatcctacaatgnactttggnggccnatnggtccctggcngcgcn

SEQ ID NO: 92891 - DNA, 535 bp, Triticum aestivum
  unsure (1)..(535): unsure at all n locations
  Clone ID: PAT_TA_92891
ctcgtgccgaattcggcacgaggttcgcggcaaggccgcccttaatgctgctcaacgtaccggttccgtcatcggtaccgaaaaaaagtttaccgcaggaaatctggcctcgaaacccggcgtcgaaggacaacacctgaccaaggttgaccgcagcgatgacattgtcaaacctaacactgttgggaaagaagttggctccgctattagcgagcggcgtcaaaagatcgaacccaaaatgacgcagcgagacttggctacaangtgcantacaacgcatngtatcgttgccgaatttgancgcggtaccgctgctccagatcagaanatcttgggcaacatggaaaaggttctaggcatcaagttacgtggcaagtgncataggtgcaccacgattcggntcaaaggaaaaaantnnccacagcnagcatatatncatntccgnctgnttcagggggagcaggatacggcgagcttgctttttacggngcnnagttgggaacnatnaagagacaatggtngtaattatttgttg

SEQ ID NO: 92892 - DNA, 280 bp, Triticum aestivum
  unsure (1)..(280): unsure at all n locations
  Clone ID: PAT_TA_92892
gcgcggcccanatnaaccgaagccagccagcccactcnacgggattctcctccggcaagctccgcgcggaaccctagctagccccgccgggcgccggcgcccctctcccgtccacactccanccgccgggctcgcctcctccacctcncgacaccggcagccatggcgcagagggcggtgggcgcgcttctccggcggtccctcgggctcgcgccgccggcggccccgagggngctgagcaccagcgccgcggngccggtcgcggnggcggangcgagag

SEQ ID NO: 92893 - DNA, 550 bp, Triticum aestivum
  Clone ID: PAT_TA_92893
tttttttttttttttttttgtatacatcagcaatctgcaatcggattagcacaccctcataaataaggggaattgataaatcaaggttgctttcctttctaccgtggataaccatattgaatcaaccaacattaccttcaaccaatgcctcccacctctagcaggagttacccccaattaggcatggcaatccaattgaactaagagttggcaaaataatctctgccctcaagttacccctaaactaagccttagcttctacacctttcaatacatggctctcccttaccaacaatgcaagtccatcctttacctcccctttcttctccaatgccgtggcagctttgtccggcttctgcttccggtactgccaggcctctgctggatctgttgtgatcaccctcacctctgatccaccgccattgatctcaagcacctccggcagcccattaccacaccccctcgacaaaccaacatccaacctgacggcctgtggcccgcaaactgcattgattccctcactccgtatcgtgtggcccaatacatcctc

SEQ ID NO: 92894 - DNA, 539 bp, Triticum aestivum
  Clone ID: PAT_TA_92894
gtcaagagtatgcgtgcgttcgtttatcgatgcctattactcttgtggtccgtcaagccattctatcgcagaatgactaggagaaacaaactccagtacctcttccatatctaggattgggtcaaagcaattgtgctccgcagatcaaaatgccaacccagcttttggttctgttctaccttggagtattaccccctttatgtcagaattgtcatgagaactgcaccaactctcatgaattttgacgtagtgatacttctcaccatcaatactcattcctcggttccgtgtggttataaccggaatgtcgacaagtgaatcgtgatgtgtgaaatcaatatgcctagcaacctcgttgctgggtagttaaaggtcaataatttcattcttagcgtgttggttttgaatcatcattctaaggttgatcatgctacctaagtccattctcctgggtcactcctcgatcgatgagttaggattttttcaagtcctcactcaattgatcatgttgtcttgcctcaaaagtaaagaatggtctc

SEQ ID NO: 92895 - DNA, 551 bp, Triticum aestivum
  unsure (1)..(551): unsure at all n locations
  Clone ID: PAT_TA_92895
ctcgtgccgctcgtgccgaattcggcacgaggcgaaatggcagcaagacagccccaatttaaccaaactgtgttaattgacactgcaccccttccggctgacataccaccagtaaaagaagttggcagtagttctgcaccattactatcagcgagcttctttattggagctaggtgtaagccctataatgatgactttatgcaatgcaagacagagaatcctggaaaaggggagtttaattgtctcaaagaaggaagaaaggtctccagatgtgcaaggagcgttatcgaagacgtgaacaaacattgcctggatgagttcagaaagcactggtcttgtctagaaaataacaatcaacaactctggcactgccgaccagctgagtggaagctcaaccagtgtgtcttcgacagcttaaatctgcagaaggtaattccaaatactcctgaaggagagacaccgtacacctccgaaaaagacaagatatattcgcaaaattaatgctgccaatcagtccgcagaaaagtgtaccgtggnaacttatgttncan

SEQ ID NO: 92896 - DNA, 523 bp, Triticum aestivum
  unsure (1)..(523): unsure at all n locations
  Clone ID: PAT_TA_92896
ctcgtgccgaattcggcacgagccgctttcttcctcctccctccaactcccaagaggagcctcggggtttctagccgccgcccggccgcttcccgcaaggcgctcccgcgatttcttttccctttccgccgccgcctcctccacgcaaccgcttgctgctggcctctactcggtcctgcaagaaccaccggcaccgggttggattcattttccctgcctgcctgcctgcctttcttgtccagttcgccgggagcgaggaatcaatcttcatctgccgccgggagagctagctaggataatactcctacacaggaggaggtggaatttgcctgtgattattgcaaggatctcgcgccaagaagaggaagcagcagcagcagcaaggagcaagattcttcaacanaggagggaggcnggatcntggnggcatgggttcttgcgaggatctgnggtacggngacgtctatccgtccccaacccgggcggctgcccccngcctacgcgctcgacttctcctccacaa

SEQ ID NO: 92897 - DNA, 526 bp, Triticum aestivum
  unsure (1)..(526): unsure at all n locations
  Clone ID: PAT_TA_92897
tgactctcaaagaaaatgtagactatcagcccacttaactcttggcctttcccatcactttttaggagccccttctaccgccctaaaatattttctctcaattttagaagagtcaggcgatagtacagatacagtgtgtcttttagcacaagttttatgggctatgaacaatgaagagtctagaaatagtgccagaaattatttatttaacagcatcgagggcaaacccgatcatgtacagtcggttctattattaggtgtcattgctctcgtcgaaaatgataaagagagcctcgaagcagtcactgctagtctttatgaaattcgtaccacctctaatcttagtgctattgagaagtatcaagtagaagaagttttatgggggatggcatctgtatccaacagtcgccgtgaaaaagaagctatcatcgaggctcaaaaagacgtctttttatacccttaccaacccataggttggagccgtctatctgactttaaatatantaaaatatacagctacaatggg

SEQ ID NO: 92898 - DNA, 528 bp, Triticum aestivum
  unsure (1)..(528): unsure at all n locations
  Clone ID: PAT_TA_92898
ctcgtgccgaattcggcacgaggccgctgcatcgcagctccggtggcatcggcgtccgcttcatcgtagctccggcggctgctgcatcacaactccggcgcctacaaggccgctgctgccgtgctgggcatgcttggagcggacagtgggcgttgtacctgcggagaagtgcaatccacgggagaccaaacgaacggctacgatgttcacaatcagacggttgtcaaggcggctgataactgcgagttatcaagccggcttacgcctagcatcggccttcttccatttgcttctgtataagggcatgtccagcggggtgcaccggtagcaccacaagtgcgggtgcaccggatacattccccgcttgtaagaggcgctaggatcaaattcccaagccgttgtgccaagcatggatcaaattcccaagccgttgtgccgccagtgaaaataaaaaaatctgcagctgtggcagcattttggctgccttggctgtgttttgcaaaaaaaaaaaanaaaaaactcnanggg

SEQ ID NO: 92899 - DNA, 526 bp, Triticum aestivum
  Clone ID: PAT_TA_92899
cgtctacttatggagatgtgtggtttctgttgttccattgcatgacaacattgcttggtccttaggcacatttataatagctcttgtaatctggctcgtgaagtgcattgctgtactatgcagattcgtgttggcacccgtagctgtattgatcttcctcgctcacaagtactggaaaacaaggataacaatcgatgcagtagagaagttccttcgaatgcagcaaatgctgggtccaacaaggtatgcctacactgacatcaccgcaatcacaaaccatttcagagataagctgggtcagggaggctacggctccgtgttcaagggtgcgctatcaccaggcaatgtccatgtcgcggtcaagatgctagagggtaacaccaattgcaatgggagaagatttcatcagtgaagttgccaccattggcaggatccaccacgtcaatgttgtgcgtctcatggggttctgcccggaagaaatgagacaagcgctccgtctacgaagtacatgcctcgaggggggggc

SEQ ID NO: 92900 - DNA, 527 bp, Triticum aestivum
  unsure (1)..(527): unsure at all n locations
  Clone ID: PAT_TA_92900
cgctcactatggcgacgcaacggattccccacatccagcgacgcggccgctttgccgctatctttagccccctatcgaattcgagacaaatccgatattcgtataggttacgatcacagtgtcgcaggtgattggttgttagctaggtttaagtacccacacaatcctgatctttacggtaaagtgcaagattctatatcttcggcagcaagtacccaagtcaagtcggtaaacggaaagtttactatcgtgcttacagttacgcagataagaaattataacgcagattcatacacttccattgttagtactcgtgcattacgcattcaacctgaccaatatggtcgcgtatgttacgaagagtgcaaaatgactcgcaaacctttgagcagcattttgttactgagagcaatatggaatgaatacagaaagatggtcaagtatagagacacaatatatgtcgataccataccatttgtcgacgatagacaaatagattttatgtctaaagaagacgcaaggnaagt

SEQ ID NO: 92901 - DNA, 514 bp, Triticum aestivum
  unsure (1)..(514): unsure at all n locations
  Clone ID: PAT_TA_92901
cgaaagctctagaatagtggatcccccgggaatgcaggctcgtgccggttttttttttttcttttgntcttcttcttttcttcttcttctttgntcttcttcttcttcttcttcttcttcttcttcttcttcttcttcttcttcttcttcttttcttcttcttcttttcttcttcttctttgttcttcttcttcttcttcttcttcttcttcttcttcttcttcttcttcttcttcttcttcttcttcatcttcttcttcttcttcttcttcttcattcttcntcttcttcgtcttctgcttcntcagtcntcttcnctcgngccgaaatcggaacgaggggggggaccggtantcaattcganntanagagaggcgtaatagnngcgntcacaggancgtngcnttgacaacgtcnnagaatgggaaaancatgggtgtnacacaacttaagcnacttgaaagnanaacantgntttcgnacagcaggcggaaanagnaaacgaagaccgcaa

SEQ ID NO: 92902 - DNA, 357 bp, Triticum aestivum
  Clone ID: PAT_TA_92902
ggtatttagttcaatattgcgagttatctaaaaaatactacttgtttagattgggtggctcagactgggaaccatgtcaataccacgaagagtaacaggcctcgaaattcgtgtcagtttgcaatgaagacaattattgaatggaatgtagagaggcgtatttctttccaatacctaggcgtatggttactcttaccctggcaagcctcacattatctgccaaaggtgaggagttttattctttactttgttgaaacagttatattataaagcactctgatacgtagtaggattaagcgacaactctctcatatagttttcaagacttttgcatttaaaaaaaaaaaaaaaaaaaaa

SEQ ID NO: 92903 - DNA, 448 bp, Triticum aestivum
  unsure (1)..(448): unsure at all n locations
  Clone ID: PAT_TA_92903
ctcgtgccgaattcggcacgaggtttcattgtgtcccaagctgtaggcaaccgtttacttaggcggctttgtatccgttatagaaggaaggatgcacaggcacttgcatggagaatgcatcttgtaggatatgatatggatgtatatctccgtgagcctacaaaaactttgctatacagtcaatagaaatatctgtagtgttgtaggactacagagctacccccaggagggatgctgatgttttgtcctgtatcaattttgttaggtaaaacaacaaaatagggtgtgattcactgatttcttacctcttgcaatggatttgtaacccatcagttgagttgtaacttcaataatgcggcaaaaagttttatgtcaaaanaaaaaacaaaannaaaaaanaaaaaaaaaantcgagggggggcccggtacccaattcgccctaaagtga

SEQ ID NO: 92904 - DNA, 450 bp, Triticum aestivum
  unsure (1)..(450): unsure at all n locations
  Clone ID: PAT_TA_92904
gccgaacgacagaagctaggtgcgcggttgcctcctccaagagcaaattctccaattaaaacgtttcttcaatcacccgcacgaagaaatccttctatcttacccgcttcttcgccatttaaaggntcaattgtaaagcctagaacagcctctanaaacgtctccctacaaaaaaancttgngttgtcaanggnnaaagcaacctgntaataagaatagaaccgcagcaagctganacagtcttctaaacaaaagtncgccnaanagacttaagtccctggaaatcttccaagaataagnccngnttaagcaaaagnangngttcccgcatcaacaagctttncaaaccaataaannccgacaaaaangatggagggtcaanaaacaattnttttttncccaaacgnggggggnnanggtttcanatnccaacnaaagcctcnngggcca

SEQ ID NO: 92905 - DNA, 454 bp, Triticum aestivum
  unsure (1)..(454): unsure at all n locations
  Clone ID: PAT_TA_92905
ctggtgtcatcaagcctggtatggttgttacctttggtcccagtggtctgacaactgaggtcaagtctgttgagatgcaccacgagtctctcctggaggcgcttcctggtgacaacgtgggcttcaacgtcaagaatgttgccgtgaaggatctgaagcgtggttttgttgcatccaactccaaggatgaccctgccaaggaggcagccaacttcacctcccaggtcattatcatgaaccaccctggtcaagattggcaacggctacgccccaagtgctggactgccacacctcacacattgctgtcaagtttgctgagctggngaccaagattgacaggcgatctgggtaaggagatagaggccgcggcccaagttcctcaaagaacggtgatgcctggcataagtgaaagatgattccccaccaaagcccaatggggttgtgggagancctt

SEQ ID NO: 92906 - DNA, 454 bp, Triticum aestivum
  unsure (1)..(454): unsure at all n locations
  Clone ID: PAT_TA_92906
ctcgtgccgaattcggcacgagttcttgtgagagatgtctttaatcccgaacacggtatgtttacttatgacgaggactcaaggatgtgttactttaatccgcacagtttcgagacttccgatcaatttttccttgtgggtgtcattctaggactagctatatacaactcgactatacttgatgttgctctacccccttttgcttttcgaaagctactcgctgctagtccatcgcctgctcctgggagctgctacgcatactaaaccatcaatgacatattctctaagatgatctaagctcaagtatcgaccatctttagccaacgggnctgcgtcagctactcgagtacgatgggtgatgtagaaagtacatttttaagangattttggttgccgattttaatcgttacgggacaagttaggtacaagttccgctatgtncctgaagggcgna

SEQ ID NO: 92907 - DNA, 439 bp, Triticum aestivum
  unsure (1)..(439): unsure at all n locations
  Clone ID: PAT_TA_92907
ctcgtgccgaattcggcacgagcggcacgagacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggncgccggggccaccctcctcgtctccgccaccgccacccacaaggcgagctccggcgggatggagatggcggccgagaacggcggctgcggntgcacccaattgcaagtgcggnaccaagctgcggntgctcctgctngcagctgnctanatccnatcatcgattaatgcatgcaccntggccgtngngnggaatcanccgatngntntccganttttnctaactaccnaaaacaaanttttaacccgccaaaccc

SEQ ID NO: 92908 - DNA, 457 bp, Triticum aestivum
  unsure (1)..(457): unsure at all n locations
  Clone ID: PAT_TA_92908
ctcgtgccgaattcggcacgagggccccgcctgtgggcctgtcccgtcgcgcgtgtgggctgacaggacggcctagccgcgtgccctcgcgtgacaggcctagaacaggcgacagcctggaggcttagctagcacgccacttaatccctccgcgacgttcgaaatactgagcgagtcggaattgagtgagtccgagttgaggaagtccgactccttctagtcggcccggcagaagtcaatcaaagaccatgtgttgagcacccggaaagagaaactgctgaggcttctcaagccgatcatccgcggggcctcaccaagcttccgggggactactgtcggagtaatgggccacaaggtagggcaacccggagtnccagaacctttcaagacnatcggggggnanggctgcgnccctcaaggaccccantgncaaangaggccgccctccttgaaggag

SEQ ID NO: 92909 - DNA, 393 bp, Triticum aestivum
  unsure (1)..(393): unsure at all n locations
  Clone ID: PAT_TA_92909
tggnaggaactaatgctcaagacgtaagagcacttgtgttgggcatgcaaagcaagattgcttctggntatgctaggcaagggaatagagtctgcgctgataaatccatcaaccctgctacctgaaccctggcaagcttctagtgaattgttgtctaacattgagcctgacaaaatgacggttgacccagctctacttccaagcatccagggttatgttgacgctgttctaaatttagcatcacntttcatcacacgcntgcggggttatgcaagcttctgccggnctttggnctaggcatgctgtaggagcatcttctagggtcaggcnngtcaagggaatatgggtacccaatccaaccaaanaattctccctnngccggtcanataatca

SEQ ID NO: 92910 - DNA, 383 bp, Triticum aestivum
  unsure (1)..(383): unsure at all n locations
  Clone ID: PAT_TA_92910
ctcaactgacccctaccaaacaaaaaaacaagctttctaattaggccttcaacataccaaagttgaatgaggtctagtctagtcaaaaattgagcccaaatatggcatccaagtacagtgagccccgctcccgtgcgtcgcgaagccttttgtcacgacacatcaaccaaagataaacgactctaaacaccaaaacatacatctctcctgcctcccctccatccaccgcttccagtcctacagcaagactccaccaacttaccaatcgttgtctattcctctactcttctcgcccccttcnccggtcactctttcgctcgccctccggtactgatcattcaacaattgntcgnccgncacttgcttctgacctggatcaagaa

SEQ ID NO: 92911 - DNA, 470 bp, Triticum aestivum
  unsure (1)..(470): unsure at all n locations
  Clone ID: PAT_TA_92911
ctcgtgccgaattcggcacgagctcgtgccgaattcggcacgagtatatttacaccacttcaactttcttaatccaataaactctttgctctgctagtttctaacggcgtanaatgagttgcctganggtatccaaaagctttatccatcattctggaaaagtaattccctataatactttcagtataaaaactatgctcggcattgtgagccgcaacantattatgaagctagttcatgtgcaacaacaacccaccaagtacgaagtggtcttaactctgctgctacnatcangaaantacnangttgcntgnagttgcttataaaaaaacnaaaggtttgcaaangatgctgccactgggaattaanggcgataggtattttccaggactcctccgtaaanataanggtgcaattgccttttcttgggacgtggtataaatttcaagctnaccccaancaaaggaagg

SEQ ID NO: 92912 - DNA, 471 bp, Triticum aestivum
  unsure (1)..(471): unsure at all n locations
  Clone ID: PAT_TA_92912
cttccccccgctcgcgccgccgctcacacccctccctcctcctcctctccttcgcggggccacccggacgctcgagcccccgacagccatggcggcagcggctggagaggccccgcgggcgctgtcccagaaggagcaggacatacaaatgatgctcgccgccgacgtccanctngggancaagaaatgcgacttccanatggagcgctacgcctanaancgccgctccgacggnatctacatcatcaatctggggnaagacgtgggagaagctccanctcgcggcgagggtatcgtcgccatcnagaaacccccaaggaaaatnatcggttccagtccgccccggcccctaacnggnaaggggggncgttcctccaaagtttcgnggnaaanaaaaaccngggggcccaannggccattccnccggggngggganaaaccccctngggnncctttaaacnaaaacaaaat

SEQ ID NO: 92913 - DNA, 433 bp, Triticum aestivum
  Clone ID: PAT_TA_92913
cagatcagaagcaacatgcttaacgggagtattcccgagtctttcagcaaactgaaggtcatacagcagatagatctgtccgagaacaatttaactggtcaagttccacagtattttgtgaacttcagcagcttaaattatattaatatatcatacaataaatttgaagggccaatcccgactggtggcatatttcgaaattcagctgcagtattcctgcaaggcaacacaggcttatgtgaaacagctgctgccatatttggattgcccatttgcccaacctcctcagcaacaagaaggaagatcaacgcacgcctgctgctgataatagctccaccaattactattgccgtggatctcattattatgtgttgttgtcactattacgaagggaactaaagctcaaccatctgaaagcttcaagggagacaag

SEQ ID NO: 92914 - DNA, 472 bp, Triticum aestivum
  unsure (1)..(472): unsure at all n locations
  Clone ID: PAT_TA_92914
attgcgccgagcacacgggcaagcggggacagccggcancggntcttccacacagaggagaggagatggcggncgcgtccttcaccgccgccaagttcctggcgccggcggcggccagatccggcgggtgaccgggcgcggnccttccccgcgccgtccgcgtcctccatgcgcccgctccgccacaggcccgcgcgccgcctgggctccgtcctgggcgtctcctccgacgtgctcaagggcgcggccccgcccgncgccgcgtacctcggcggngaaccnggggnaanaangggttgngngctgtangaangacattgatccctcgggccggggagcttccgnngggagatgtgncgcngcaaaantgtacgtacccntgggccaaaantgatttgngngttccgnccnatcttttacanacngggccaangnagggaccgttcttccaccacgggntttcantcaaaag

SEQ ID NO: 92915 - DNA, 452 bp, Triticum aestivum
  unsure (1)..(452): unsure at all n locations
  Clone ID: PAT_TA_92915
ctcgtgccgaattcggcacgagctcgtgccgaattcggcacgagcacctatcgagacaaaactcgtattcattttgttcgaaatccactcagtggggtatccttatattttccaggggtcaagggttctacagggtactaccacccttagaatgcacaaatctttcatagaccatatttctcatatcctcagaatggccaaaattcttcttcatagagtaacaactcataaaatccatatcagcaccaacaatgctaactttattcattctcaaggtgattacaatcctctcgcttttccattacatgtctcaactcaacacctcaaatataanaagaaaatgttctcacttctactactccatttcctttgttgcaagnctcaactatttatcnacaaggtctccttatcccttggagcattcnctggnaaagtggcctggctccaattag

SEQ ID NO: 92916 - DNA, 378 bp, Triticum aestivum
  unsure (1)..(378): unsure at all n locations
  Clone ID: PAT_TA_92916
attgggctcgcatacctgtaaggtatgttttccangagggattcgtcaatcacgtaattctcacggnattttgggacttcgaccatcgnccaagatacgaccagcttcttgcangagagtggcgcaagtctctgtccgataaacaantttcgagtaaggccccagaaaaactcatccaagccctccggaggaattcgggaatttcttcgcgaagggtatcaanatcagatatttccgggccatacagccgtcaggaatcaaaacacagtcccttcaaaatccattnaaaattcatcccntggtcggagnttcctgaangcccgttgtcccggtttggattaataaggggagaacctggaaaatggcnaattaccgaat

SEQ ID NO: 92917 - DNA, 538 bp, Triticum aestivum
  unsure (1)..(538): unsure at all n locations
  Clone ID: PAT_TA_92917
ctggtgcccgaatcggcacgagatttaaacttgcctaaatagttaagtttccatatgcttcacctcttgccatgtttagcaacatttaatattgtttgggtagcctaaccgagagcgaactaaataaatgttgtgaagtttcntcaatatgcaactcggttgcatattgaggctccacttaaattgtnntgttgttgttgttgcaattttgccatgccaatgccatgctaatttaaaccgggacatgcatcatacttgtttgtgcntcatgccantgtttaaggcttggtggcatttaccaacgggttggtttggtttcctttcccggggggtttgccttccttaaanntcccggggnaaaatgntttgcgnanttggttgaagggaatttcggttccaannctggcntccccnggtttngcgtccttnctttcanangngggcgntccnaagtccctttccttccccttggnnaagggganttttnaangggcaaaggantggaacccggccttaaccccctgnggatttctncaan

SEQ ID NO: 92918 - DNA, 246 bp, Triticum aestivum
  unsure (1)..(246): unsure at all n locations
  Clone ID: PAT_TA_92918
gctagctcaagctgccctacaccgcacgcggattangtagccatggnggntcatgactcggaccacggggggaccgtccangtcctcctgctcccgtacccgaagcaggggcacatnaanccgttcctccagttcgggaagcgnctcgcctcccangccggggtccgctgcaagctcgcccgttnangcgctanctcctcnggcaaagggcgggaaccngtgccgggggggcgtccaactcgccgg

SEQ ID NO: 92919 - DNA, 275 bp, Triticum aestivum
  unsure (1)..(275): unsure at all n locations
  Clone ID: PAT_TA_92919
gaagacatcaaaatttgttnaaaccttataaganagtcacgagtgtctgcnttgatcatcantgtgctccaaanttatctgtnacncatgatnctgttgcttccncaacatcatacattgcntgancancgctggtttacggantctgaagtanctgtttggaaagcacgacctttcacctctcagtattttttgtcantctcaanagctgaacggagctttcnangttggcgtantttanccacaataangtntacncgtctggctgttccctc

SEQ ID NO: 92920 - DNA, 447 bp, Triticum aestivum
  unsure (1)..(447): unsure at all n locations
  Clone ID: PAT_TA_92920
gatttttcagtattcaaatcccttccacatatccaagagtaatgtagataaaggcgaaggcaatgatggagctgaggatgccgataaccaggaccaacagccttccgaaatccccaatgacgacgatgatgatgacgacgatgaagaccttgacggtgaagataaacctgagcttcaaaatgataaagttcagggtgaagtaaaagctgatattaaagacaacgttcaagctgagccgattaagaagccagttgagaatatccaagcagaacagattattaagccggctgagatcgatgataatgaaatcgacggcaaatttgatgagcaaggctgagaaaattgaagggcagtctgagaaacttgaagggcaagtctgagaaacttgaangagcaagctgagaaactcnaanagcaacctgagaaacttgaagggcaatctggagg

SEQ ID NO: 92921 - DNA, 450 bp, Triticum aestivum
  unsure (1)..(450): unsure at all n locations
  Clone ID: PAT_TA_92921
ctcgtgccgaattcggcacgagctcgtgccgaattcggcacgagcgccgacgaggcgcaccaccgcgacgtcaaccacttcgccgcggacatccatttccaggggctggagctcaacaagacgcctgccccgctaggatatcactgacggatgaatgcccaagaccgcctagctctgcccttgtcagtgaagaacaaaagttgttgctaatatatatatgtgtgtcggataggtaagatagtgatgcttgtgtgaganatanaacggccgtttgtcacgagagctccaangatttctcgaggaaccaatgtacncgtcccaactcttacaagcttacagcancgagtagctagctagctattcgattagctagcgatgaacggtgggggcactaggcttgtantggnaaattgcttcgggtaacaaaggatgtcctgtatgtgctgggca

SEQ ID NO: 92922 - DNA, 209 bp, Triticum aestivum
  unsure (1)..(209): unsure at all n locations
  Clone ID: PAT_TA_92922
ggctgatcagctcttcaaanttcggtctctagacgtgtaaagcatgcctgcgcaaatggnngtgganaccgttttatagaagataatccatgccgaggaaantagttaaaatanaatctcaatgtgatcaaaatataaatgctcactctctgaatcagtcgggttgggcatatagacttgctagattnacactntnaatcaatnacana

SEQ ID NO: 92923 - DNA, 437 bp, Triticum aestivum
  unsure (1)..(437): unsure at all n locations
  Clone ID: PAT_TA_92923
aagattttgtcgctgtgattagaagcattcttattcattaatctgctactggtactctacgatatgggaaatacaaagaaactaccgtaagacaacatcaacgtcgtataaaatcaaaagccgcggaataaatcaatcaatactatccgttcgttcgacttgtagcatttgctacatgaaatagttcatccgttacaacctcaaatgccaattttattatgcacctcgagctccagtagtatgcgagatattcgatgtgtcttagcaaagctccctgggtgttcagacaacaatcctctgcagtcattgctatcaattaaagaccgttccaatatctcataaaattccttggtgcattattacgctaagaactaagaaagtgactcctcgaaatggagagatagagtntaaaaaccgcngaagatnattaaagggat

SEQ ID NO: 92924 - DNA, 424 bp, Triticum aestivum
  unsure (1)..(424): unsure at all n locations
  Clone ID: PAT_TA_92924
ttttttttttttttttttttttgacacagcaaaagcacggntgncacatcaaggncaaagcattcactgggnccaaagagcaccagtcgatcattccaacatggggctggnactcgagacaaggnaaagtacaaccgttgntgagtaagtttaagccaagaccccgtccttctccttgggactgtanccatacagattaaacggagggnttggggggtgattaaagggtaatcctacgacacnaataatactggtccaagtgcnataagaggagaaaaagncactaanttaaggccangttttataggnacaatccacacacacccaggtccaaaanagcccttcactccaaagtcctanncccctttttgctntccaanaccncngggaaggntacccgggtatggttcnaaaccanccccca

SEQ ID NO: 92925 - DNA, 315 bp, Triticum aestivum
  unsure (1)..(315): unsure at all n locations
  Clone ID: PAT_TA_92925
ctcgtgccgaattcggnacgagcattcccgtccaagaaaaaaaaaacttatactgcagccgcctcctccccggccncttccccgcagctgccgccgcgctatccgcgnggacctcctctacccgtctccccgcccggtgctgctcactgatttcggngatccgcattgcgggtagggttgggttggagtngccggncgnatccgcggcaccgangntccgtcganacnggttcttgggggntcggcgcccgcgagcgctngggaccggcgccgngngacctgcntgncccnggacttccntgcccggcggcctga

SEQ ID NO: 92926 - DNA, 439 bp, Triticum aestivum
  unsure (1)..(439): unsure at all n locations
  Clone ID: PAT_TA_92926
ctcgtgccgaattcggcacgagcaaatgttctacctagctggtaaacactaacagccagaagagactgaaaaatggtgtcacgttttttaggtttacgagtcctctttttcgcctaagctcctgacacggccgattatatcaaaatgggatcatgaaatttcgtaaagtagagcttcaatctacttattgatacacggatggcgtgggcgcaagaagttaatcagtgtaacggctacaaagccagtattttcctgtagccagtactggcaaggacaggcatacaactaccgggggttgggcaggtgcaaaagccctgcagatgatacaagagcctctgaagaaggatcttgaaaaattcttacatgagtaaagactgagactgaacctcnaagaagctgctagaaataatatcctttgggtggcaactggagtcgttta

SEQ ID NO: 92927 - DNA, 167 bp, Triticum aestivum
  unsure (1)..(167): unsure at all n locations
  Clone ID: PAT_TA_92927
ctcgtgccgctcnatttctctantatctctctccctctcgngctcttaccagnngtgtactaccaangtagcancgatctgattatattatangggtagggccgntccgtcgcctcctccncnccagggaagagggataaggcacaacggcgaaacaacatcgagaa

SEQ ID NO: 92928 - DNA, 425 bp, Triticum aestivum
  unsure (1)..(425): unsure at all n locations
  Clone ID: PAT_TA_92928
aaattaaaagctgacggcagataataatctatccccactaagctcatggaatgcaatagtagacttatgtgagcctgctcatatctaagtcgggtccaacacttattgccagaaccttaaagagaaaataggacgagtttcatcgctaaatgggccaatctcaatcataattaccttcaaataatctcaaactcaaaattcggcatgattatcgtcctcactattatttcgcttctattccaaaatatagtcgccttcagtgctaccgctgacactgaaaaatgcaaaagtcttcacatcaaaccatcgatggaaaggttaggtttgtcaacggcagtacacttgaaacatcacgctcaaaagcttgtcgaaaaatccgtaatatggatctcagggatcacacaagaacaaaaaccacttgtntt

SEQ ID NO: 92929 - DNA, 427 bp, Triticum aestivum
  unsure (1)..(427): unsure at all n locations
  Clone ID: PAT_TA_92929
gtaaaaaccgtaccaaagacaccaggcacccatatatacatgatagattgactccatatgtctcatgcacacatctctccctctctttccttccctctctctctctcactctcccaagacaataatgccaaacgcgggatctgagcgggcagcttcactctcactgaaaaagcaagacaccgccaccttctccggtaagctaccgtcgaccaaacaacgtttttcgtcggtatcaagctgcttgtccttcctttagaatctactactacgacggggccgccggtgccgtccctttcgaatgggaatctcatccaggcacacccaannacccctcctctgagctacctactctgccacctctcactcctccgccgtctcatttctctttctccgggggaccaaatccgccgccgttcccaaaaagtcg

SEQ ID NO: 92930 - DNA, 370 bp, Triticum aestivum
  unsure (1)..(370): unsure at all n locations
  Clone ID: PAT_TA_92930
ttgaaagaagaaatggacgccaagcgtgcaaagaccaaagctgctcgggagaggaaacaagaaagagcattacttaagcaacggcaattgtatggcgaagaggagccagcagagactaagtaaatgaatggtcagcaatgtttcacgatttggagtcctgggcagggcctacttagagtgggaaatctgttagagtatacttttaagaaactatcactctggtatcaagaaaaaaaaaaaaaaaaaaaaanaaaaaaanaaaaaaaaaaaaaaaaaaccncgagactagttcnctcncgtgccgaattcggnacgaggggggggcccggtccccaattcnccctatagnggngtcngtattacgcgcgcn

SEQ ID NO: 92931 - DNA, 436 bp, Triticum aestivum
  unsure (1)..(436): unsure at all n locations
  Clone ID: PAT_TA_92931
ctcgtgccgaattcggcacgagtacaccaccacagccccactcgtagagagcacgcgcaccggacacgcacgaagtctcctcgaccancgagcaatggngaccaccgcgatggggctctccccctcgtccttcgccgggaaggcggtgaaggacctgccgtcgtcggcgctcttcggggaggngcgcgtcaccatgcgcaagaccgcggncaaggncaagccggtgtcgtccggcagcccgtggtanggntccgaccgcgtgntctacctcggnccgctctccggngaccccccgagctacctcaccggtgagttccccggcgactacgggtgggacaccgcggggctgtcggncgaccccgagaccttctccaaaaaacgggagctgggggtgatccactgccggtgggccatgctgggcgctctcggctgcgtc

SEQ ID NO: 92932 - DNA, 475 bp, Triticum aestivum
  unsure (1)..(475): unsure at all n locations
  Clone ID: PAT_TA_92932
ctcgtgccgaattcggcacgagctcgtgncgaattcggcacgaggctatttataaatcacaggccgaaaccggtgaaatcaangggcattacttgaatgcnactgcgggtacatgtgaagaaatgattaagagagctgtntttgcaagagaattangggntcctactgtaatgcatgactacntaactgggggattcaccccaaatacnactttggctcaatattgcccgcgacaatggnctacttcttcacantcacccgtgcaatgcatgcangttattgntagacaagaaaaatcatgggatgcanttccgngtnttanctaaaacactgccntatgtcnggggggnggntcaataaccaacctccnnctacaantaagtaaggtaaggnttatanagggggaancgcccacatgaccttaangnttttgttggatttaattgccnccacgaattttntttganaaaanatc

SEQ ID NO: 92933 - DNA, 441 bp, Triticum aestivum
  unsure (1)..(441): unsure at all n locations
  Clone ID: PAT_TA_92933
ctcgtgccgaattcggcacgagagttactcgtacactttgatgtcgttatttttgaatttaatttgatcgacaccgcatacaaaaagatcattatcgatattacaaataagatgggtaatggaatggccgattatgctttaaacgctgaacataacatcaatggaataaatactatcgaagactatgaaaattactgtcattatgtcgcaggattggtcggtgacgggttaacaangctctttgtanaaagtggctttgcgaacccagcgttactgcagtgcccaaaacttgcgggnatctatggggcaattcctgcagaagacaaatataatccgtgntatacgagaagacnttgatgacaaaanacngntttggncctaaagggaaatcnggtccaatcatgtagaaaaatttgatggacttattccagccccnccaac

SEQ ID NO: 92934 - DNA, 441 bp, Triticum aestivum
  unsure (1)..(441): unsure at all n locations
  Clone ID: PAT_TA_92934
aaaagcatttgaaaaaaaaggagaaaaaggtaaaaaaaaagaaaaaaaaacaaagaaagaggacagaagaaaagaacaagaacgataatgtaaacacaacagttcatggtggctgcttggttatcgtggctatatttgttcnagaatgtccccngtttgagtcacgctcactttttttgcgatttaaaatcagaaaaaaatattggcaagacccaaaatacttgtagttgaggtatgatttaatatattaccatcatgccctttcttacgaagagggggtctaccgaagcagaagtgtaacaaaaaatgtctttaaagaaaaggggctggcttaggttaattttaaaaaaaaatggncctacnaagcgaaaagaaagaattaaatggtcaagcattcaccaaaaatttgantagaagaatatttccacctaaatatggatn

SEQ ID NO: 92935 - DNA, 279 bp, Triticum aestivum
  unsure (1)..(279): unsure at all n locations
  Clone ID: PAT_TA_92935
ggaaaaatggcgcgaactctggtgttcctgctcgtgctactgtgctccaacgcaagcctagtcacaantagtgccaagcgcagggctccgcatgaagctcacccacgtcgacgacaanggcggttacaccaaccgaggagcgcgtgcgccgcgctgtcgccgtaagccgggaangcctggcctccatgcangcaacaacntggggtagtcggcgacgtgagcgcgccaagtccacctggncacccggcagtacatcnccgagtanctcatcngggaacc

SEQ ID NO: 92936 - DNA, 379 bp, Triticum aestivum
  unsure (1)..(379): unsure at all n locations
  Clone ID: PAT_TA_92936
ctatttacaccatnntcactctaaccaactatcncctatccttntacttaanacntcgggntctctccggggggggttatnatntgcccgcgccnnngggggggggggngacgctctacaacnantnaattccccnggnatgcaggctcatacncaattcgngcangangttgcgctgcctccctatcaatctatctatccacatctaactattcattcttctcctccctaacacaacanaanactaaaaaacatnanantattccctantcaaatactcaatactctacttgtgggnngctcaaaaagtnccncaggtcnctcaccgcatgnnatccccaagcgggacaaatatcatccctctttctgncccngcttt

SEQ ID NO: 92937 - DNA, 445 bp, Triticum aestivum
  unsure (1)..(445): unsure at all n locations
  Clone ID: PAT_TA_92937
aaaattgaaaagcacaacattttttgaagttatgaacatattttgaaaggngaacattttttaaaaattaagaatattttttgaaataggaacattttttgaatttatgaacattttttgaaaggtgaacattttttgaaagttaagaacattttttcaaataggaacattttttgaatttatgaacattttttgaaaggcgaacatgttgtaaaaatcactaagttttttgaacttctgaacaacatanaaaaacaggnacaaattttaatttcagaangttttttgaaattttgaacaaaatttgggattctgaaaaataaaaataganagaaaangggtagattaagaattacaaaagaaatanagaaaaggggaaaaaagataaatacaaaaantcaactaggtcaaccaaaatttggaatcaaagaacaattttaaaatt

SEQ ID NO: 92938 - DNA, 440 bp, Triticum aestivum
  unsure (1)..(440): unsure at all n locations
  Clone ID: PAT_TA_92938
ctcgtgccgaattcggcacgagcacaaacacacatctggattggctccttggcctgcaatagagcagtgacctcttagcacctgccaccagcggcgccagcgacggcgagagggcggctgcagttggaccgccggagagcgagctgccaccatcatgcaaggggaccaggccgggaagaaggggaangtgaanaaggggtggctggcggtgcgggtcccgccaggcccaggcggagcancagggcgacggnttccggcggttcgtcatccccatcgcctacctctaccatccgctcttccaacggctgntggaggcggncccgggacacgtncggntanaactcgggccggncccgctctggctgccctgctccgttcnanganttttctccggccctcccgcgcgctcggtcnanccggggggagaanggngcaactcn

SEQ ID NO: 92939 - DNA, 423 bp, Triticum aestivum
  unsure (1)..(423): unsure at all n locations
  Clone ID: PAT_TA_92939
ctcaaattgtaagaatagaggcaggtccatctctaagcactagagaaatgtctcgagccaccaagagatgcattaatcagtatccggaagatgatcccacctctccttccgaaattctacaaaggacaaatgggtagtgtcgcagtcataggtggaagccaagactatacgggagcaccatatttttctgctatggcttgcgcaaaaacgggtgcagatctggtccacgtaatctgcgaacctcaagcagcacaagtgattaagacttattcgcccaatctcatgattcacccattaatgcggcagtctgatcgtgcaagtactgaggactcagcgcaatctattgcttcaaaaattattgaattactgccacgcttgcatgtattggtgataggccctggactaggcaagagataagctgna

SEQ ID NO: 92940 - DNA, 412 bp, Triticum aestivum
  unsure (1)..(412): unsure at all n locations
  Clone ID: PAT_TA_92940
ctcgtgccgaattcggcacgagagcagatncagccgacaacccccgcaagcaaacaatggncgctccctcccccgccgtcgccgccgtcancagtagcgcgccctcgtccgggctcctgccgccgcggcgcgcggnancgtgcanagccgtcccgctgccgtcgatgangagcacngngccnggggtcangatngcgacngtggcccgcncggtgggcnaantngtcgcngaggggnaaaannttcctcatcnccggggccgtgggccgtcgcgctcgtcgggancgcctttcccaancttcttntcccggcaaggganacatngccccnaagctgtgangtgtgccccngggttcnctgcnncaaantccggnatcagagncttgcggnnccaaaaanccggctntggaaa

SEQ ID NO: 92941 - DNA, 435 bp, Triticum aestivum
  unsure (1)..(435): unsure at all n locations
  Clone ID: PAT_TA_92941
ctcgtgccgaattcggcaccaggtcaattaactactacactgcgcattcttgatctaagaaggtgtcgctacagatatatcgcagtctgatatgaagctttgataaattacgatcctttcaaaccattttcaaaagcttgggcctggtcagagcatctaacgatatcctattaacagcatccgttggattatttccaagcgtcgatgtaacagctccgaggaccatggaaaattacatcaaagaaaccttctctacaactctacattaccaccattcctcgctcgccttcaagccgaaaagctcttccaacggattctcaacggacatggtagggatataccgaggtaagaaaaagtacaaaatggcgggatgaagatagattgaaaaatggaggccaagntttaactttggatggaaagaaaacaaaaagtgcc

SEQ ID NO: 92942 - DNA, 433 bp, Triticum aestivum
  unsure (1)..(433): unsure at all n locations
  Clone ID: PAT_TA_92942
ctcgtgccgaattcggcacgaggaacgtttccgaatgtaaaaattgatggcccagcaggcactcaaatgattgcaaatcctctgtacagctataaatttcatccgctagacacgtcagaatttcaaggtgacccgtttgataagtatcccgccacaatacgttatccaactggagaaactgcttctgcaagctcccagaacaacatctttgaacaaaggttcgatagcagcaaagacaatattagaagtagactttacgcgcttttgacaaactaccatgattacttgggattcaagcaatgatgggataccgaaaagatgcgcctcccaacgaacaaagattctcttgaagctatacacaacctaagtacataccttgttgggngggcacaacggacacatgtcataccttgactacgctggggtttgatca

SEQ ID NO: 92943 - DNA, 433 bp, Triticum aestivum
  unsure (1)..(433): unsure at all n locations
  Clone ID: PAT_TA_92943
cgaaaaatgaagtgaccacatgtgaaaaaaatactatcacaagtagaagtggaaggtaaaacttgtgagaatattcataaaataatagtcaataaagatcacgatccaaaggggatatttgcaaacatgacagtcattaagatcgaaatccacagaggataacatatctaccatattttagcatgcagttcataaaaatggtacgcctggaccacatcctaattgataaattggatgtcatcagctatgaaaaggtcagcgaaggcaaagtcaatattcagtaggtttgcaaaacatggcaggaatctggagcctgctagccaaacaacatatgcctacgaactaacaatagccgatttcaagataagactatctttccaccctttatgttgnacnacacgggggcagagtaacccaagtggggcaaagctgn

SEQ ID NO: 92944 - DNA, 529 bp, Triticum aestivum
  unsure (1)..(529): unsure at all n locations
  Clone ID: PAT_TA_92944
ctggtgccgaattcggcacgaggacaaagttgtatcaagaagactggattggtctgaaggccctgggacgaggccgggcgagtcaaagttcgtgtcggtgccaaggaggccacctggggcatctccaacaagtgacatggaagggaaaacacattgtgccttacttgaaaagggacaaaaccaatctgtttccgcttcactccgccggccacctgggcacgccggtccggggggggaaaagcgctccgngggctggatggggggggaaaacggaatgtccggttggtccctccttcaagtccctcggacaattgaaaagaaccccaaccaatccttcttggccaaagggggaacaataaaatggtttggggatttggggtggtgggtggttataataatcaatttcttttggttccaaagnctttttccctttggtgggnaaattaatccgccttttggttaggaaaagaccaacaaggcaaactggttaaaaaaaaccaaaanaaacccaacaanggtttacnattng

SEQ ID NO: 92945 - DNA, 535 bp, Triticum aestivum
  unsure (1)..(535): unsure at all n locations
  Clone ID: PAT_TA_92945
tcgccatgtggtgcattccaagcctcgacatcatttctctcactgcatgaacgtgacaagaggggcatcacagaacacaaggatggggcaaacaagagaagactgtcactggaataaaatgctgttttcaccactaagcctgcaccgcgggtgctggataatgctgggtctgcatcaccggaagagggaagatcgctctccggcccggaccctctccaatttctccacaattcaaacatggatcttccggaagggtcaataaaagcgccggtataaggggaaaccgttaggggaacttggtccaatccggggttacaagctggccgccggaagggccttggcccggcaacccggggaaggaaagcaaaaaggcggttcttggcccaagggaacaattgccccggttacaagccttcctcccgggggtggggtggggaggcggaaccaaaggggggaaaggggtggggttccttggtccctngggttggaatggcctcctggccgggggaggggctccaaaaattgccttcccaac

SEQ ID NO: 92946 - DNA, 310 bp, Triticum aestivum
  unsure (1)..(310): unsure at all n locations
  Clone ID: PAT_TA_92946
ctcgtgccgaattcggcacgagctcgtgccgaattcggcacgagcgatggccgcggagaactactggaggtacgccgacgcgcggtagcancaggccatggtggcggcagcggcggtcgcggcggggatggccccggcagctaccattgcgcaggcagcgacngccgcggggggcatgcancannaccagcaccancaccatgcaaggcgggcgantgngcgcaaacancatccaatcagncatgtcaagggcgggccgncgcccggtcttcnttaagtcgncggcgtcggcnccaagaacttacngggt

SEQ ID NO: 92947 - DNA, 416 bp, Triticum aestivum
  Clone ID: PAT_TA_92947
ctcgtgccgaattcggcacgaggtgccgttgagtctcaaatatgtcttcgtctatcctaaagcagatatttagagcctcgcgatgttctcgcttcacacatcataggcctttggaccgcacaccacgaacaataaactcatacagacctcttataccaagatgcttggctgctacatactgcccatcacaccacagcacggcactatccgtgttgaaatcatcggtcgaaacatcctccgaagatttccagcaaaatgaaaggcaaatgtgcgaagctataatgaatattgaaaatttaatcactaaaatacagattggtggctcactcaaggccaagagaaaaacatttagcgaggaataagttgcttccacgaagatagaagtaagcttcattgattgatgttggtacatcctt

SEQ ID NO: 92948 - DNA, 422 bp, Triticum aestivum
  unsure (1)..(422): unsure at all n locations
  Clone ID: PAT_TA_92948
ctcgtgccgaattcggcacgaggcgccgtgaccgccggcgtcgacgacgagcccagccctccctctactcctccctgtttcctagatcgaccgtgtacgccgctgccatggaccagcgtcgtggacgccgccgccatggacgagcgccaaggacgccgccgccttgccgtcgcggccacgctaccacatcaggttcgaaagaaaaattgttggccgccttgaactgcctctcctttccgagcacaaacacggccaccacccgcgcccagtcgtccgccttgagcgaggccggcttgtccctcacctcgaggatggtcttgcggtccgggagggagacggggcgggatccggcggaggcgggcggcctggaggaactcggtgtgcttgaggtcgttgtgctgggcgaggaagacggcggcggn

SEQ ID NO: 92949 - DNA, 427 bp, Triticum aestivum
  Clone ID: PAT_TA_92949
ttgactttctttcatccatcatcacaacttttcaaccccttgccatggcactaatggcagatttacaatcaggcaatcagctatgctgctctatacaaatggcactatatatcaatatatgtatgtacccgatacaagagaacaatggcaagtgttttcgcagtattatgtgcaaccaaaccctgaatgctcagggcacattatgggcgagctccgacgcctacaactccggtttgcttcatccagagggaccacttgactgcctccaggaaattctcattcctctgtagagctgctatgaggttagtatacgttactcggtcagcattgataccttttgatcctcatctcctgcatcaagcttgacaagcatcttcggggcattccccgctatcccgtaagcctttatcaatggtgttgtaactgg

SEQ ID NO: 92950 - DNA, 422 bp, Triticum aestivum
  Clone ID: PAT_TA_92950
ctcgtgccgaattcggcacgaggagaattgtctagccggcaatggatttccagcaagggcggcagagaaaaatccatgacgagatgaacaccaccacgacagcatcatggatgtgatcgaggtacctctgtttccacagtcctaccaggtggttccaggttcagattgtttatagagtaatcatacgccgatagtgtgtgcgcagtctgtacaaaatggataggcgtagtttttattaaccaacttgttgcatattattggttctagctgaaatatctttttccttgcatcttacaccaagagagattcagggaagaagtgaggtgcataagtataacaacaaggcaggcaagataacagggtgcaggcttcaacattcaagtcgttgtggccagcatgcactcttatttcataaatctacc

SEQ ID NO: 92951 - DNA, 411 bp, Triticum aestivum
  Clone ID: PAT_TA_92951
gttttttttttttttttttttgcacgaacaaatcaatggaataatggcagagttcatccaaaaactactagcagtctcctacgggctgtacattgcttgcatgaacacaaaacagtaatcaaaccatcctcggctacattaggcaggcaggcaagcggggagttcaatcaacagcaaaagcatcgatcacgtacgaaccggccgattgagatcgtgtgtgtcatggacggactcatgggtcgaggtggatgggcagcaccgtgctccgcgagctccgcccgagcccgaacgacgacataagccgccggaaccgcccgctcgtctcgccgacgccggcttgggtggcggccgcactgctgctgctgccggccacgtcggcatggctcggcagctcggcctccttcccgcggg

SEQ ID NO: 92952 - DNA, 406 bp, Triticum aestivum
  unsure (1)..(406): unsure at all n locations
  Clone ID: PAT_TA_92952
ctcgtgccgaattcggcacgaggctttccggcgggcacgccgaaaacgcatttttccggattgagcttgatgtcgtatgttcggagattgtcgaacgtgagcctcaagtcgtctattaaggattcgacgtgtctggttttaacgaccacattgtctacgtatgcctccactgttttgccgatctgtttttccaggcatgtctgaatcatgcgttgatatgttgcaccggcgttcttaagcccgaaaggcatggtgttaaaacagaaggggccgtatggggtgataaatgccgttgcggcttggtcggactccgccatcttcatttgatggtatctagaagtatgcgtcgaggaaacacaatgagtcgtgtcctgcagtagcgtcgataatttgatcgatgcnnggg

SEQ ID NO: 92953 - DNA, 420 bp, Triticum aestivum
  unsure (1)..(420): unsure at all n locations
  Clone ID: PAT_TA_92953
ctcgtgccgaattcggcacgagcacttattgttattatggctcccacccaggaatctgcagcattcttggctaaaaaaccaacagtccccccaaattttgatggtgtcgaccgtaatgatacgaagagattgaagcaagcgcaggatgccattattcgcgaacagtgggtacgaagcatgatggccaggctagtacgcgaagagctcggaagatgttattatcgtgaaggcgtcaatcacctagaaaaatgcggtgctttacgagaacgatactttgaactcttaaaagacgcaaaaatcaaggggtacctattcaaccaacgaaactacatcaagtaaaggaaaacaattnagnaaaaatagagttggcttgtttagtttagtgtttgatcttaacattgcctccaatgggtggtacaa

SEQ ID NO: 92954 - DNA, 410 bp, Triticum aestivum
  unsure (1)..(410): unsure at all n locations
  Clone ID: PAT_TA_92954
ctggcgaatcaacagcaaaatttgataatcagtcccacgacacaaattcagttggcagcagcgcgtgggtttcgggaagcaatcttgtctcaagaagtgacatgagcaggcaaaattctaacaccgaccgacaaaaaatagctagtgctaggcttaacattgtcgaagattccacaaccaaaccatctaaagacagtcatgaaactggcagtcgtactgaagaagaagcagttgtaaacacccttcctgaaaaagaaggtatcttcatgtttcaacaccgcaattatcaagatatctagctctcgaaaaggactgaaggtagtaaggaggtttagtgactttgtatggttgttggattgcttgcaaaaacgatatccattccgccaactccctcttctccctcctaaaan

SEQ ID NO: 92955 - DNA, 468 bp, Triticum aestivum
  unsure (1)..(468): unsure at all n locations
  Clone ID: PAT_TA_92955
tancgtgggttcctccatgncacaaacctcgacatcgccgtgaagaaagtgtccaacgagctcccggcagggctggaaggagttcgtctccgaggtgaggatcatcagccagatccggcaccggnacctcgtgcggctcgtcggatggttccacggcggcgacgacgacgatctcctacttgtctacganctgatgcccaaaggcagcctcgacgctcacctctacaagccancaccacctggctatcgtgngccgggtcaggtacgaagatcggtgctccggngcttgggctcctgcactgcctgttacctgcacgaagggaagacgggagccaagcgcaatcctggcaacagggganccatcaaagccanagccaaccgttgaatggctgggaacngncgtccctntcaantgcccaaggccttcgggcgaaccttttgggcctttgccaagggaatcgcttncnt

SEQ ID NO: 92956 - DNA, 453 bp, Triticum aestivum
  unsure (1)..(453): unsure at all n locations
  Clone ID: PAT_TA_92956
tttttttttttttttttaatttacactgctgtgtttcacgtgctgaaacccagataatctattttttctatatacaacctccatcatacatccatcacaccgcttttgctgttggntactacgttgaacgctaagataaattatttattttccgacattttttctactttttcaggtgtcaattttccttctacagcattttgcgctttcagttggtctgcagcctccgctattacccgtctctcttccttctcatcgatattttccgtcggtctcgagggagaaagctcgcccggtctctttattttcttcatcttgcctcattctcntcttctaatcaagaatccttggctggctctttcaggaactttccaagggcgctggcttattcgtggggctggcncccttcgggcggctaatgaaatcctcccaaanttccnaatcnccaatgag

SEQ ID NO: 92957 - DNA, 428 bp, Triticum aestivum
  unsure (1)..(428): unsure at all n locations
  Clone ID: PAT_TA_92957
ctcgtgccgaattcggcacgaggagagagaggaaaaccattacttgatccacagttttatgaagataagagaattcgtctcaggggataccaagagagcaatggtgaaatcaatgaccctggctgcaaaagtaccacattttcattatctggaggaaataaactgtgatgctcttgtacaacttaaggcatcatttcaaaaggagaataaagaccatgatgtcaagcataccttccttccattcctcataaaatctctttctgtggcacttaagtaaatatccattgttgaacagctctttcattgacgaaacaaatgaagttattctcaaaggattccataacatcggagtagctatggctacagaacaaggattagtgggtgccaaccatcaagaaagtccagtcactttctatattggngatcan

SEQ ID NO: 92958 - DNA, 425 bp, Triticum aestivum
  Clone ID: PAT_TA_92958
ctcgtgccgaattcggcacgagctggtacagtaatggctgaagaagacctctttggaagcctgcggaggcaatcggatccagaaaagttagagaagcaggccaaagctgtcgcagaacgagaagcttcgtgcagtgccaaagctgaggaacggctaaaatacttgcttgatgacaattcaacccttcccatttcagtgtcctctatccaacttgtcggcgcatcgcatacacgacgctcgtttttagataagctttttacgcctctcctaagctgcaatagagatgctccgtacacgctatctacagcgttgcatgaaattggaattttatcagacaaactgtcgcgttttggaatctttcaacccgaaatatccacatttctaagaccgatctgacctgggtcctgcatcttcgccactcacta

SEQ ID NO: 92959 - DNA, 420 bp, Triticum aestivum
  unsure (1)..(420): unsure at all n locations
  Clone ID: PAT_TA_92959
ctcgtgccgatttaagaatgcttcagcggtgtctcgcgctgtgggtcgctccaaggctataatccacaccctttttgtcagtcgatcaacgacttgcaagatatatcgataattaaaattcctaatgttacaagttggtaaaggtcctacaaaatcaagagttaagtggcgaaatgcggctgagggtgctggcttcgcaacctttcgcatacttgatacactctttatgacacttaggccaccaataggttctactgagtaaggtatacagagcagcggctccacgatggccatatagtgggttttcatgaagtagtttgagtaattgctctcggagcgttaaagctggctaattcgacatcggtacgattagattctgaatttttcaaggctgcccgaatttcttgacaaatacttatn

SEQ ID NO: 92960 - DNA, 480 bp, Triticum aestivum
  unsure (1)..(480): unsure at all n locations
  Clone ID: PAT_TA_92960
acgccgtccacttccgaggtcgcgtgcgtggatagggtttgcttcgccgccgtcccgccgactgcgcctcccccctcgtcgccgcgccgccgccggggagaccaggccaccaccagccgagctaccgatcgatcgaccaacgcggtgatggcgatggccgcggcgcaccanatccccaaggtcgcccacaccctcgtcggagatcgccngaggtcgncgccgctacgcctanagagcaccgctccgggccacgccccggggccactnacggcgccaacggcgtatggtccgcncgnacggggngagngaggcccgcgcggcctggcgggtcgggaattaacgtccctccnttccggnagccccggccttcgncggggacggatcgttcgctcccttcccgttccggccggaagccttttcaagggggcggccgcccccnttttggttttccccaaaggangttggcccnttccccgaact

SEQ ID NO: 92961 - DNA, 430 bp, Triticum aestivum
  Clone ID: PAT_TA_92961
ctcgtgccgaattcggcacgagcatttttccaggaggtcttcaactacgttggatgtaaagtagaatggctcaaagaggaaggctgtggcactcatgataatggcgtaaccatagccctcgcaactgtaacgggaccgcttcgaaaaattctccgtggtaaaagaatcgcccttaatgtgttgagccgatgctcttccattgctacgcagacagataaaatgattagtatcgcacgaaacgcagggtttaaaggcagcttggctggaacacgcgaaacaactcctggctttaggcttgtggaaaaatacgggctaatcatcggcggcgctgatgctcatcgttttgacctctcgaatttgacaagtccgtaaaaccccccgaaaaccttgattcctggagtgtaacttgcttcatgaagcgaattagaga

SEQ ID NO: 92962 - DNA, 228 bp, Triticum aestivum
  unsure (1)..(228): unsure at all n locations
  Clone ID: PAT_TA_92962
aagcaacangaggagattattatgtccatnaggnagcaaggaaatacatataatcgcagaggnattacacataaagnttgtgagaggggtaacaatcacatcnacacttgggcgnnctacngaaacaaacattggatggngnaaacacnngnaacttccatcgtttaatcaagaaacctcccntgatctctctccaaaggnggnangtttgtttggtcngacaagccc

SEQ ID NO: 92963 - DNA, 429 bp, Triticum aestivum
  unsure (1)..(429): unsure at all n locations
  Clone ID: PAT_TA_92963
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcancacggagggcctcctcaagcaagtggactacctgatccgctccaagtgggtgccttgccttgagtttaacaaggtcgggttcatcttccgtgagnacaatgcgtctnccgggtactacgaaggncgctactgggacaaatgtnggaagctgcctaatgttcnggtgcaaccgacgccaacacaag

SEQ ID NO: 92964 - DNA, 432 bp, Triticum aestivum
  unsure (1)..(432): unsure at all n locations
  Clone ID: PAT_TA_92964
cgcagcccggcctcggacgactacatgctgcatttcgcgctcggcattgcggagcgcgcggtcggcgcgtcggcgatgatcgtcaataccttcgacgaccttgagggagaggcggtggcggccatggaggcgctcggcctgcccaaggtctacaccatcggcccgctccatctgctggcgccgagctcaagcatcagcatgagcctgtggaagcaggaggaggagtgccttccatggctcgacggcaaagaggtcggctcaagtcatgtacgtcaacttcggcagcatcaccgttatgaccaacgaagcagctcctggagttcgcgtgggggctgggccaagagcggcaatcattttctctggatcatccgtcccgacctcgtcaagggcgacaccgcagtgctccccccggagttctcggccgagacggtn

SEQ ID NO: 92965 - DNA, 427 bp, Triticum aestivum
  unsure (1)..(427): unsure at all n locations
  Clone ID: PAT_TA_92965
tttacccttacaactgattcatcccaattttccttactcctccattggnagcagagtatgatacaacaccatatacaaattactaaaaacgaatactacaacgcgcgatttcttcgcttctcagccccaccattttcagaattactgcgaattttctgtggattcaatcttcaaatttacgttgacatgtgcttcaagaaacttcaaattaacttgntctcaaccgcatgattaaccactaggaaagcaagcttttttctccgggagagctgttgtcccctcaaccttgaaatcgtcaaatacccatggcacgcctccggcgcttaaaacatcanctggnagtataccggtatcgctgntgggatacaaagtgggcgtaggtnggtccaanggnggggatccctttgtctgtatgagaaaaantcaa

SEQ ID NO: 92966 - DNA, 429 bp, Triticum aestivum
  Clone ID: PAT_TA_92966
actcgggctttcggagagtatctaatattcatcaaccagcagatttcacttgcgactattccgctcacaatgcgcttttccagcatcaccatcattctccaaagcgcaagcatcttcttcacaactgtggctggggtcactaccaatcaaatagatgagccaaggaaatcatttgtttgtaatggagttactattaaattcaataaatttggtcatcaacgcagtttagtagaagatgcagcgagcaagtttcaaccagggagtttgtaccaaatatatacgtatgaattgactcaggcacaccaagaacgagcatacctataggactcctttcgtgtatgcagataatgataccactaacttatctttttacctactcgccgatttgacatcatacgaaaaccatcgtgcttatttcatcacatttgg

SEQ ID NO: 92967 - DNA, 504 bp, Triticum aestivum
  unsure (1)..(504): unsure at all n locations
  Clone ID: PAT_TA_92967
tttanatanagccagccccacctcgtccgctcgtgaacattcaatcgtacgccaccttcggncaagctgccgacaaccgtcccggcgacaancttgancggctctgnaagagcgaccgacgtccgtacgtagtcctctgttnccggcgncatggactccggtgncgcgggcgcccacctctatcccgtcctggggggtcaangaaagaagtggttccgncggccgaacctcaangggtcgnctaacgggangggtcgnccatgaaaatggnaatccgggaccggggtgcttcgggcngtccgggcaagcttccgccgccgccgttgggtggaagggccaaanngaagggttttccaatcgaagattncataagggggcctaactcccgttggttctccggactccggncaaggaanggntccctctaacgaacgtccgggcgtctacctaaaancgaacggnngaacgggccgccangccaagcaaagaatgtnttcgggggan

SEQ ID NO: 92968 - DNA, 443 bp, Triticum aestivum
  unsure (1)..(443): unsure at all n locations
  Clone ID: PAT_TA_92968
gcccccctccgatctcgccgagaaatctcctccgatcgaagcgaagccaaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctggcagactacaacatccagaaggagtccacccttcacctggtgctcaggctccgtggtggcatgcagatatttgtgaagacactcaccggcaagaccatcaccctgggaggttgagtcctcgggacaccatcgacaacgtcaagggtaaagatccaaggacaaaggagggcatccctccgggaccaagcaagcgtctcatcn

SEQ ID NO: 92969 - DNA, 312 bp, Triticum aestivum
  unsure (1)..(312): unsure at all n locations
  Clone ID: PAT_TA_92969
ctcgtgccgaattccgnacgagctcgtgccgaattcggcacgangncggcaactccactccacacaggtaagaanaagaagagatggtgcacaangaagcttcancaagnatggtggntngatagccacaaactccccaggaacgtccccatgggtangnaacancctttcataactgggtgacaaagaccaagcaaatgctcaangctgnttgaccaagaagcgggnctcnttcgctcaacntgngtgaaatgttttacaaaaagcgccccctcctngtggacangntcngcgacctnttttgcaagcaac

SEQ ID NO: 92970 - DNA, 198 bp, Triticum aestivum
  unsure (1)..(198): unsure at all n locations
  Clone ID: PAT_TA_92970
cgcgtgtgctaaatanngatttcaagcccttcanctttcacaatatttcatcatgttacctctcggtctantgngcagctgcccaaggatatcctatgcttgtcgaancntaagaatggngaaactctgaatggaacatctcgtcaccntgtgatacatgggatgaatttgatgctcaacngaaggtgggctgcacga

SEQ ID NO: 92971 - DNA, 444 bp, Triticum aestivum
  unsure (1)..(444): unsure at all n locations
  Clone ID: PAT_TA_92971
ctcgtgccgaattcggcacgagcacacacgaactatttcacaccacttcaccgccgacaaaaacagagaaacaaagtccacatctccattatgtgcagctccgatcatttcgccagtaataatgacttgtaccttcagcccaatcatcagaggggggctgggatcatggaggcctgcgatcttgacagaagtgggcacgggcagagccggcatggccaggaggcggaggagcaccggtcggacccgagcgcggcgctcaccacgtacctgaccttcctggaagcacaagatcgggcacctccgcgggatcctctgctccacgccgcgccacccgcagcagcagcgtgccatcgtctccgccgagctccgctgcataatcgtgcagctcgtctccatcgccaactacctcgactccgngtcccgggcgcccggcgcggcggacgn

SEQ ID NO: 92972 - DNA, 213 bp, Triticum aestivum
  unsure (1)..(213): unsure at all n locations
  Clone ID: PAT_TA_92972
ctcntgccgaattcngcacgaggtttgtacttgtagtgctacgtcgccgggcancaaggtgtgtangaantgcgatcgantgagcaaganctanagctagtggtgccanaggcagganagatcnatnggagcggccatggcgggggagaaaaaggcccaccccnttatgttcccgttcccttgctcnggccacataaacccgacttcaatctt

SEQ ID NO: 92973 - DNA, 306 bp, Triticum aestivum
  unsure (1)..(306): unsure at all n locations
  Clone ID: PAT_TA_92973
actttnttcnccntccnttcnctttctactcttatcccnaccccnggggggggtgggggggntccacccccattacctaccnctctagaactagtntgntcccccngttcttcannattccncacgatctccatactacctttacctttttgtntccaccctnttgatncacctaccttccatntctactntacccatanaccatccntcnatcctacccgccactacacntcttnccctttcttnttttctcctnccnttcctntcttataccctacaaaacatatatntctccacacttcctcc

SEQ ID NO: 92974 - DNA, 327 bp, Triticum aestivum
  unsure (1)..(327): unsure at all n locations
  Clone ID: PAT_TA_92974
ggaaaaaaccgagcaagccaaggncgctgccacgactgcggaggtcaaggctacntgcaactttgaaagaaataaaggcgtctaaggcatccgacaggctggcactaagtggcaactcaagcattgcaagagagtgagggagggtncaaagctctgaatattctccgacagtgacacttccggttagggcgaataacaccttcttaatcaagagggttcatgaaacccgaagagctcnccanccaaaggggtggnggnatccgttggccgcaaataaaancttggcngaaaagagtcctgagtcaaagggaancctgggaagaagac

SEQ ID NO: 92975 - DNA, 424 bp, Triticum aestivum
  Clone ID: PAT_TA_92975
ccgaaactctacatcaatttagtttgggagtgcttgcaacaaagctgcagtacaatttacacaatctacggatttgctctgatctacacgtgctaaattaattctcgcaggctttatatcagttcgtaaattgaacacaaatcggctacaatttccgagtcattactctcccttgaacgagtcacagatgccaaaatagactgttttcattgcttattaccgtgtgcttgcctcatctcttaatacaatgcactgtaatctcaacatgacatctgaagaatttgacgatagtgtccgctgctattcgagtgatacctcttgtggctctaacagtaaaagaatgtttttattctgggtcctagatagttgtgttccgaaatattgatagagtttaaagttgttgtgaaaaaatctatgtgtcaag

SEQ ID NO: 92976 - DNA, 437 bp, Triticum aestivum
  unsure (1)..(437): unsure at all n locations
  Clone ID: PAT_TA_92976
cagccatttcgtaccttcnccacagcgcaaacagacattttcaagacctaccaagtatggtgggaaatacactgttactctaattcctggtgatggaattggcgcagagattgtagattcagtcaaaacaattttcaaggcagataatgtaccagtagaatgggaacaaatcgatgtaactggtgtagaaaccggagaaaagctttccgaagacttattccgcgaatcaatcacttccttaaagaggaacaagcttggattgaaaggtatactgcatacacccatcaaacgctcaggacatcagtctttcaacgttgctatgcgacaggaacttgacatctacgcttctaccngtgtcatcaaaaatattcccgggctacaagactcgccatgaaaaatgtttgntctgtgcataaatccgggaaaaatacagangg

SEQ ID NO: 92977 - DNA, 417 bp, Triticum aestivum
  unsure (1)..(417): unsure at all n locations
  Clone ID: PAT_TA_92977
gcaagtttagcagattacgatgtataagctgcactactgcacttacttgatataaggtagtatctcaggacagttaatcaacacataccaaaccattttgtccaaatctttaggtttgtcctcttgttgactcttccctgtaactcgatcagaataatcaaaaacattgagcccgggattgtcttcacccacctctttgctaagttgatcggttgtttcaatgtattttgagcaagaatgtcaatgcttctgtagcaatgtaggcctctgcaatggaaccgccgggtctagctctgttcttaacatancccttgaaagtgctaaccgcctttgnatagggtacatccaagccaaatccaccatcacatcaaagaaggntggagggatatatcttctcaaagtcgcaaaggatanttt

SEQ ID NO: 92978 - DNA, 426 bp, Triticum aestivum
  unsure (1)..(426): unsure at all n locations
  Clone ID: PAT_TA_92978
tgtgtcncnacctatctacaacctcaacctcgctaataacatctttccggactctgcttggttgtctacgatccccagttaaaacacactgctgagaatataactcgtcacgtatactttaatcacattttcttgcaatcatgggacttgcattttcaaaaatctttgacaagttatggggaaaaaaagagatgaggattctgatggtcgggcttgatgccgctggaaagacaacgattctgtacaagctcaaacttggagaaattgttacgactattcccacaataggcttcaacgttgagacagttgaatataagaacattcaatttaccgtgtgggatgttggcggacaggataaaatacgacctctttggaggcattactttcaaaatactcaaggaatcattttttgtggttgacagcaat

SEQ ID NO: 92979 - DNA, 425 bp, Triticum aestivum
  unsure (1)..(425): unsure at all n locations
  Clone ID: PAT_TA_92979
aattcattctcgtgcacccttgtgtttttgtccctttgaccctacagccaaatgtcttctctttaatgttttaccataaaacctagtagaacatgaccgtattatatacaaatataatttcctacggaatttaccagccgtaccgactactagcctcagctctgttactttttcctttcgcaaagctttcctccaatgcctctttttgactctgcgcagcattgaccaattgtttaagactatgctttccaggtgcaatggccctaacagggttgtgtacctgttgctcgccagtgctgcgtattatttcgttgtgtgcgtattcttcgtccgtattaaagttgattattttggggatccgaagcccaaatgtcattttctttatgcctcccaaagagttgacgtctttcagaaatgggggagan

SEQ ID NO: 92980 - DNA, 425 bp, Triticum aestivum
  Clone ID: PAT_TA_92980
ctggacttctgaagctacaccgcacgcatactatgatcagctagaaacccacctaaaatttcttcatgcttcacctcctctcatctcacgaatgctacacatttttattacaatcgggttttctggattcttcatcaagctttttaagccatcggaggcaaatcttttattcgacggcgcctcacttgttctttatgttataggagttgtagtctacatttcaaatatagtaaagggattgagaatcgtaacatcggggaactacggtctgaaagaaggtaatacagaactagccattggaagagaagaaagcttgaaagttctggctgcaagcaataccatccttgcactcgtcctaatcggtgtgcttgtgcttcaagctggtcagtggtatgctgagcgcaaagaaattggatggaggtagc

SEQ ID NO: 92981 - DNA, 510 bp, Triticum aestivum
  unsure (1)..(510): unsure at all n locations
  Clone ID: PAT_TA_92981
ggggggggcggctctaaaactaaatgggattccccggggctgcagggaattcggcacgangatagtgatgtggactgtgttgttaattttgcttcttcacnaagtgtatacacatctacaatggagttaatggagtatcctcaaattaaatcnattgctatcattgctgagggtgtccctgaaagacgcgcccgagaaatcctccatgtagccaagaaaaagggtattactattattgggtcctgcctaccgttggnggtattaagcccggctcattcaangattgggaatacanngagggatgatggacaacatcgtcgcctccaaagctctaccgaaaaaggatntgtcggctatgtccccaaaatcanggagggnatntccaaatgnagccngnataaatatcatagnccaaccaccaactgngtgggngtttnaccaaaagggggttgncnaanttgggngggngaatagaatnatccccanacacctannntttttattcgaaac

SEQ ID NO: 92982 - DNA, 343 bp, Triticum aestivum
  unsure (1)..(343): unsure at all n locations
  Clone ID: PAT_TA_92982
ctcgtgcccgaattcggcacgaggtcaccacagccgccgcctaccccaccaacctgccccgacccgctcccgacctccgaggnaatcagcgtcccgccgcgggccgccatggggttcgagaagatcaaagtcgccaancctatcgtcgagatggacggcgatntagatgaccagagtattctggcagtctatcaaggacaagcttatcttcccanttttggncttgggcattaaagtnctttggacntggggagttccacaccgtgatnnaactgatnaaaaaggttcantggggggtgnanagggctaccccncaaagtacaaatgtgggntaattaaattg

SEQ ID NO: 92983 - DNA, 484 bp, Triticum aestivum
  unsure (1)..(484): unsure at all n locations
  Clone ID: PAT_TA_92983
ccgcaccgcccctccatccacgccancgtctccctcttcagctccggcctccgggngtgcccctcgcatccgtcgaggggtccggggctcaacctccctccgcaacggccgcgggtctccggcctcgncggncttcccttccttgtcttccccctcccgggggcccccttcnaccctcgcggcttcgcggggttgccgggggccctcgcgccctacctcgccgaagcgcacctgtcngcggctcccctcactctcccgcatcttgggtatggaaccgcaccaaggccaagtccgcccgcgctcgtcgccaagctccgggaagcgcacccgggaagtggccgttcnaggaggtcgacggnaanggtacnaaggcaagtgtccgcnggcgggacaatccgtttaggctgccgcgaacggggggtccccnangaaggccggatttgtnncgttggggggaagcttgcttgaagggccccggggggct

SEQ ID NO: 92984 - DNA, 441 bp, Triticum aestivum
  unsure (1)..(441): unsure at all n locations
  Clone ID: PAT_TA_92984
gaatagcacaagaaanaattttttcgcatatctaggtaccaccaaaacttganaaaaaaaacaccccaataaacctgattacctcggaataaccctattgtacttctgaagatgtgagctttattgtctcgatcttcgacgccccattagcatgatcatattcttgtcatcaaattgtcagtgttattcatgtcttgataatccttgtactggatgtgtttatgctaccacctttagcctcctcggacgcacggaccgctgcaactttagctgcagccttacgagaggactgctttcggtacgtgctgatgtaaaatgatataaacaaaattaagtaagacagcagaataaggtcgccaagcggctgcagcccatggctcgccagcacactcccccgacatggggggaagagagggccaagttaacgtgggncgacnttan

SEQ ID NO: 92985 - DNA, 443 bp, Triticum aestivum
  unsure (1)..(443): unsure at all n locations
  Clone ID: PAT_TA_92985
cagactccccanataagttggtcaatgtttctcgaaancatttgagtcattcttcacagattgaatcagatancttaagaacaaatgatgggncatctactaacaccttctttgcccgcgaaaaatataaatccttaagagatatctcatcctctgtcaaagatgncgaatatccatcactaattaggtcaaatcctgttcgaaaaagcacgtcgnacccagcaagaaacacgtcagnaattcaaacgatcaccatcggattttccatcaaattaagattggccatgantctgaaaaatcatgttcaactagatatactttggaaagatgcggccaggtgggccggtacanaaatcatggagtcctaganacacggtagctanatgcgtggctaaaggncttggtcattaanaaggtnatggtacagcaanttcanntaantg

SEQ ID NO: 92986 - DNA, 443 bp, Triticum aestivum
  unsure (1)..(443): unsure at all n locations
  Clone ID: PAT_TA_92986
agctcgtgccgctgagtcctcatcaccccatgtcgcccaaaggcaacgtgacgctgcctagtgcgcccaaagtgagtaccgtcagcggtgccacggcactagcctcgagcaccctgttggtcttcctgggtttagccgcgggcgctgcgacagcttggatccaaatctaatgcggagcagccagcacgtcggcgcattgcttggatcgacacgccgtagtctcaagtcggtgtggcgggnttctagggccgtccgaatttcacgattgcatgaggatatggaacgggagctttggggttgtaattttcctcgcctacgcagaagccattcttgggctagcttcattgaatacggtaatagcgtcatncgggtcggggtctcaagggcactccantccggntggggggtgtaatctaattgtacnaatatnaattggtttttna

SEQ ID NO: 92987 - DNA, 446 bp, Triticum aestivum
  unsure (1)..(446): unsure at all n locations
  Clone ID: PAT_TA_92987
ctcgtgcctcgtgccgaattcggcacgaggttatatactctataacataggccttatacacacaagcaatggngagcatacaaaggctttggaatattatttccgggcactagaacgaaaccccttcttaccgcaagcttttaataatatggccgtgatctgtcattacgtgcgactatctccactatagaaagaaaaaaaaaagagaggntcaaattttctagtaaatactagaaaaaaagggctttctacatagggatcgtaaaaacaacgatttttccctatcagctgtaggaaggaaggacacttcacgaggaatcaaaaaacgaagaaagtatggcctatactactactcnatggggtaaagtttctcaaattgatngaagaaagcaccgtnaagatcaattattgagcgactgggtcgatacaactaaaaaaaactgcnt

SEQ ID NO: 92988 - DNA, 196 bp, Triticum aestivum
  unsure (1)..(196): unsure at all n locations
  Clone ID: PAT_TA_92988
gtcgtgccgaattcggcacgagccggagccgganctggtcgagactcgacgccgatggccgggttcgccacctcgcggccggnctccctcgcgctgtgcggnttcctcatcttcctaaaggtctttcgcctttcctcctcgccgtcgggggcccgacnagcgacnaannaccgggaaaggtgggtgcccgggacga

SEQ ID NO: 92989 - DNA, 409 bp, Triticum aestivum
  unsure (1)..(409): unsure at all n locations
  Clone ID: PAT_TA_92989
ttttttttttttttnggccctcttaaatacagcttcgtatgaattagaaatctaagatctttttaaacaatgattaatcttcagttacaggctgtgcattattaagcaaaagcccccgacagtattctaattaccagtttttcctttaccatatactcgaagattccgattatgagatgtttatccgtaggttgactttatctattctgttgtagtgctggactggcatattttaacatgacacatctaagcttgcttttgagttcatgagaagtgcaacaattaatccgtatagacccaatacttcaagcaaaaattagaataagaatcatgccgacgaaaagccttggctgctgcgcagtacctctaacaccagcatctccaacaattccaatggcaaatccaggcg

SEQ ID NO: 92990 - DNA, 442 bp, Triticum aestivum
  unsure (1)..(442): unsure at all n locations
  Clone ID: PAT_TA_92990
ctcgtgccgaattcggnacgaggtgtggtaaacaatagggaacagttcccaagcaatccaagaataaaatcagcactacagtctcaaccctatctgatataggcagtaagagatagcaactaatctctcctacttgaggggttgtgaagctaagtatgagaaactcacttcttcaactctagccagttagacctccgtccgagaaagaaagttcttggagaataattgataaggccacatcgatgaaagccactattgtcaagggatgttatcttgcggtggtataacctaaatcattgaatataatcctttatcatatcctgacatgtgtgggtcaccgtattggagaccgaaaggtcatcagaaggtgtaataatattccccctcatttnanttatccatttttaanangagnaaaaanntcncgcaccctccgaggggg

SEQ ID NO: 92991 - DNA, 461 bp, Triticum aestivum
  Clone ID: PAT_TA_92991
ctcgtgccgaattcggcacgagctcgtgccgatcaaatacctcgaagttatccgtcacgcatcgcagtacaccaaaatcatatatctccaacttttatgaagtaatcgctgaaattaactcgacgcaatcatgtcaacggaaaaaatccctaacaagattaccctcatcagcaatgacggggccgtaatcaccgtcgatagccaggttgctatgaagagtgttttaatcaaaaacatgattgaagatctcggtgacgccgtagcggaaagtgacgtgcctattccaaatgtcaatgaatcggtccttcgaaaggtgatagagtggtgtgaacatcacaaacatgaccctgcacctgccgcagacgacgatagtgactctcgaaagaggaccactgacatcgaagaatgggaccaaaagttcatgcaggtcgaccaaggagatgcttttcgaaataatactg

SEQ ID NO: 92992 - DNA, 463 bp, Triticum aestivum
  unsure (1)..(463): unsure at all n locations
  Clone ID: PAT_TA_92992
ctcgtgccgaattcggcacgagcatgcgtgatgatcctgaagatgtcgattcgagaagtatctttgtgggaaatgtcgattattcgtcgtcacccgaggaaattcaggcacactttcaaagctgcggttccatcaaccgtgttaccatactcctggataagttcaccggtcatccaaaggggtatgcgtacgtagagttcacagagccaagctttgttgctcaagctctcgtcctaaatgagagtgtattcaaaggacgtaatcttaaggtagtacctaaacgtactaatattcctggaatgacccgtggcaagaggtagaggtggtccgaggggtcgtggatatggcggccgagggctacccaccaagaggaaagtggctaccgggggggattcagagggagccgtggcagaggatacagtccatactgacactcgtttgnaaaggggtcttattgcacatg

SEQ ID NO: 92993 - DNA, 186 bp, Triticum aestivum
  unsure (1)..(186): unsure at all n locations
  Clone ID: PAT_TA_92993
ctcgtgccgaattcggcacgaggtttttttttttttttttttgacatgttaaccataatataataaaaaatctgtggtaaagatcatcnncatcgtttgccctgcangattcnttcncaaggaaccangctcccaccacggcntcacangcaaaagagcntgcccgtacagcncacccttgccacc

SEQ ID NO: 92994 - DNA, 464 bp, Triticum aestivum
  unsure (1)..(464): unsure at all n locations
  Clone ID: PAT_TA_92994
cttttattctatctttcgtcaacatgcaagggcttattacctcttcactcttcatttcatgtgctctatctctcagtctaccagttgacaccgccacatctcaattcaacaaacgacacttcgatcaggctgatgaatccaatgccggtggccaaatttgtgcatccagctcgcangtattcacggagagtgacattcaagaaacagctctcagagcttgtcatctcttgcaccagcagaacttacttgatgcttgcacaagaatgcgttgaagtgaggccagaatttcctcgaatgttcacaggaatcatcgccgatgaggtcggtcataatttacaccnatgataagcatcaaaaaacacatgctcaatcccggggttctaaacaaatgttcaactaatgttttcaattggattcaccaatacccgancaantgattcacnanantctcacnagcanggcag

SEQ ID NO: 92995 - DNA, 237 bp, Triticum aestivum
  unsure (1)..(237): unsure at all n locations
  Clone ID: PAT_TA_92995
tcgtangcgcaaccacngtctcgacgtctcctcctcgccctatccntttcctccgtttcacactctcctccccttccttggtantaatgtcctcccttgctagtttccgcctcacatcttgaccacanatccncacccccggnactgnccccaggaccaccgagnagcagcacntcatgancgcccctcctgccgtcgannaanatctattacggngngncggtcngncgcctgctc

SEQ ID NO: 92996 - DNA, 444 bp, Triticum aestivum
  unsure (1)..(444): unsure at all n locations
  Clone ID: PAT_TA_92996
gatgggtacttgaaggagaagctcgtgacgtggctcagcccagcggcactggcactccaccagataacctgggatgatcctgcctccttgctcgagaagattgtggcttatgaagctgtgcatccaatcaggaatctgatagacttgaagagaaggctgggtgtgggccgacgttgttttggttacttccatcctgcgataccaggggagcccctgattttcatcgaagttgctctcctcaaagatatggccacatctatacaggaagttttgttggatgtccctccaatcgctgaatgtgaagctaaatgtgcactgttttactcaatatcgtcaacccagccaggcttatcaggtattaatctgggaaagtttcttctcaagcgtgtcattgacatgttgagaaaagatatgccttccgtgcagatttttgctactcttang

SEQ ID NO: 92997 - DNA, 464 bp, Triticum aestivum
  unsure (1)..(464): unsure at all n locations
  Clone ID: PAT_TA_92997
ctggtgccgaattcggcacgagctcgtgccgaattcggcacgagatgtgtcgatcgttcctgtgcatttcatcagcanagaggggtgggctactagccttcccatttccgacaggtccatcatcctccagcatctcgtcagccgaacgtgaagtggattggccactgggaactatgtatcccctttgagcagattccctaccggctctgtccctctcctcgtcncactgccccccagccttctccctgggngagcctcctagtcntggtacggtaatcaatgccctcctccgacgagttcctcttgggcttcccctcctcggacggcgcggggatgccccagccaaggagaaatccntcctctgcgcgacgagcgcgggtggggncggnagaagcaagggcnttctaacgacgacccgccccccgcctggaangnctggcgaangggccttgacccctgatctt

SEQ ID NO: 92998 - DNA, 197 bp, Triticum aestivum
  unsure (1)..(197): unsure at all n locations
  Clone ID: PAT_TA_92998
cgccgatnntcngtccacgggcagtcacacgagactancacgatggaggcgcctcgctcctgccgggggcaagccgctgtcggggccgcgggcncggcggcttgcccggngccgggaggagatgctgggcctcctcgccgacttcgtacggcggcgatgganggctccgaccgcgagcttctccttctcacgacctc

SEQ ID NO: 92999 - DNA, 461 bp, Triticum aestivum
  unsure (1)..(461): unsure at all n locations
  Clone ID: PAT_TA_92999
ctcgtgccgaattcggcacgagccctgataatacatttcccgccaaccttaccttgggccaaactgtttttcacgctctcagattacattttctttcagacagaaccattcaactttccaacctacagtcatctccaactcttttcccttttctcaaggatgaaggtttgacagtgctccacagggtgcgttgcatagtctagtgaagatctaggtggtgaatgaggataataaatgggtcaaagggatgacaggtcttctctaggaagagataaatgggtaactagttgcggtagatgttacacgtgggtctttctgatgaagaactgggcaatggataaatggtcttcccgaagaagagatgggtaaacaaatgtattgtaaatgataagtaaagaaagacgttgcgtgngaagtaaatctctctcactccgnactattatatacaaggatttagaagc

SEQ ID NO: 93000 - DNA, 503 bp, Triticum aestivum
  unsure (1)..(503): unsure at all n locations
  Clone ID: PAT_TA_93000
aagacaagcaaccaaatcttcttgagggttttctgcaactgcaatggcgttgtccaccatggcactctcctctccggcccttgccgccaagcaggccaagatcgcctccttcaacgtgttcggcgagggccgcatcactatgcgcaagacggcggccaaggccaagcccgccgcttccagcagcccgtggtacggccctgaccgcgtcctctacctcggcccgctctccggtgatgcgccgtcctacctcaccggtgaattcccgggagactaacgggctggggaacacgggccggggctctcgggctgaccccggaagaacgtttcgcgaaangaacaagggaagcttcgagggngattcaactggtcgggtgggggccaatggctccggtgcctccnttgggttggcgtccttccccggggaggctccctccgccncgcaaacngggggtcnaaagtttccngntgaanggctggtgntgggtttcaaaaaacttgggttg

SEQ ID NO: 93001 - DNA, 444 bp, Triticum aestivum
  unsure (1)..(444): unsure at all n locations
  Clone ID: PAT_TA_93001
aaccctctatagtcaacacacaatcgcaaacctccatttggcttttttgcaaagagtactggtgctgctgccgctgagttacttggacgaatccatcccttctttaacaattccgtcaacgttttccgtagaacgagtagttcctcccgagacattccgtacaatggcccccaaggcggggatagcggcttgccgtcttgctgttggagattgatggcgtggtctagggtacctcgcagtggtggtaattcgtctgccccaccaccgtctgcaaaaaggtgtgcaaattcccttacctgctctggcaatttttctctagcttgatccactgtaacgtttggtttcgtgcgtaaagccttgttaatgtcatctanagaagctttgcaagactggcacttctttaatcatgggataccatcttatcgncaggtatcattctcggcc

SEQ ID NO: 93002 - DNA, 449 bp, Triticum aestivum
  Clone ID: PAT_TA_93002
gatgcaagtacactatgcaagtacagtatgcaagtactcaaaagaataacatgcatccagattgcagcacacacaatttagctacactgcaaggtccacactgatcaagtactctcaggctatcagtacctagaaattaaattattactgggcgcgccataacacgaaagctcatgagctctggtggttaggcgcaatcgttcaccagcgggacggttcgatccctatcgcgcgggcatagccgctacgagcataatcatccccacggccgaggaggattcatgtgtgagtcgctccttgatccgacgcctgcgacctttatccacctgggatctccttgggtaaatggcatcgcatttctcacatgggacttcaccacgcaactcgattctcttcagccccacaagctcgctccatgactagcccttatgtagtttgtcactttgtct

SEQ ID NO: 93003 - DNA, 236 bp, Triticum aestivum
  unsure (1)..(236): unsure at all n locations
  Clone ID: PAT_TA_93003
ctcgtgccgaattcggcacgagagcantcaagcanagcattccattcgcctcctccattgnacggnctgagggcgggagcacggtgagcatggggtcgaggtacgaggtggaggtgacggtgggctcggngcgggacctcaagaacgtcaactggcgcaanggcgacctgcagccgtangccgtgctctgggtngacgacggccccaaggtgctcntcccgcgtcgangttgacaa

SEQ ID NO: 93004 - DNA, 464 bp, Triticum aestivum
  unsure (1)..(464): unsure at all n locations
  Clone ID: PAT_TA_93004
ctcgtgccgaattcggcacgaggaagagcaggccccaactccaaagcggcgcccagtgagcaacgaccgcgagctagctcgattcctctccggttcgattcgattctgcagaatcctcctcccggccaaaccagtccctctacgtctctgcacgaagcaagctttggagtctacatatcgatgagcatttggaaggagaattgacatacatatagcagttgaaaaggatgggttatggcatgagtaggctacagggatccagtgagcctgaagggcagaatagtgatggatctaagttcagttgaagtgaaaaatgatttctcaaaattacataatgatattttccatatgactcgactaagatnagggacctagngaaagcatccgcaagtccatggatagagtctcaagtaacaagggttgttacgttggaaagggaagttaattcttcaagaaaatgggaa

SEQ ID NO: 93005 - DNA, 445 bp, Triticum aestivum
  Clone ID: PAT_TA_93005
tttttttttttttttttgctgttggaatagtaatttcaaggccctgctaagcgcctactaagattacagactaaaggatatgggtcttggtgtttttcgaaagatgcgttctatcgcgaaacaacaatctgagagaatccccttcgaaaagcttcttgttcctctgccacgccactatacttattaatccatccaagaacttccttgtgccataccagagagttctctggcttcaaaacccaatgattttcatctggaaagctaaagaaaacgactctcgatgcctcttgattgtagtacattgaatgtcgctaggccttctgaaattggtagacggtaatctagctcattgtgaatcacaaggtggggcgtggcccagtgctggaggaagcggggcaggatcccatttttcgtaattctgccgattctcccaaagctttccgcc

SEQ ID NO: 93006 - DNA, 205 bp, Triticum aestivum
  Clone ID: PAT_TA_93006
agaaacaacatgtgttatctttcagtcttggtcggtcggtcgtcggtgatgcagcaatcccttctgtcatggattgggatgtgatgttggaatatcctatgtttgaactcggtttaaatggaagaaaatgcaagtcgtcatagctgcgaaaaaaaaaaaaaaaaaaaaaaaaaaaaaaaaaaaaaaaaaaaaaaaaaaaaaaaaa

SEQ ID NO: 93007 - DNA, 497 bp, Triticum aestivum
  unsure (1)..(497): unsure at all n locations
  Clone ID: PAT_TA_93007
ctcgtgccgaattcggcacgangcggcacgcgctggagtcggacatcnccgtgggcagcgcgctggtggacatgtacgccaagtgcggctgcctggcggngtcnagggcggtgttcgaccggctgccgaggaggaacgtcatcacctggaacgtcctcatcatggcctacgggatgcacgggctcggcggcgacgcggtggcgctcttcgaccanatggcggcgggtcggcgaggcggcgcccaacnaaggtcaccttcatcgcccgccctgggcgggncgtgcagccactcccggggctggttcgnaccgacgggcctggaagcttgttccnccggcaatggtaganggggaaccaacnggnggtnaaagncncgaacgcccggganccttccaccgcccctgncggtccntccnaaccttgcttccgggcccggngacgggggggaangcttccaaccnaagggcgttancaancaatcaattnaacccttccca

SEQ ID NO: 93008 - DNA, 460 bp, Triticum aestivum
  Clone ID: PAT_TA_93008
ctcgtgccgaattcggcacgaggagagagagaacctattggtcgagtcgcagcaagtgctattgctgaaaaatatttgaggctcacgtacggaattgaaattgtgtcgtgggtttcatccgtaggaaaccttcacatgtttccaccaacttcagaacatccaacaccatctaccaatccagaatttctcagtctgatccaaaccatcacccgggaaaaggtggatgaatttgggcccgtgcgctgtcccgatgcaaaggtttcggcagagatggctaaattaatcgctcaatatcgtgatcaacacgatagtatcggtggtacggtgtcatgcgttataagacatgttcccagtggactcggcgaaccaacttttgacaaaatggaagccatgcttgctcatgctatgctcagcattcccgcatcgaaaggatttgagataggatctggctttggtggcc

SEQ ID NO: 93009 - DNA, 274 bp, Triticum aestivum
  unsure (1)..(274): unsure at all n locations
  Clone ID: PAT_TA_93009
ctcgtgccgaattcggcacgagcataaattgataaggtagcatttccatttcttcttcaaaaaaaaagtgccttttgatgcaaagaattgcctttccttganatcgaacataaatgcataagaggatccataaagaaccatagggttttccgagcaaaaaccagggtacattatcccaannatgttccatcttcctataaaaagtgggattcgttccacgaaaagttccaacaatgatgctaatggtaatgcaaagaacgattgtttacggacg

SEQ ID NO: 93010 - DNA, 264 bp, Triticum aestivum
  unsure (1)..(264): unsure at all n locations
  Clone ID: PAT_TA_93010
gggaaattcaagcccantaattctcgaangggaaaggcggtggtcccgggtggntggttgcngcctctctgcntgctgatatcgatggncgtggttatgtcatcatcccgccgttatgtaacggagccggtatcttactgatatcggaatgtctgtangancataancttantgtatatgnaatgttnagttatgggttcggccgtncgtaaatgtatngncatgatgctntnttganggtgctggttgctgcttnctnagtaa

SEQ ID NO: 93011 - DNA, 440 bp, Triticum aestivum
  unsure (1)..(440): unsure at all n locations
  Clone ID: PAT_TA_93011
agagaactagtcggacgtgcggcccgccgcgagcgagccgacgagcgagaagatgttgatgatgccggcgaggacctcgatctgcgcgtccgtgatcttcaggtccctcttcatgaatatctgcgcgccgctcatcaccgagacatcatagccgaggaggatggagttcatggaggcgagaatggcgcaggcgagggcgtacttgttgaggggcgcgcgtttcgccggcgcctcggcggcggggatgtcggcggccacgtccttcgacatggtgaaaccggggaggaagtttgtctgcgaagtggctctcggcacactcgacgtgtcctgctcctgcccgactcgtgccgaattcggcacgaaggggggggccccggtaccaacttcncccctaaanntgaggncgttatntacgcgccgctcaactgggccgtccgttt

SEQ ID NO: 93012 - DNA, 155 bp, Triticum aestivum
  Clone ID: PAT_TA_93012
ctcgtgccgaattcggcacgagcttgatgtcacttggcctggtttattgtgaacatgttttgagtttaatctgtgttgaatgcttgatatatgtcccttatctcgttgcttattgttatactgatgatttggcccttaaaaaaaaaaaaaaaaaa

SEQ ID NO: 93013 - DNA, 479 bp, Triticum aestivum
  unsure (1)..(479): unsure at all n locations
  Clone ID: PAT_TA_93013
agctggaatccttatgcaccatgctgtttatgatagagtttcccgccttggtcagaatggtgatctcacgtctgaagaaaatagaatattgctggcagagttctatctgcgccatcgaggagagcacagctaccgtcattcatgaatatgccaaaaggaaggcaaataatttggtggccaaactttgngatcgcagtgactgctgaagaaacatgtgcangctagtttgttaagcaagtgatttgtttggcaagttgtctaattcagtattatgatcaactttaggactaaactggttatgtctgaaaaaaggaacgatatactggctcgggcaaaatcaagggtggctggcgaatatgctgantccaaaacaagaatccaaggggggcaagggaccttggnggtctttgggtggatggcaaaccctaattggcacaanaccctaaaaaggcaatttaatggattgntncntcccantg

SEQ ID NO: 93014 - DNA, 270 bp, Triticum aestivum
  Clone ID: PAT_TA_93014
ctcgtgccgaattcggcacgagaggtcctatgggcgcattgaaactgggcactaaccaattaaccataaatccttaatcaattgaaggccttcaaccactctccgccacttcccccaagccgtctatcgcttgagggcaatcacccatgacatattacctataggccatgtatgttgttcagtcccacttagtagtttccaatcatctagagatacaccacatcccctcagtaaggtctcgacttcctcgggggtacgcgtacgcaaggc

SEQ ID NO: 93015 - DNA, 446 bp, Triticum aestivum
  Clone ID: PAT_TA_93015
ctctgtagttctgcatcatttattcaaatccaaagatgccttttcacaactcatatgtcaaaaatgaatgcggaaatgggtaaacaaaatgttacttataaagtatcgtcccgtaaaccacttagtcaagactacagagaatttctctccagggccctgcgtgtgaaccaagcaggcgaacttgctgctacgctaatttacaagagtcaaataccaccattagtcgctgcacacccgagtcttagaccactcatgcagcacatgcatgatcaagaagctggacatcttcataaattcaatcagcttatcgcaagacaccgtgttcgtcccacagccatgtatccggtatggacgatagcagcatctgttctaggatggggtaccgcgatgatgggacgtgaagcagcaatggcatgcaccgaggctatcgagacagaaattgggag

SEQ ID NO: 93016 - DNA, 445 bp, Triticum aestivum
  Clone ID: PAT_TA_93016
ctcgtgccgaattcggcacgagataaagtccccttcctccgcgcactaaacagaccgatccacaattccatcagcttttattatttcgccccacaaaaatctcaggacgctctcctctactttcatcaaatccgtcattaacaattatctcgatggcatcaatggattatgaaaatgagaatagtgctcgatacgaagaagagccctctcgttatgaacatgatagaagtgcatcaccaagaccttctcgccgcaacgatagccctcgtgagcgcccaagaagatctgcatctccgagtggcaacactcacgtagacagccgtcctcccaagggagatactcgaggtgcacctccggatgatggtgcaattaaccctggatctaacttattcgtgactggtatccatcctcgtctctccgagcaggatgttacacgtctgttcga

SEQ ID NO: 93017 - DNA, 434 bp, Triticum aestivum
  unsure (1)..(434): unsure at all n locations
  Clone ID: PAT_TA_93017
gtttatagctttggagtgctggttctagagttgttcatgggacatcatccaggtgattttctttcatccatggacaacaacagccaaagtacatcacttgtaaatttcctggacacccgactcccacttcctgaagctgaaatcgcccgcaaaatattcaaagtaatttcggtcgcggtttggtgcatagaacctgatccggcacaccgtccgactatgcagcaagtgatcaaggcgttctcaacagctgaacagtcacctgctaacaatgttaattatctccacacggccattgtcatccccgcctgctggtcctgactcttgaatgttcattcagttggcacactattgtttcttcctatgattatacaagagactgtctgtatgacataattaacctgtatggtaagtttgttttctgcattatgctcatn

SEQ ID NO: 93018 - DNA, 476 bp, Triticum aestivum
  unsure (1)..(476): unsure at all n locations
  Clone ID: PAT_TA_93018
ctcgtgccgaattcggcacgaggtcggcattatacggggtctacctcttggcccaataggcatggcctaaacaccagaaaaattacaaaaaaataagtacaatctgccattacagtactgaagatattacatgggcaagatcccagccaacatgcagttctttgctgtgagcgaccaagagcagtgagctcatggacggctccaacttgcgaacgagccaccttgtcagtacttctctatcgccttgggaccaaggctggctatgcttggaccgccgaatctgtggctgtgaaattatttcttgctggtagttagtntgtgaagcaagaagaatcaaagttattttaagcacctgaatgnttgtgcatggaaagctcatggctgggaataccttttagnctgcaataattaacaccacaaaataggcttcccctggaatcacacccaacagggaanaanaacnatnaatccccccn

SEQ ID NO: 93019 - DNA, 431 bp, Triticum aestivum
  Clone ID: PAT_TA_93019
attaccacttggtgtgtaaagccgaatcccttgtttccccttcttcttcttcttcgctaatccttccccgttccgccctgaaacacacgctcccgtgccatggacgcagggagcggaacctagttccggcgccgccccatccctctggcatccgcgccgctactcaccccgccccaggacgctgccttgccgttcccgtacaccaggccgcacgaccaccgaccgccgtcctctcccgctcgagcaccgaccgcagcagcccatctctgctcgcgcacaggccgccgccgcccctctccgcttgagcatcgaccgcagccaccctacccactcgtacaaaagggaaaagaaaatccctttttcccatcgccgccgcctcctctgatctatccacgcaagccctctgccacgtcccccccaggggaagacaa

SEQ ID NO: 93020 - DNA, 448 bp, Triticum aestivum
  unsure (1)..(448): unsure at all n locations
  Clone ID: PAT_TA_93020
ctcgtgccgaattcggcacgagctcgtgccgaattcggcacgaggcccttctaacataaagagtattattatccaattatctatcaattaataaatatgaaattcccaatcagtcttgcaacacttgctatcagcactgtggcatccgcctactgtgtaccgccctcaccccaatcatccatagttgaaggacaacagttcatttcangaaaaacttanaattcctggccaaaatgagttgcaatattgttcaagtcaatttaaaagaggtcccatcaccttttctgatgtatcgactaagccaagggtgccagtggttaaccagccttttgaggtggacatgaagggtactctccacgttcctctgagtangccgggcaaaaattcgggtttatgatttgaccactgattatgatctcacggnaccaatcgnctttctcacgttatn

SEQ ID NO: 93021 - DNA, 439 bp, Triticum aestivum
  Clone ID: PAT_TA_93021
ctcgtgccgaattcggcacgagctttctttcacttttcggctctgagaatcttttcaacgaattgctcattgtcaccatcaggattcacaagcggcggtggttgctcgtctaacataatttgagacggaagggggttttgtggatctcgttttaacaaatcgacgtgaaatctcggatgtatacccgatgggacatcaagttcgacgacatgaggggatataactttgaggacgcgatatttggcgttaacccatgacagctttttactaagttgtggcgtctcaatattttttagttttaaccaaacaaggtctccctcttcaaacctctcttgcggaagcctcttttgattagatgctgattccattcgttgttggacaaatgccatggaagcttgtgcatattcctgtccatctgttattcgctgtacaaattccc

SEQ ID NO: 93022 - DNA, 629 bp, Triticum aestivum
  unsure (1)..(629): unsure at all n locations
  Clone ID: PAT_TA_93022
ntnnnnaagcttatnnaatanccgtcnaacctccncagggggggggccgggtacccaaattcccccnaatagtggaggtcgtattnacgccgcgctcactggggccgtncgtttttacaaannttcnntgaactggggaaaaaacccttggcggtttancccaaaccttaaaatcgccctttgcagncaacaatccccccctttttcgcccaagctgggnggtanataanccgaaagaanggncccggcaaccggattngcccctttcccaaaanaagtttgcngcaaagcccctggaaanggggcngaaatgngggaacnccgcccctggttaanccggggnggcaatntaaaaaccgccnggcggggggtggttggggtgggttttaccgccgccaangcggttgaacccgccttaaccaccntttgnccaagcngggccccttaanncggcccccgcctcccctttttcggcctttttctttcccccnttcccnttttcctncgcccnanngntttcggcccgggggtttttccccccgtccaaagncntctaaaatcnggggggggttcccctnttaaggggntttccgnattttaattngccttttannngggaaccctcccan

SEQ ID NO: 93023 - DNA, 465 bp, Triticum aestivum
  unsure (1)..(465): unsure at all n locations
  Clone ID: PAT_TA_93023
ctcgtgccgaattcggcacgagcctccacgacctcaggccacctcgcaacacgccttctcccttagcaatagcaacaggttctcctccagcttcatcgactctcacggccacaacaacaacactaagtaggtacccttccacgagcttctccttctctagcttcgacgagtgtagcctacccgacgccgccacgtggccatcaggcattggatcatacctgggctacggatcctcgtccggcacgtcctacaacggccccaacaagggcacattcaaagctgcattgagcagcatccatggaaggcaacaaggctcagcggcatcgctctaccagccagtgcatgtgctacagagggcggctgagttgaagaagtggtggcacgaagcacggcggcgccgatcatgctcactgatacgatcgccaaggtgattacctcgaacccaggcttccacacngcgcttgg

SEQ ID NO: 93024 - DNA, 450 bp, Triticum aestivum
  unsure (1)..(450): unsure at all n locations
  Clone ID: PAT_TA_93024
tcgtgccgaattcggcacgagctcgtgccgaattcggcacgaggcatggacgaagcatcggtatctgtttccaatcgccctttggnccagagcttgccggcctccatgcaaacgtacatttggcatgcgacgctaccacttgccatcacgcatgcctcttctgttgtgccctacctgcttcacgtgccgcgcctttcctacctaccactggttctaccgcgactcaacctcttctttgggcctggcatcgttggctccagcttctcgcatcacggccgcgccctgcctaacctacctatcggccttctctttgatatattcgcgccccccttaccctgggccctcgagctgggcaatagcccggtatatgagactcatgatacatttatcaatagcctcaaagaagctgactttgtgcgcaatggcacggctagggggcgtactggccna

SEQ ID NO: 93025 - DNA, 466 bp, Triticum aestivum
  unsure (1)..(466): unsure at all n locations
  Clone ID: PAT_TA_93025
ctcgtgccgccatcatccgctcttccttctccaaagattacatactgaaaaccgtcaattcgctgagccccttccaacacctcacactccgccgatcctcagtatgatggaaatcgatctctctcttaattccgtctcgctggtggctgctcttggggtgtccgcatatcttgtcgaccaatgcattactccgccaaatcctgcaccttcggcttctatcgagtatggcaatgattccatgcaggtcattcacaagttagagcttctccgcccgtgggcgtttcttgtttggtttctccactacgctctcattctctttccccacaacagagaaagtatttgcctgaacccagatctgcttaacgaaggacctttatacctggaaataaagacaacanttatatatattttggtgatcttagtgggctgctaccaagcagagtcgctgcctaatggcccaaacttt

SEQ ID NO: 93026 - DNA, 449 bp, Triticum aestivum
  unsure (1)..(449): unsure at all n locations
  Clone ID: PAT_TA_93026
aattttgtggggttcatctctcgcacctaccaaggcaccaaatctcagaaagaaaacttatggttagaaacctaatatattaaaaggcaagagctgccgtttaaatagttcaaaacctttatggtgacacatctttcacgatgataggtgtaccaatgccgttgttttctcgcgtacaaatgttccaactttctaccaagcgcgtagctttcaaaataacaggtcagatcttacgctgtattaattcagctcctcctcagtctgcaatcgtatcaccaataaccctaactggcttgccacctttgccaccacaatctttatcatcaaacaatgaggaagcaaaagctcgaatcctaaggcgtagggaacaggcccagattctcaatcgcggaactaattctcaactcactgccaacgaagggattaaagggcggngattctggaaagaa

SEQ ID NO: 93027 - DNA, 476 bp, Triticum aestivum
  unsure (1)..(476): unsure at all n locations
  Clone ID: PAT_TA_93027
ctcgtgccgaattcggcacgagatcaacatggtcaacctcaccactcaaaagcgcctggcagcttcagtcgctcgctgcggagagcgcaagatttggctggacccgaatgaaatcagcgaaatttcaaatgccaactctcgacagactatccgcaaattaattgccgatggtctcatcatcaaaaaacctgtcacaatgcactcccgatctcgggcaagagagcttgctgctgcacgcaaattaggaagacatagaggtttcggtaagcgaaagggtacagctgatgctcgtatgcctagtcaggtagtgtggatgcgccgtctccgcgtccttcgccgccttcttgtaaaatatcgtgccagtggaaagattgacaagcacctttaccacgaactttacacttaagcaanggtaatacttcaagcacaagcgggcaataatcnaacaaatcatcgcgccaaggnaaagaaagcac

SEQ ID NO: 93028 - DNA, 475 bp, Triticum aestivum
  unsure (1)..(475): unsure at all n locations
  Clone ID: PAT_TA_93028
cttggaggtgaaggnacaagctggactgactcggtggaacanggtaccacgtcggcttttaaagtcggcgtggttacctcaccgtcaagaacctaaggntcttgcggattatccaccgaaagaacaagtccagttgttcctggcaaacttgtactttaaagcatcggataggatgattgaagtcttaaagagttcaaccaacccttatccgatgattcaaagatggttagatactgccgatggtgtggttttaccttatctacttgaagtagaagaggagccagaccaaaaggtagtaaatgaccttacaaggtttgccttaaaaaactgcgctaacaattacgctcantttatatcacgacttaaagccgtgaagaagctgattcgtaagggnagtcctccctccaagagggaactccctgttaatgaagaagacaagggtactttaccctcaaagtacttcccgtgcttaatg

SEQ ID NO: 93029 - DNA, 469 bp, Triticum aestivum
  unsure (1)..(469): unsure at all n locations
  Clone ID: PAT_TA_93029
aattgnatcacaatatgttgaaaaggnnacaatagtctttttgcatgggaatacgtgtctcattcacatcataaagaacaaagtncaagtcatgtnnagaccgncatgacaaaactgaaaagatagcagaacatctctgagcttganancaangcccgtcacctgggctccggnaccaccatannagccacccgnggaaaagaatgacaaatcacctcctcacctgagntcgacgcggntccatcgctgatatacagctttgcgggnccttcaaggggggtcaccaaaagtgnagcccttaccgttgnacgatnanaccgggggaacancccgggcaagccatcgaactccagatntatcaacccaccacgactaaaacaccgnaggggggaaacatatctgccatccatgaancacgagcctagcacatgctccgtcttctanatgtcgtcggggnagaacaaaatct

SEQ ID NO: 93030 - DNA, 450 bp, Triticum aestivum
  unsure (1)..(450): unsure at all n locations
  Clone ID: PAT_TA_93030
tgcacactgagtgcctgccggatttgatcaagcttgcctgcttgttgcctgcaaaagaggatagcttaagaacagtgatcacaaagtacctgttggncgtatctggacgctatggaaaagattatctcgagcacattatgttacctgtatttcttatagcagctggtgatattgatagcggngattttacctattttcctctgtcaatccaagtccaaagttcgtggnttccgtccgaaaacttctgttgctgaaaaaatcgctatcatttgtgttcttccattgctattgtctggtattttgggttctccttcaagtcgtcaacagttagaaagaatatttaaggaaattacttatccaaaacacgaaggatggntcattttctatgcatcacactgccgagatcattgatgcgattcggtttctttgcatatttgaggagcaacaagg

SEQ ID NO: 93031 - DNA, 467 bp, Triticum aestivum
  unsure (1)..(467): unsure at all n locations
  Clone ID: PAT_TA_93031
attacgctgttccaaaaaccctgaccaaccgttgctttcgacaattctgccgacccaatatcacgcctctcggcataaatcgccaccttcaaatcacttcctcataccgaggtccgatcaggccagccatgacacaaacaggagccgctgggctcttgcaacgacagctgaaatacatgcaaggngcaaaagatcttcccggaatctcttgtggtcttttggaaaatgatatctttgtgtgggaagtcatgctcatgatttcggatgactgcaagtactatggnggcggnaacttttgctgcttactggcatttccgtccgaatatccgctcttgcaaccaacctcaccttccgcaaacccattcccttccaacccaaaatataagcanatgggcgcctttgtatctccaacttacatgcaaccggggtgaagattaatatgggtntgaaaagtgcaacggggcgcc

SEQ ID NO: 93032 - DNA, 489 bp, Triticum aestivum
  unsure (1)..(489): unsure at all n locations
  Clone ID: PAT_TA_93032
ctcgtgccgaattcggcacgagattgcctcctcgtccggcgttaaaaagcagcctcggctcctccgcgcatccgaaccgagcctcgccaccatgatctccccgcgccccactctctcctccggcttcttctcccgctccgcctccttctcccgccccggctcattctccccctcgccgcctgcctcgccggccgcgcaggcgccgccgcggctgctctcggccccgttcgcgcgccacgccaccttctcccgctccgcctccgccgtcgccgcgccgggccgcggggcctcctcctgcttgtangaantgctcggcctcnacgccggcgcgagcgaaggggagatnaaggccgcgtancgccgcctggngcgcgccgtcaaccgggaagtgtnnccggacccnccngcgtnccgccgaagaacttcatanggggtggaaagncggctaaaagaaggttcttcggnncccaaacaaagcggcggccgant

SEQ ID NO: 93033 - DNA, 488 bp, Triticum aestivum
  unsure (1)..(488): unsure at all n locations
  Clone ID: PAT_TA_93033
ntcgtgccgaattcggcacgagcttcagctcanaatctttacagcagcttgcaataccatccataagaaaatacttgagactcccgcacggntcctacaattcctcactttttnaacctcaattaaaccgagagattaaatttagcaataaatcaagtcatcccaaaaaaatacaagaaaaatttgttatacacgacaacagcagtatgaagatcttcagtcttgttacattggnagctattttgaactgtttgacgcctgtacttgctacttcaaactatcaatgtcacaataaggntcttggngcgcaatacataaatcgtgcagttgcaaaagaatataatcgtctgggacaaaatcttggtataaaatacggggccagagaacaaaatgggcgtaggatctttaacaattactgcaaattancaatcaagacctcaatttcggtcaagagtcactataggngtttacgaaggacaaaaagaagt

SEQ ID NO: 93034 - DNA, 248 bp, Triticum aestivum
  unsure (1)..(248): unsure at all n locations
  Clone ID: PAT_TA_93034
cccagaataaacacgcgacgcaacacaagcgagatttccccaattcctgctccttgcttctccctcacgcacgcacgggataatcttncccctcccccccaaatccgctttattagcccgcgccccgatcgaaaatccanccgccctcgattccccccgccccaagcactccgcttcctcnagctccccgattccttctttcgncgcccagnagncccccgaatgcgccggctccatcccgccgggac

SEQ ID NO: 93035 - DNA, 468 bp, Triticum aestivum
  unsure (1)..(468): unsure at all n locations
  Clone ID: PAT_TA_93035
gtggagggtgttggcgctggggaacaattctatttgtctcatctacactagctagattaaccacctagctagaacctgtgatgcctttatatgagacaatatatatatattccctacaaagttagcactgggctagctngctttggtttggcaatcttgatcccccagctcacgtcctcacagtgccgcacatacggcaccaccttccccacatccacgtccctcctcgccgtgcagtcataantangacggtgagtggaagcacggctcgacggacatcgctcgcacacacggtggttccggtacctcctttttctcaaccaagtcggactcggaccaaatgggtgtgctgggcatgatccacggtcgtatcccgccaagcccctgcgcgacgtacccgaacgtcgagaagccggtggtgacgaacacgtcgcaggtgctgagcaagtacatctcactcaacgcccc

SEQ ID NO: 93036 - DNA, 472 bp, Triticum aestivum
  unsure (1)..(472): unsure at all n locations
  Clone ID: PAT_TA_93036
tcttagcgccagtgacagccatggcaattcaccagggcccagagctaatagcagcgcccaaccgaaatagtgacttcagcttttattgtcgaagtggaaagtcgtacaacaaaaattatctcatgggagaagttcgagatgccataaatctcattggcgaatctagaacattccttattcatcctgaacctttcgaagaagttcagtaccaaatctccggagaacaatggttttatcctcttcaagcgtactatggctcacgagatcatgtcgtgttcacaagagacgcacaagtcgcgggcgtggntcacctcatgatccgtgataatggngagcgatactacgatccctgtattataacataagtaattgcctcccaacagatcttcctcaaatgtattgttatgacccaaaatgttgntaagaattgatattctacagtttatcaaaatgtttaacatgattcaattac

SEQ ID NO: 93037 - DNA, 394 bp, Triticum aestivum
  unsure (1)..(394): unsure at all n locations
  Clone ID: PAT_TA_93037
aagaaaccctcgcccccctcgcctcgccggcatgggcagcgccgcctcgccgccgcggggcctcgangcggngangcangaggacctcaancgcgtctccgcgcaccgcgccgtntanatggtggagtccggcatgannctggggctcngcaccggntccanggncgcgcacgcgctcgancgcctcgggggcctcctccgcaccggcgcgctgcgcgcggtcgccggggtggccacctccctcaanacagaggagcacaccgcgcgccgtcgggatncccatgctcgcgntcgccgacgccgncggaatttanctctccanccnacggggncgataagttcatcccgggncctnaanctcntcaaagggccgnggnggntctgctcctccccg

SEQ ID NO: 93038 - DNA, 418 bp, Triticum aestivum
  unsure (1)..(418): unsure at all n locations
  Clone ID: PAT_TA_93038
gagaaacagagcctccgattgccctggtctctcccaaatcgccgccaccaaccgtctcgtctccctcctccgccacacctcgccgctggcccttctccttccaacctcccatctcgcaaccccggaggctaccggatccgccgcacccccacccacccatccctcgcgcgtccaatttctctcttctcgcggctcctcgttgcgccaccggcggtggctgattccggcgacgttcggccaatcccgccaccgcgaaacacatcccgtggtcctctcgcaccgcggggccctcccaaccacctagatcagcacctgcgggcaccaaaggccaaccgcgaacctcccaccgggtttcgggcgtcggctccggngccggtcgccaatgtcgtcctcgtctcaaccggtgagtggatcccct

SEQ ID NO: 93039 - DNA, 604 bp, Triticum aestivum
  unsure (1)..(604): unsure at all n locations
  Clone ID: PAT_TA_93039
tttaangaattttgatgaattggntatcgacgaaatctcttgtctcgaaaaggaaatgtcactggcttccataagttgccaagtcttatatctcctatattgaataattcacagaagaattccagcaaacttggtgttgttgacaatggaacaacgtttgtcgaagtcatgcttggntnaaacaataatatggcaccaagaagcgcatcanaaagaaagcaagncatcctatgtgcatgctatgattgctggaggcttggtggnacgactggcgattttttgatgcattctttggntacaagtcaaaacgcgtcaacaangngatacgcatactccgccaaagtacacttcaatgtcatcttcanactctactattttgaggnaagagggnancanaagaagcttatacnggggntggggtccagctctcctgggtcaattcctggnactgtnanctctntggaacgtatgagtatagcaaaaaaaanatgattgtgccgggattcacacanatttccaaccnatgangngggtttccngcggaccttggccgcctcaaatgtgttgttcaacaaaaattccaaaaaccnnttaaagcttcagg

SEQ ID NO: 93040 - DNA, 678 bp, Triticum aestivum
  unsure (1)..(678): unsure at all n locations
  Clone ID: PAT_TA_93040
gnggcgctctagaatatggttcccgggctgcaggttgaaaacggcgttaatacagctgcagcgcacaanaatggnggggctgtatgagaaaacgtcggagacgtacccaagaagcgggcgcggtacccaangagtggttctccatgctcgcctccctcaccgccgggcaacaangcgcctgggaagccggctgcggnagtggcaagcttccgtcagcatcgcggagcactacaacggnttgtcncgacggacgtgagcgaagggcaagtccgccacgccatcgcgcaacccaaagtgnggtatctgcacacccggnggactcccggnggacgaactctccccctggtcggngggganggtccctgnanctggtcatcctggggaacgcgatcantggttcgacgtcccgctcttctacnccgtggtgaaacgcgtcctcangaanaccggcggggtcctcnccntgtgggggtaaaactannacatcaaccnttcggggacaaactgcacnggacgctgttcccggcatgcggcgtcattganccnagacaagntggcatgancggtacncaactgcgttccttcanncctccggtggcgcaaggnagccgcncctcaattagggggataactggggactgncggtttatacggtctccncaccntaanganaaaaga

SEQ ID NO: 93041 - DNA, 242 bp, Triticum aestivum
  unsure (1)..(242): unsure at all n locations
  Clone ID: PAT_TA_93041
ctcgtgccgaattcggcacgaggtctcgagtttttttttttttttttttacgttacttaagtcatttatttttgacaggctactattttctgacaaaatattcagtttggtgatatagcgaactagcagcggataattgtttcgaaccaaaaatttgttnccngggacgcccagagannccacgttnatcttcanatcactcaaaaaaacgcccagnagcaanacctgacaantcaatctat

SEQ ID NO: 93042 - DNA, 477 bp, Triticum aestivum
  unsure (1)..(477): unsure at all n locations
  Clone ID: PAT_TA_93042
ngaactantcacaaggggttgttanaagcanaaatnagccaagagaacttgcgggtaaatccaaggngatgggggnccctcntaagttcanctacaatgctttgcgtgnttcntcncggntcaaaccgatngaagtaactcccgatgatcgcatgtctgcgtccgaggnaagcgctatgctgggtangatacacntggagatgggagtccaagtggtgggacaaaatncggatgagctggntcttggnggatttgataaaagnctccggntctgccataacgtgaatggnagttccgttttggacccaanaaaggnaacttttcaaagtgcctggggtgactggttgcctttcngtacanccaagtactgaacaataatgggcccgaatcctcntcgcttcctcaanancggtacgggnggaagaaatcaanggngtacaataaagggaatcctgncgaaggnaatgattcctgcnn

SEQ ID NO: 93043 - DNA, 303 bp, Triticum aestivum
  unsure (1)..(303): unsure at all n locations
  Clone ID: PAT_TA_93043
ggntttcggtcacgttttcactgatcacatgctctctatcgagtggnacgaananacangctggntctcgccacgcataactccctaccaaaaattacagatagaccctgcgggctgtgtacttcactaacgcatcggaatgtttccaaggnatgaaagcctatcgagataantctaatcgggntnaggntctttcnacctaccaagaacatggngcggntgaatcgctcnactgctcgaattgcccttccggncttcnaatcggnanaaaagattgaattaatttctaaactgggcaagctc

SEQ ID NO: 93044 - DNA, 480 bp, Triticum aestivum
  Clone ID: PAT_TA_93044
ctcgtgccgaattcggcacgagccagcactcaccagcctttctttcctagacatcaatttagctgaattgacagaggagggtctggtcactcttggagagctcccagctttacttcaccttgtactgtggtttagaacaagacctgatgatagggttatagtccgaggattcccaagtctgaagcagtttaccatctatagtaatgatgcgtcagcatacgtcacatttgtcaaagggtccatgcccaagcttaagaagctggatttgcttatcaatgtatcaacggcaaaaacatatggcttccatttaggcattgagcatctcacatgtcttaaacaagcaacggcaaggcttgacaataggggcgctacaccttccgagagaaaggctgcaaaggctgtgatcaaggttgaagcaagtgccatccaaaccatcccgcagttactatttgtgatgaataacaatgttctcaaaaagga

SEQ ID NO: 93045 - DNA, 214 bp, Triticum aestivum
  unsure (1)..(214): unsure at all n locations
  Clone ID: PAT_TA_93045
ctcntgccgaattnggcacgancaacatcgtgaggntgctctgctgcatctccaaccatgangtgaanctgctggtctaccaatanatggagaacggnagcctccaccggtgggtgnaccancttnaccgccanggngcgccngcgccgctggactggncgaccaagntggncanccccatccactccgncaagggggtcaactacatgcanca

SEQ ID NO: 93046 - DNA, 214 bp, Triticum aestivum
  unsure (1)..(214): unsure at all n locations
  Clone ID: PAT_TA_93046
agctcgtgccgaattcggcacgangnctcctcctancaagctatatacctacatagtanagccatggnccccaccntgatgggctcgtnngggcanctccgtcgctcctttcnatgggntcaagtccancgccggcctccccgtcanccgccgctccaacngngntagcctccgcagcntcancaacagtggnaggatcatgngnatgcaggtg

SEQ ID NO: 93047 - DNA, 418 bp, Triticum aestivum
  unsure (1)..(418): unsure at all n locations
  Clone ID: PAT_TA_93047
ngcacacctcaataactcagtcangtaagtgtgcacgcgcccatctggccatctcctcccgcctcgtanaaatactcgctcggccggngaacgatntatngngggcgcggcggcgctgggaacggagctgctgnaggaggcgcgggcgccggggttctcngcgtggctgcgggggntgcgtcccanatnancaaaaaccggagctggcttncanganaaacgcaactccgcgctcgtgcgcgccgagctcgacgccctcggggtcncctacgtctgggctatcntgcgcaacggcgtcgtggcaacatctccngcggtgtttcngggcccgtgttnnntctccggggcgatattgaagcgctccccatccaagaaattgtggggtgggagttnaanaacaaaggaagnggggaagatg

SEQ ID NO: 93048 - DNA, 334 bp, Triticum aestivum
  unsure (1)..(334): unsure at all n locations
  Clone ID: PAT_TA_93048
ccgtgccgaatcggcacgaagtgggcatctgtattcaagctggagtacaatggncaagctgcttgtttagcacaatctccccnnttatacaagcagatgagcatctgtggtggtttggccgcgngtttgaggttgggcccgtccttacagcanaaaagcaaacactcacaggcancngtgtgagtttattgggtgggntgctgagatggagatcaaatgagcactaccttgnggnttgtgagatcatacatggcntatttgttcaatantcaaacacntgaatgaaaantgtcagaaagaacntgtgacaataaataagcagtanccatttgta

SEQ ID NO: 93049 - DNA, 207 bp, Triticum aestivum
  unsure (1)..(207): unsure at all n locations
  Clone ID: PAT_TA_93049
tttttttaaacagaaaagtaactccgttatatattgccgatcggntcggaccgggcaaatctgaagtaaaaaaaaaacactggctaaggatctcctttaattttacaggattgattaaaagttgccctagaaaccaatccaacatgcaacgtaacaaaagagaacattggactgaanctcgtgccgaattcggcacgaggggggggg

SEQ ID NO: 93050 - DNA, 766 bp, Triticum aestivum
  unsure (1)..(766): unsure at all n locations
  Clone ID: PAT_TA_93050
gggcgctcagaacagggtcccgggcgnagaatcggacgagctcgtgccgaatcggacgagtttttttttttttttttttttttttttttgactgtatatgangaaatanacgggcaaaagtggacaagagggcttgncatgccaactaatattaagcggtattttaactattaagtttanatgactttgctggnagcaaatgtttatattaagccaatagactcnctatcgttctatcacgccaataattgaacatcnaatccaatgggacgcatgaaaagatgacatttgcgagccgctggctcgatactgcaggggaaagagtcctagccaatgtgacaaattccaaaaaccgatccttgcgggnatgacnaaacgccgntgttgctctgcactagctccnangccaactgcggggaggaaatgcaaacaaaaanatcctcnccagtgctgactgtactgggaaaatantggtantgtcggtcaagcgtancaaaaaatcnantgtagataaaaagncaatggtcccaatctgcggtcaaaaactgtncaaantgtntgtggcccaacncaccnanaaacanantagcangcgngaacnaacccngtcgggganaanatcatgnggantggtacaagccangatcctggacaaaacaaaccggcccatcaananngaaaggggggggcccngaaggaaaattnanctttccacncatatgngncaattccactgnaaatcctgntacanaaaggggcnggggng

SEQ ID NO: 93051 - DNA, 606 bp, Triticum aestivum
  unsure (1)..(606): unsure at all n locations
  Clone ID: PAT_TA_93051
gcgcctagaacantggtccccgggctgcagntcgtgccgaatcggnacaagagaacaagcccnagttttttttttttttttttttttacatacactcgatctttcncacancaaagagcancntacatagtgcaactgtgctantgcaatacatggctttgataaattttccaaatcgcctgaatgatctaactagtcccgtccaatgnacagcctanaatgtccttatctgggtgggttcgtgaagtgctgtcgtctggagaaaaggcgttgtggtgtgtgcggtcttccggcaagctctggctgtgcgcctanttggntcangcccgcttcgcgggcgttcaaatggttgnggngctgntagaacccctggatcccgcgaagtactccctgacgaancctgagaaatcaanagntctcgtcctcantaatcctgacggggtgtcgtaatcnanaaatctccctccgctgaagacaanaacaaatcactgtcgaaaacnggtgaaatcgtgtgcnacggcaagcaccgtgnatcccaaaccccncacggagtgtttgctggataaattgaaccgtanatagtcaactgaaacaattgccccgnca

SEQ ID NO: 93052 - DNA, 757 bp, Triticum aestivum
  unsure (1)..(757): unsure at all n locations
  Clone ID: PAT_TA_93052
ctgcgctaatcattcctttctacattggcctgatatttcgagttagaccttctggtcctcttgtctttacatggcangttgtacaatcctccacctttttgactatcatcaagacccacgagccaagttcatgtcctcgaggcactgctcatgtatactacctttatagatgaaaacaattttatgatagaagaagagaagaattggcaataatgctggaagaatttattaagatcacagtctaagcgttgggtatagacgccgtgacgggnatccgagcatcaccacgctgtagcgttactttgaccttcttgatactggnaccgtttctctcgagtctctccatcactctccgtcaaatcttatcactgatatcctccaagtgacggntagatatctccgtagaattcctaacacttatttaattctatacgaagcaagtttttgggtgttgaaaaattaaattaattggttataatantctcctactagctacacgcactcccaacagacttgttttattttgaattaatgcacttagcctcacaacttcaatangnagntgaaaaaaaaaaaaaaaaaaaaanncnaggggggccggnaccaaattncctaaaggggtcgantaccgcgcccacnggcgtcgtttanacgtcnacngggaaaaccggggnaccaattaacncctgagaaanccccttccagngggtaaaaaaaaggccaccgnttcctccaaattgcaccngaaggganggng

SEQ ID NO: 93053 - DNA, 634 bp, Triticum aestivum
  unsure (1)..(634): unsure at all n locations
  Clone ID: PAT_TA_93053
agcaaaattctatccacacacgtccacagatcacaacaacttaaactaactcacatttttaagtaaacagccatggctcgtactaagcagactgctagaaaatctactggaggaaaagctccacgaaagcagctcgcttcaaaggctgcacgaaagagcgccccatctaccggtggtgtaaagaaacctcacagatacaagcctggtactgttgccctacgtgaaatcaggagatatcaaaaatccactgaactcctcattcgaaaactacctttccaacgactcgtcagagaaatcgcccaggacttcaaatccgatttgcgatttcagtcatccgcaataagtgcacttcaagaatcaagttgaagcctacttagtatcactctttgaagataccaatttatgtgctattcatgctaagcgtgtgaccattcaatccaaaagatattcaactagcccgaagggtaagaggagaagcgctcttangaacataatanagcatatacaacggatgaatggngntaatgagaaagggcgtgggataataattgagggggatttcgnacaaganggaccttangggtatctaatggngntaaggggtgncaaaccggaatcactgtgggagactgga

SEQ ID NO: 93054 - DNA, 589 bp, Triticum aestivum
  unsure (1)..(589): unsure at all n locations
  Clone ID: PAT_TA_93054
ggtcccgggtgaggtcggcgatcggacaggaaancaatcaaggtcattatctgcatctcccgcgagacagnctcatacagacactgttaagtcaattgtcaaacnacacactcgaaatgattccactctgnacaacgangtggcggcctactctggactgcgcnacggaaaggtttacatgtatataaaaaaattacttcagaaatancgtaaananatatgtactgtggnaacaggacatagaaccatgtccttgagtgcnccgtatcacatgaatcgagtaagaaagaaaggaaantaaagaaatggattagtatatgcagtactaaaaatacactgttagaatgggtggtcanctgggacatgcatacacgaaantacaagctcnaatcngtagttgatgaaacaatatgatggatgtnagaagngattctcatactagngntggtatctacctgnaagccaatactgcaaggtagcncaatcccaangtttaaaaaaaaaaaacccagggggcgacatcncaaggggcttnccncntgcgcgttaacggtggaaccggtcantaccctgaaaacctcagnggaag

SEQ ID NO: 93055 - DNA, 796 bp, Triticum aestivum
  unsure (1)..(796): unsure at all n locations
  Clone ID: PAT_TA_93055
aaaatagatattttgattgccctcaagtttaatgatgacgatgaaaatattagtttttaatgggctgatgcctttcagctcattatatcttataacaccctacaaatccgagaaagaaagtgcccaatatccaacctagctcaaacttgaatcgcatttaattacagctctctacatcccacgaacctcggccacttaataacaacctttctacttccagtcatcgtcatcatgaagttcctatattctgcttccctgatgagcctatttaccttggncttatcaaaatgcaaatacgtgtgcccgggcggttacgaaattaccgaagaaaagttattagtcgtaaccgataaggtcgaccggaancccaagaaaaagcacgacacaatatggaagaccgaaacttcaatacacgtcatgttcgatctcgagaaaacgaagattaataacaccgaatatttaatcacaggtcaaatttatacaccaaaaaacataacctggttatatgagactgagantgagaccggcaaaaaaagctactgcgacaatntcgaagtgaacgaagaagacgaacnttcctatgatgaatccttcgagnagaactttccatgatgaaanctgaaannaaggttttttcgatgacgaattttgagagnagggccnttccgtgatgaatctgaagagggcctttccggctaaatcaaactaattagcccccaattttctnanggganttgcgggaccaaggttntttttgggnggaacctcaattaaaanaaaggttgtggganagtng

SEQ ID NO: 93056 - DNA, 530 bp, Triticum aestivum
  unsure (1)..(530): unsure at all n locations
  Clone ID: PAT_TA_93056
ggcgtcanatatggtcccgggtgaagncggcgatccgacaagttaagtgggcggaaatactaantaaaagtcggcgcaatacctgccnagganaagcngtatgagacacaaccgcaagggnntcaatgatcaagaccnacaaagcacaatcaattctcaaattgctagatacaatgggacgcatctaacaatcnagaactatgaacacaaggtgcaattaaaaagctgtgggccaaggaacgcnatgncaaataataccccatggatgggagaaggggatcnnataaaactccccccaactaaaaaanaccttcataaaagnagtctaanttccagcacgtggacttcnnaaaatcggncttcccaaagaccctgaatnatacatgttgaaggttgaatganccaancnatgggngatgnagtngataacacattggcactgatcaaaaaccccgttgaggtgtcccggagccactaagaaccgcccnaaagnaagggagacccnacttngggcccttgtcgggggggac

SEQ ID NO: 93057 - DNA, 457 bp, Triticum aestivum
  unsure (1)..(457): unsure at all n locations
  Clone ID: PAT_TA_93057
acaactaatgctgacgctggntgnctaccgacgcgaaggtttgacangaaaggactanattaaaacgacatttanaaaaattcagaanagccctgctttcttcactaatcttttantccncgcgcgaggtgtcgtntcccaacgagcctctctctctccggcgcgcctcacttcagngataagtcggctcggtccaccacaccagcggcggggtctgtcggagaangaacncccgcacngctccnccgtcgnccangaanccacgtctcngtcctcctccaccttaaagaaantcccgngcaggaaagnatgnccntgcgccggcncagacagccgcagntgacggangcaccnggncncgcaagcagnntccccangtctggtnccgnagctcnccgntggtgtacgcgccaggcgcnngcgtgtcngttaanaacaccgctcgagcagctgtctg

SEQ ID NO: 93058 - DNA, 325 bp, Triticum aestivum
  unsure (1)..(325): unsure at all n locations
  Clone ID: PAT_TA_93058
caaaaannattcacgtgccgngggggcgnacaaaaantngtcccngggtgangaatngnacagccgggcgctctgacgacntcgtgacccggggagaggacncagtgggcgcccgaccggnagganangttcgtgngccgcttcnccnacgcgctcncccgccccaangtnaagacacgatctccgcgtcatctggatcgacttcctctccaatngtgacaagtcntgcngcatgnangtggncaacctctcatcgtgancccaaacatgtgatgtggatggatgatggatggaccgttctgtgngtcnaccttgtgctatatat

SEQ ID NO: 93059 - DNA, 471 bp, Triticum aestivum
  unsure (1)..(471): unsure at all n locations
  Clone ID: PAT_TA_93059
ntcgtgccgaattcngcacgangaaagcacacgtactcgcatccatcacactancttgcttancatcgccacctgctcttataatggggggctactacaacggcggnggnaggagcatgtcctactccaacaacgatgagtgcttctatggnggnaggncgatgtntccaacaccaacgacgactgctangacgccggcaagcacgggcacgggcacgggcatggcatgggcatggcggggnaaacatgtangctaacaccactgactggagtgttccangactccngcaagcacgctanacgtggtggnggnangacatgtttccnacaccntcnaccaggagtgttctctcccgcaaggaccggcatgggnacngcacagntacnggcacaaaacngtangggcatgtctattccaccaccaccnaagagtgtttntggggggaggaaggcaagggttctataataaag

SEQ ID NO: 93060 - DNA, 509 bp, Triticum aestivum
  unsure (1)..(509): unsure at all n locations
  Clone ID: PAT_TA_93060
ccatntgtatgatgaaaaaagccaacatnggtcggggtaaccaatacacactgtaatcataaatgtacaatactcaanagtgcaanaatttcagngcacggaagacgtccncctcagcataataaacaatgtccggtaaatgtggtatcatttcttgtaacgtcgcnagnacaatattgaggggancaagctaacntcagcagttactgaaacaacagaaggtaatagacttatggtatactgccaggcgtcgcggtnacattgtagggcngacaagactgcacgcatgtattgactgaatgtcaaattagtagccgaatngtgaggagaattaaaaaaaaaaaaaaatcaggggggccggaccaatcgccatatgagcnatacccccanggcgcgttaactcngctggaacctgngtacaantatgcttgagaatcccttccagtggnatacaaagcnacgtccctccaaatncactnatggatgaccccgngcggatacnggggggg

SEQ ID NO: 93061 - DNA, 202 bp, Triticum aestivum
  Clone ID: PAT_TA_93061
ggcgcctagaacagtggatcccgggctgcaggaatcggacagctcgtgccgtttttttttttttgaaaggaacatgatttatacagtgctaaatagtacacccctcttcactcatccatgtatttacaagcgtgtggtcgaaaataagcacgagatggcacaatagtcctattttttccaccccaaaaaaaaaaaaaaaaaa

SEQ ID NO: 93062 - DNA, 284 bp, Triticum aestivum
  unsure (1)..(284): unsure at all n locations
  Clone ID: PAT_TA_93062
gcaataaaaaggtgnagattgagtggttatgcgcattgttttgtatattgggcaccccnngcaatgtggcngtggaanacggaacttaacatgaggtggnnaagcatcnaccanaactcgtgcgtgtgcnaagcaacctgnccggtgngggtganagcaaagntaaggggaactgctnnggggtgcacatgngancaaaagaaaaaaangactgtgcgggggaaantggggnaatggcatgttgcacaacttnanaagtcagnaatcgannaccgaaatggggt

SEQ ID NO: 93063 - DNA, 272 bp, Triticum aestivum
  unsure (1)..(272): unsure at all n locations
  Clone ID: PAT_TA_93063
aaantcctcctccccgtcttccccgctcanatttccgaacggcgccccgccccgccccgccgagatgtcngngnagagcancgcctgaacgtggtgccgacggtgacgatgctgggggtggtgaaggcgcggctgatntgggccannccgggccangcgctgctcaanaaaaaatcgggcgcgctcacagtgcagttccgngccatcctcaaaaagatcgtggnaccaaagagtccatgggngaggggatgtgcgcntcctccttctctctt

SEQ ID NO: 93064 - DNA, 667 bp, Triticum aestivum
  unsure (1)..(667): unsure at all n locations
  Clone ID: PAT_TA_93064
gnggcgctctagaatagtggttcccgggctgcagntcgtgccgaantctgaaaaagctcgtgccgaattcggacgagnccagtcctagctagttcctcctcctccttcctcctcctctcctgatttgattggtagaatatctgttagntgcgtcacgaactcaaaggaacagagcattgttttgctatgctcctcctgcaactcgaccatgaanctaccaaaaaaggctagccgccgccgggcaccgcaagcaangtaccctccgccggggnagcancaaacaagcctacatngcnccgccgccgtccacgtanccgcaagaacaacantaacctcccgccggcgcgacacaacaaacgcgggggggcaaggacacagaggggacggttcntnanaagatgtgngcggcgctctgctgntgtgctcctcnaccctgcntctgatngagnttgttcaagtgtttctgaccgtcaataactcatgntaagnacnggaatataaattatcgtcangatcgagtttgtttantntcccacnnaacaatttcctgtgtttatcacgngcgntgtttttttcattccgtatgntcaagnaaatagcatgtggttannaatnaaaagntattctcttannaaaaaaaaaaaaaaaaatccaggggggggcgggc

SEQ ID NO: 93065 - DNA, 552 bp, Triticum aestivum
  unsure (1)..(552): unsure at all n locations
  Clone ID: PAT_TA_93065
cgagcaatgcatctgctgtaacccatttaattgagggtatttgaaagtaatgctcggtgcatccccagtggctgaaggatcccattgctagttccaaatagcacatttgtcgattttcaaggaaattctcggacgaaagcctcaagctcatcaacttgttccgcgcttaatttangtgggcatcttttgcgaggtataagattctcaagtctctcgagcacacgcaaattgcacttgccttcttgtgaaagcaagttcgtcgaatatatgttatgcctgcaagctttagtttctggagcaaacttttcnagagacaatgtgtgctagaataaacgatgaaattgataagtggtgttaattttcaangggcttancaaggataagacgattggnccaatcctcatggcgaacggggtaatgaggagagatantctaacctaatacgagctaacccaactgtgcctacaggactaaacccctaaatatcccanttttaagaataacaatttgggttctanaggnactgtgcccgtaagcccgggaaagcgcgat

SEQ ID NO: 93066 - DNA, 167 bp, Triticum aestivum
  unsure (1)..(167): unsure at all n locations
  Clone ID: PAT_TA_93066
tggattcccgggctgcangaatccgcacgaggnaatatattttcacaaaatcaatancaatggatnatcccatgtcgagcttaatttgtctcgagntttacaantttagagtantttctaagggagnntcccgcacttttcatctcatccngnacgggtagattaca

SEQ ID NO: 93067 - DNA, 560 bp, Triticum aestivum
  unsure (1)..(560): unsure at all n locations
  Clone ID: PAT_TA_93067
ggcgcctagaacagggtccccgggctgcaggaatcggacgagtgaaccgttgaacaaaacttaacgcgatcagtatctatcagcatgcgcccttccagcctcctgatctgccttggatctggcttccatcatgtgtttctgagcttgaattcggtaattatcgatgcggtaatggcgtcacggtcagagactacaacattcggatggcatttgtagcaactcaaaggaggatatctgggttaagtgcaaatgaacatcaagttctacaagatctgttgtacactgggagttttagcgcgcagtgctaatgaagctttataccaatgggaggtggacgtgccagacagtaagtgggatcttcaaattatcgttacaagtataaaataactttcaacgtatcatatgaaattcgttggattatttattatcgagaaaatgggaatacgtttactgagggtgattgttgtactangttgtgatangtcaagactagaaattacctcattccattactcatggggctacgagataaaaaaaaaaaaaaaaaaaaaaaaannnca

SEQ ID NO: 93068 - DNA, 274 bp, Triticum aestivum
  unsure (1)..(274): unsure at all n locations
  Clone ID: PAT_TA_93068
gcggcgctctagaaaantggattcccgggctgcaggccgtggcgaantcggggacgaagagacgaacaaaatccaaacgcaggagcgtcgccacacgaacgagtcgatcgatcgatcgatcgaattctcattctgttgcccacagaaatccaaacaagagcgacgaggacataaaccccttccttcctccatcttcccctttccnccctcggnctcggctgcgagagtggctccacccctcctcccaccnnactgctantgcccngnccaacac

SEQ ID NO: 93069 - DNA, 491 bp, Triticum aestivum
  unsure (1)..(491): unsure at all n locations
  Clone ID: PAT_TA_93069
aataatggtccccgggctgcaagctcgtgccgaattcggcacgagctgcgttcggcggcggcggcggctgccggccggcgctgggcctgccgttctcgacggcgagcatggactggaaggagacgccgacggcgcacgtgttcatggcggacgtgccgggcctgcggcgggaggaggtgaaggtggaggtggagcatgagcnggtgctccggataagcggcagcgcgcgcgcgccgncgaggacaagggcgaccggtggcaccncntggagcngaacgccgagaattcntgcgnaccgtgcgcntgccgcccaacgccgacgtcgacggcggcagcgtccacgcctcgctcgacancggcgtgctcacatcacatccccaangacgacngcaataacgcctacggnangatcatccccatcancaactaatnaccagncactgcatgnacaacaactcatcaatactgcgtacatattntcaacactgctt

SEQ ID NO: 93070 - DNA, 541 bp, Triticum aestivum
  unsure (1)..(541): unsure at all n locations
  Clone ID: PAT_TA_93070
cggnggcgcctagantaaggttcccgggctgcaagccgtgccgaatcggacgaggnaattccgggaacatgagaattgaaactgttatttctgctcgcaaacgtgctacccctccaaaggtatcacgtttgtgaggaatgatgcgcgcgcgttcaaattctgtcggggcaaatgtcacaaaaatttcanaatgaagcgaaatccacgaaagctgaaatggnctaaagctttccggnaaacagcaagnaaggaaatggncgncgattctacattaagtttcgctgcgcgccgtnacattccaagtccgatacaatcgggatctgttgggaaagacactcaatgcgatgtctcgtgtgagcgagatacgacagaaacgagaacncgtcttctanaanaancgcatggntgggaataaggaangacaaatgggcctgaatcgggaactcnnggctgagaatcancacctcccaccncggntgcgtgcgngtgagcganaagccaaanaaacacaaagaanccnnggtgatgngggtgttgtcgc

SEQ ID NO: 93071 - DNA, 158 bp, Triticum aestivum
  unsure (1)..(158): unsure at all n locations
  Clone ID: PAT_TA_93071
gcngctgcacgagcaatcgtcanggagacttcgtgcaggngttcnacaccgccggccgccgccacggcaacacagacgcggtccngcacttctaggtgcgcgnnacatgtcgaggganaaagatttgatcatnctttctccancgncagttgtactcg

SEQ ID NO: 93072 - DNA, 346 bp, Triticum aestivum
  unsure (1)..(346): unsure at all n locations
  Clone ID: PAT_TA_93072
gcggcgctctagaatagtggtncccgggctgcagntcgtgccgaantcggacaagtccaaagcgtcgcgtggtgnccgcgncgnccgctacgccgcggncgagaacgccgtcttcngcctcgncggatgctcgtcgccgccgccatcttctggctcgctgnccctccgggtccggccggccgcangccctactcctccggacgngccgccgccgtctccgggagctcanccgcntctccgtcgaaccgccgcgcgcaacccggccgccagttcgtgggcggnaaagtgncctcgggtcaaaacgcaangggntccgcgtctcntcaccggnggngncggttcgtgg

SEQ ID NO: 93073 - DNA, 563 bp, Triticum aestivum
  unsure (1)..(563): unsure at all n locations
  Clone ID: PAT_TA_93073
agngcacttgatcttatcggtgggaagtactacaagcgaagtgacacaagttcttgcaccgatnanattcaacttctgcgcaagatgctggacaanctgtgggacgacgtggtgggcgggctcncccggaganagggctcganaagctccgccgcgccgccggcaaacaaaccctcgccatcaananaaatgcaagggaggggattaagcaatcgccgtcgatgccgacgaaccnaacacccggtgangcctctntccancccccccgtgggggggaaagtgtggggggggttttcaaccccggaggaacttggcaacaaaanactccgggcaactcctncacccccgcaaacaaatccccnccgctaaaatnggtttnatcggnggnccaaggcangagnaccacccnnatanaaacnacggcaaanaattaaaaaaggaagtttcgccccnccncgtttggggccnttggttctaaccngcaaaacgnaattcttctaggggnaannaatttctgggntccncaaatatcacanaggggtgtganttttttntttccngca

SEQ ID NO: 93074 - DNA, 501 bp, Triticum aestivum
  unsure (1)..(501): unsure at all n locations
  Clone ID: PAT_TA_93074
acgaagaatagatatacatatgcataatggaaagagggtacagatgtgtcgcnaaaaaagaaaagaacanatgcatctgtgatgctattggtcanctaaacanaagntcctgaatactatatttaacaataattctgnaggcntcnaatgaaaanantatcanattaaccgtgtattgnatagtcctgcctcntgcnacacttatttnttaacaagcaagnactacaaaaatgaactgntnaaaggagaaggattccggggngtgggggttgnactgntccnacaaacaattgtgtcaccttnagcaagggtgggctcaaaatccgngcccccnggggggacaaaaggggnganacacgaaacnccccgcccttttgngggtggagttggcncaacggcaaccttcaacaaaaaagcgattctcccacaactgntanaaacggttggccaaaaanataatatccnaaggtcctcaacggggntntntaaatccacaattcc

SEQ ID NO: 93075 - DNA, 270 bp, Triticum aestivum
  unsure (1)..(270): unsure at all n locations
  Clone ID: PAT_TA_93075
aggaccctacccaaccactggaaagtcaatgtgccggaagggtaaaacnttgcacacnccaacatgtccaaatgtggtgttgcnctancagcaaccttganaataagnacactgtgacaanacctgcggggggngtcacaaacatggnagnccttcntcgtggagggggagnaaaaacgtcatgataaccagcattgtcaatcggcnacgngnaaccacgtgtgttgntnatgatcttgtagnngntcaccacaacaacgggaggttctg

SEQ ID NO: 93076 - DNA, 617 bp, Triticum aestivum
  unsure (1)..(617): unsure at all n locations
  Clone ID: PAT_TA_93076
ggnggcgctctagaacagtggatcccgggctgcagntcgtgccgaatcggacgagaagtgccaccagactctacatattacaacaaaaaacatcaatcgcagtcatgcagtcttcaatatgctcttttaacaattgctactactatctctgctcaattaagtcttcccgggttcctgatgcaacacttaacaatgctacggnaccccactggcaagagatgtaggnacaactcttgcctccgaagcttcatcgcaaagtcgcctctatatctaagcgaaatcgctggncacatgtcatctgttactaagctcaattgccgctcagtcttcatctctcaaagagcgangngtccgggaacatggtgtctatgaccaagctcactcgcctcaagaagcatcttctgtctcctcaaaagtatcttctatctcttcgaaaagcaggcagtatttcaagtgaaatagctagtaaaactaagcgaacntaaattctggcatgggaccactancacagccacaaaagataatgctgcatctcatccaactggggccttgtcttttgtgnaataatcggtggcggngtaattgntgaaatctctaaggtggtgggtcaatcagat

SEQ ID NO: 93077 - DNA, 252 bp, Triticum aestivum
  unsure (1)..(252): unsure at all n locations
  Clone ID: PAT_TA_93077
ctcgtgccgaattcggcacgaggaacaattagaaggggaatacttcatttcaattaacacacaatcaagatttatcaaacaagtcggtctcggtataatctctcaacctccaattcatcccctaatcactaaactgtatgatggcaatctggtacctatgtacaaactacagatgcctcctagcagtttgatatcacaccctaagattaatcaagcactccctcgctcacaggccatcattatngccttgca

SEQ ID NO: 93078 - DNA, 369 bp, Triticum aestivum
  unsure (1)..(369): unsure at all n locations
  Clone ID: PAT_TA_93078
gggcgctctagaatatggatcccgggctgcagntcgtggcgaantcggacaagncggacggggagtggatnccttcccctccgaacggganaaccggggggngggagcttcgccatccacatgtgcaccgaacggnaacgggctgcggngggtggtgnaaacacagacngnggnaagacaaacaccctggttcagnccgactcnaagcgcatggtgttaactcggacctcgccgccgtctcngccgagccatttctttccgcaccactaaaancctacggggagatttnancgtcaacatcnacggtcggggntgcagcgggtcaccacantcnttcgangangggacgccgtcntggacgccgcactt

SEQ ID NO: 93079 - DNA, 763 bp, Triticum aestivum
  unsure (1)..(763): unsure at all n locations
  Clone ID: PAT_TA_93079
aaaacaggaatcccttctcttcggcttactccaccctcatctttatcactctaagatggcaactgaactctacgatggtgcgataggtatcgacctaagtaccacgtactcctgcgtggcaacttatgaagggacaaatgtgggaataattgcaaatgaacaagggagtttacaacaccttcattcatttcatttacagacaangagaggtgattggtgaagctgcaaaaaaccaagctgctatgaatccacgcaacactatctttgacatcaaacggttaattggnagacggtttgacgacccgacagtaaaaaaagatgttgcatcttgggcattcaaagtcattgaccaaggatgggagtccaatgggtgaagttgagtatctggggggagactaaagtttttctccacaagaagnctcanctatgggtttatcaaaagatgaaagaaatcgcanaagttangctgggaaagaaagtaacaaaaagctgtttaacaagncccggngtnttcaatgntnatcaacgacaaggcactnaaantgccggggctattgctgggcncaacgnctacgaaattataatgagcccacggggnaancgattgcctccgggtttaggnnaaggaaatcnaataaggggggaaagttnttttttntattccgngggggaanttcctgtcccngncaanaccaaggggaggggttcnataaaacacngngggnacccccttgggggnaantttgtaaaccccggattncaa

SEQ ID NO: 93080 - DNA, 573 bp, Triticum aestivum
  unsure (1)..(573): unsure at all n locations
  Clone ID: PAT_TA_93080
cggnacgagcaccaacctgcgcggntcgatccccaccgactgcgtgcgcactgggagncgcagccgcagccgcgtccccgtcttcctccccgccgattcgggcgagcgatcgcggntgccctcgtccaaccatgcttctccgggcgggtgcggacgagatatgagccggcggggaatcgacggagccgccgacgccgcccgccatggaccctccgagcgccccgccgtcgtattcgacaacgggaacgggtataagcaaacttgggtttgctggtaantccgaancgtctttcaacanccctactgtagnagctgtgaatgaatcttcttggnccaatcaaagcaatgcagtantgcaaattggntagcacantanaatgcaagtgtcatggctgatcttgatttttttatcggggatganggtctgtcacaattcanatctaatgggctgtncaagtttaanaaagccaattcgtcatggtcaaggtgaatgactgggatacaatggagagaatttggaacaatccaatttcattatctacggnnaatcctgaggaaanaanattctactta

SEQ ID NO: 93081 - DNA, 809 bp, Triticum aestivum
  unsure (1)..(809): unsure at all n locations
  Clone ID: PAT_TA_93081
ggcgctctagaacagtggatccccgggctgangttttttgggactaaattaattatatctgttatatcatgaaggttggttggttgttttgctcaataacgtggtacgtaaagtgactaccgttgcactcctgctggagcttatctacgggtgggggcgggctggataagttaactaccattaagtacatctacctcgtccaacctcaagatttcaaccacatgttgaattatgtcaagcccaatcgtccaaggaactctctttcgacgcgctgacgcgctgatactcctcaagcctcgggcanaangcgcccgagcccttgacactttcgcgatctataacttttcccttccaattaatcccagctttggtcanctcaagnatctcttcatctcatccaatgagtcgttttcctcaatggngaactcatccagtcncccaacaaaggcgcctcagttttaattcctttgcccctcaaggtagaanccctcnaaccctcagtcaaacctcgcaacccaaaaanttttgtanaatgtccaancccccgggccttgccccttcgctggcggnttcctaacaatgggagtcgaaaaaacacctgagagntcaagaacgagggaaccggggcccanccctttgtcaacgccccaatttgtctgcggggaaaantttgttctanctttgtcggacaaantntccnaggcaggtatttgggcccttgcnggggggggncacccaagggggntttttccgnccctccaacaanggaantgnggggggnagganccccccnctcttngaantttttg

SEQ ID NO: 93082 - DNA, 452 bp, Triticum aestivum
  unsure (1)..(452): unsure at all n locations
  Clone ID: PAT_TA_93082
cggattacattgatcaagcggtccancgccgaaaaatcaatttgctcatgatcacagaccgagacggatcaaaattttgcagggcggaaagactgcatcgggtacatgattatgctacactgactgaaccgaccggcatgtacgattgtcccntcgggcaaccacaaaatcaaancctgccancagctanctatcgaattttccaacctgnnaggganggtgngaacaagtacantggngatcaaccgttgccacttataaganggaggtgttggtcaacaaggtgnatgcaattgntgcggcgcagntcancacngagggcagcagggtgacgttgnngaggctccccatgcccaagataccccccctgcggtgatggtgcantccgccgaccanccccnncaaggtnccngnctccntcnanaagaggccnccgttgttcntgccccctg

SEQ ID NO: 93083 - DNA, 251 bp, Triticum aestivum
  Clone ID: PAT_TA_93083
ctcgtgccgaattcggcacgaggcggctcggccagctgccgtgtgcgcggcacagtgcagccatggaggtcagagtggcgcccgttgaccttgtcccccggggttgtattattgtaacctttagccagaaacatcatgagagtcggagacaaaaggagagaccgatcgccttcctcgtgttagactttgagaacaacttgtgtgtgttccgtgagttcccggttacttccatgtataaaaaagcttgaaaa

SEQ ID NO: 93084 - DNA, 448 bp, Triticum aestivum
  unsure (1)..(448): unsure at all n locations
  Clone ID: PAT_TA_93084
gagagagagagagcatccggcataaataaacataacaagaaatcgatggcgatggcgatggcggcggcgatgagggtcggtggcggcgctctgctccggcgggcgcccgtggtggaggcaaggcagcgcctcgtccacacnaccccggaggagatgagagaggtggcgacccgcgcggcgcaaatcggcaagacaaaggagcanctgttcgacatggtcattgacctcaatagcaactacaacgttccccacagcatgaaacgggagcacttgctgctgtcacaacgcctctcttcacaaatccaagcctagaccatacgacccancctggcgtttctgccgacgcaccgaaagacgcaatactttctacaagtttgtgggggtgactacttgtggccttgtcgggtcaaccgggctcttcttgctcctacacggacctcaacaacna

SEQ ID NO: 93085 - DNA, 455 bp, Triticum aestivum
  unsure (1)..(455): unsure at all n locations
  Clone ID: PAT_TA_93085
gtcacacaaccctaacaagtttaacaagatncanagccnaagatnagcggggtgaagaangggacgggacgttgcggncaanggcgggaangggattcgactgggacgggctngccaaaatgctcctccccgaccaagnccgggaagggagttcgccaaactccgccgcaacttccgagggacgtcaaaccaacaagctccaagaacaaagtttctccccangaaacaaaagccaattgaactgggaatactncaaaaaggggaatcccggtncgaaagnttgtgggtatgttcaaangggggggtttatgatagcaantngggattnccaaaagttatgtttgacaactggcaactccctggngttanaaagccaaaaagtttgntggcccctgggttaatcccnaaattgaaaggggaagccnaaagaaaaaacanttccnttggangggaat

SEQ ID NO: 93086 - DNA, 332 bp, Triticum aestivum
  unsure (1)..(332): unsure at all n locations
  Clone ID: PAT_TA_93086
ctcgtgccgaattcggcacgaagatncccgataccaaagctcaacttcttctccttgaaatctttttgggttcacanatttggaggatgtcttgcaactgtggatccggttgcaagctgcggctcaaactgcaagtgcgggaagatgtacccngatctgacggagcaaggcagcgcccgccgcccanntcgccgccgtggtcgtcctcngcgtggngcctgagaacaaagnggggnaattcnaggtggnccgccggngcaatccggcgaanggctgcaactgcggngacaactgcaagtgcaaaccctgcaactgttaaactgnatgcactc

SEQ ID NO: 93087 - DNA, 447 bp, Triticum aestivum
  unsure (1)..(447): unsure at all n locations
  Clone ID: PAT_TA_93087
cacaagccggcctggtccatcttggctgaatcgagctgcgaatattggggttgcattgccttgtgttgtcccgaaagagtggatcgcgccgcctgattttgagacagccgatggcgaattggtagaggaggatgatgacgagccacacaggaatcttgaaagtagaggaatgctcgaaactacagacacaaaaaatcngataagcgtagaagaaactacacatagtaatgaggaacaaaagaagattgttgagagcgaaaaaaagtatcatagccgtaggttcatcnaccacaagtgatgttcccgtggacggggcgtcccnaaaaactcnaggncgtccgcaaagtcnaaaatgaaaaagtgttgttgggcgnttcaaggggagtagatttgtcattggcgttgggtanttcccnatacaagctcgacctttattctcccctacan

SEQ ID NO: 93088 - DNA, 471 bp, Triticum aestivum
  unsure (1)..(471): unsure at all n locations
  Clone ID: PAT_TA_93088
atnggccgggactgttcnccgtcangctgtcnatgtttctcctcntcntcgtgtaaaccaagcaattgcactattaacgattggggctcgtgaagccgctttcaaaaatattaaaagtgtaaccgagtgcttggncgaagagcttattaacgctgctaaaggaagcancaattcctatgccataaaaaaaaaagacgagctggagcgtgtngcaaagagtaacaagtaagaagcctctcaagggcctaatcncantttgttgtacggtaatgggggattaatgggntggcactcaatgcaatattggntcaatttaatgtgaaaagccgggtaaatttattcctccgtaaaaaaaaaaaaaaaaaaaaaactccaggggggggccgggtaccaaattcncccctaatantgaggtcgattacgcgccgctcaactggggcggtcggttttaaaaacntcccngaactgggn

SEQ ID NO: 93089 - DNA, 460 bp, Triticum aestivum
  Clone ID: PAT_TA_93089
ctcgtgccgaattcggcaccaggagatttccgcttcactcatatcataatttcggccgtttggcggacattctagcttcccccaaaaaccaacttccttgacaaaagctgccacatcgctgacctagcccaaggaatccgcctccccactaagctacattccagttttcgaagggcatgcccgaaaagattacagtttattccatcaccataaactttatttcacaaatggaccaattaaaccgtgtgcaaagctctttattgacgtggtgatcttccctcaacgtctgagcatcggttggtgttgtactaatggtatttacaccttgcatcagcaccgacttgatagatccaacttcggcaaaagattcggctataaagtcgatgatgtaatcaaaatcctccgtctcctgtgcagatcgtttttttggtttccacatggattcatattgacttttttg

SEQ ID NO: 93090 - DNA, 255 bp, Triticum aestivum
  unsure (1)..(255): unsure at all n locations
  Clone ID: PAT_TA_93090
ggagtccgtaaatgaactagctgccagtattacaaaagggctggaaacattcanattcgtggagcgctttcctctggactcttgaaaccaaccacatgagattggttatggttgtacaaaantgctggcctcntcttttttcataacancncgctanatgcgctttggntcgtatcatgagctagggtgngagtaagggtgtnagttantactccangganctgggnanaatagtattgacttcanngggggggn

SEQ ID NO: 93091 - DNA, 306 bp, Triticum aestivum
  unsure (1)..(306): unsure at all n locations
  Clone ID: PAT_TA_93091
ttccccccgggctggcanggaaattccgcaacnaagggaaaaataaggggnacgtatatttccccgacaaaacccgggtacaaccaaagaacccacagaaacaaccntttgggggctccgggaaaaaggggncccccccaaaaaatggggtancccgttggntaaaacccgggnccgnnaaacttttattaaaaatnggggggggaggtatccgggaaaactggttggctaagaagcaancctatcctcccnaaaagctgngccaaattaaaaatggccccataacnnaaagnccaantttttttc

SEQ ID NO: 93092 - DNA, 458 bp, Triticum aestivum
  unsure (1)..(458): unsure at all n locations
  Clone ID: PAT_TA_93092
tttttttttttttttgcgagacagcacaatttggatatttaattagttctaacatgagcatgagataccacacttaaaagctagaaacatttatccagtacttaacagttcactcctaacacaaagttgaaggtgacgcttggtgaagttagttaattctatgaaccgcagctgaccccagataaagtatcaaaaaatgagccttatttattttaaattagttgatagtccaagtcttttccattcccaataatttttacgaataggatcgtatttttcaccaagtagagttagtgccttatctgctttaccaaantcacctttctctgaccagatatctgctagaaattctaaggcgtgcgagcttgctacaaatgtgtacgttgcagtttcatccttgctaatattaacaaaccttgttgcccattcttcttcagatataatggaacgatcccctt

SEQ ID NO: 93093 - DNA, 462 bp, Triticum aestivum
  unsure (1)..(462): unsure at all n locations
  Clone ID: PAT_TA_93093
ctcgtgccgaattcggcacgaggcttcatctgcagctacagctcctcttcgtcttcgacacacaagtattttttcaggacaaagatcaatccagatacacatacacctgccgacgtttaactagcttacttccagaatccagatacacatacacctgccggcgtccagctagctcacttgcgagctgtagtacgtcgctgcatattccaatggagtgcgaagaatgggcaagtcgccgccaacggcgatggcttgtgcgtggcgcagccggcgcgggccgacccactgaactgggggaaggctgcggaggagctctcggggagccatttggatgcggtgaagcggatggtggaggagtaccgacggcccgtggtgaccatggagggcgccaagcctgaccatcgccatggtcgccgcggtggctgccggcaacgaaaccaaggtggagctggacnaatcccc

SEQ ID NO: 93094 - DNA, 294 bp, Triticum aestivum
  unsure (1)..(294): unsure at all n locations
  Clone ID: PAT_TA_93094
gaaaaggntgggattgatgctcaatggaaggagagtgcatgggcaaaaaagagaactcaaagggagaggagacntgctttgacngactttnananatttaangntatgcngntganaaancaanctcngtttnaggttcnaaagtcgttcccaaagattanggcangnaccacatnataaatgttaggnccaatgcaattnataactttgacaaactaaatcncaatcctccncccnaaaaaaaaaaaaaaaaaactcccgggggggnccggtacccaattccccctanaatga

SEQ ID NO: 93095 - DNA, 278 bp, Triticum aestivum
  unsure (1)..(278): unsure at all n locations
  Clone ID: PAT_TA_93095
ctcgtgccgaattcggcacgagcggcgacgccgtggacaacgcggagcangaccaggaccccaaccagcggccgcgcaagaagcgctaccaccgccacacccagcaccanatncaggagatggaagcgttcttcaaggagtgcccgcaccctgacgacaagcagcgcaaggagctgagccgggagctcgggctggngccgctccacgtcaanttntggntccanaacaanaggncccanatgaagaaccancacgagaggcacgagaactcncagctg

SEQ ID NO: 93096 - DNA, 318 bp, Triticum aestivum
  unsure (1)..(318): unsure at all n locations
  Clone ID: PAT_TA_93096
ctcgtgccgaattcggcacgagccgccgcctcccctcccttcgttcttcttcttcgagttgggtagtttacctctacccaccagccatgggtaaggagaagactcacatcaacatcgtggtcattggncatgtcgactctggnaagtcgacgaccactgggcacctgatctacaagcttggnggcattgacaagcgtgtcatcganaggttcnagaaggaagccgctgagatgaacaaaaggtctttcaaagtacgcgtgggtgcttgncaagctcaaagccgagcgtgagagaggtatcaccatcnatattgctctc

SEQ ID NO: 93097 - DNA, 216 bp, Triticum aestivum
  unsure (1)..(216): unsure at all n locations
  Clone ID: PAT_TA_93097
nccaacctcgtctcatcctctccanacgcgcacatacncacttccatggacggcggctcccctcctcccagntccgcctcctcccgccttttattgactttgntancgtacgtgtgctaaggtggatngctcaanaacaaaagcgtacgtcttggtttgtcgttaaaggaggagctaagccgtggtgtngggtggagctaactgggggaaaacccc

SEQ ID NO: 93098 - DNA, 459 bp, Triticum aestivum
  unsure (1)..(459): unsure at all n locations
  Clone ID: PAT_TA_93098
cgcgcatccaccgttgctagcaaggtcgaccaagcancaccgagatgggtgntgncttctcctccaccgtcggtgncccggnttctacgccgaccaacttccttgggaagaagctcaagaaacaagtgacctcggccgtgaactaccatgggaagagctccaaggncaacangttcacaatcatgggagggggaaacctcnacganaaagaggaacaccgacaaagtgngnagggtcttgcgtacgatatctcccgacgaccagcanggacatcaccaaaaggaaagggatcgtgggactccctcttccaaggcgcccacggggggaacggggaaccaccaagggcgtcctcaagctcctancaagtacgtcaagcccangggaactcaaagaaaanaacnaactttctncnacaaccaatgggganggggttctacaatcgcctcccgggtttnaatt

SEQ ID NO: 93099 - DNA, 176 bp, Triticum aestivum
  Clone ID: PAT_TA_93099
ctcgtgccgaattcggcacgagctcgtgccgaattcggcacgaggtttaagtcaagtcaatgagtgagttgtgtgaaaggcatgaatgatgtattcgtggtatcgttttctctgtatatgtaatatatcgtttcattgaagcaatatgtgtaatatctcaaaaaaaaaaaaaaaaa

SEQ ID NO: 93100 - DNA, 486 bp, Triticum aestivum
  unsure (1)..(486): unsure at all n locations
  Clone ID: PAT_TA_93100
ctcgtgccgaattcggcacgagcggnacgagcggcgctagcctcggcagcgtcagcaacggtggaaggatnangtgcatgcangtgtggcccatcgagggcatcaagaagttcgagaccctgtcctacttgccaccgctcagcacggaggccctccttaagcaggtcgactacctgatccgctccaagtgggtgccttgcctcnagttcaacaaggttgggttcatcttccgtgagcacaacgcatcccctgggtactacgatggccggtactggacaatgtggaagctgcctatgttcggatgcaccgacgccacgcaggtgatnaaanaagtggaggaggtcnanaaagantaaccctgacgcctaatgtccgcatcatcnggatttcacaacaagcctcaagtggaagttgcgttaagcttcaacccctttnaacccaaccggggctgngaaggagtnccggcaaagggctnaaacaanctca

SEQ ID NO: 93101 - DNA, 472 bp, Triticum aestivum
  unsure (1)..(472): unsure at all n locations
  Clone ID: PAT_TA_93101
ctcgtgccgaattcggcacgaggagagaactagtctcgagnttttttttttttttttttttttacntcagaatggcaaatgcattcctagatgaattattgtacaaaaagtgttctcaaactactctttttacctcaaaaaatctcttaagccaccatacttgaaatataccttctccgagtaataccgccatctgaaatatactccaccatttgactctcgagttggtgctttcagcagtattcctgtgggtcctttcgcgaagaacaatgtatgattgttcgtctttcacttgcgataagagactcgatagttcgcgtacttcagcttcaagtggatcagatgggtgctctggctccgatacatacacgacaccatgtacattgaatgaaacctctttgcttgccgccggaccaatgctcattgctaaagcagtaagggtactaccgtcatgttcggcacgaaatgaata

SEQ ID NO: 93102 - DNA, 540 bp, Triticum aestivum
  unsure (1)..(540): unsure at all n locations
  Clone ID: PAT_TA_93102
agaacacagcacaaacacaaaccaatcgagattcaaagcaaccaaagaacaatgggcgggcganaangggctggggctgctggacttctgggtnaacccgttcgggcaagcgcgttcgcatnccgctngncgaagaangggctngcctaacgaagtaacttggagggaggacttganggcgggaaagaagcgaaacggctnctccggctccaaacccgggngcaacaaagaaagattccgggtggctcctccaacgaacgggccgcccccgtcaaacgaagtccctcatcaatccctccaagttacctcgaanggaagcccttccccggaaggcccccgggccctcctcccctccggaacccctaangccgcggcgcgcaaggcccgcttcttggggccgactaacgttcnaacaanaaaaggtctaacnaaatgggggntccccggcttttgggaancttcaaaagggggaaaccccaaaggcggcaaaggngcccccccccanaatntcttgggggnatttctcaaaaaaaccctccg

SEQ ID NO: 93103 - DNA, 482 bp, Triticum aestivum
  unsure (1)..(482): unsure at all n locations
  Clone ID: PAT_TA_93103
ttttttttttttcacatagacaatgtatatataaagtatagatagagactgaagtagttttctcttcagaatgataatttacatactatcaaccacatagttgcaccagcgcctgttccttgatccgtgacatattatcattctccccattccaaataccacctaataaggtgaagaaatctagacgacgacgacgacgacgaggagagccaacagctaannccctaagacgaaagtataagaggccgagcccttttacacgacgacgacaagcttatctgcgatcagttaagagttgatatcagcaacccattatcaagaagctagccagtaagagaacaagtttagggctggaatataacaaacctgcaaaaatgacatctaacttggcagcacaaaaagaaatcgacgatagggtatgagctgagcatttcctacctgcaagaacagattgatgctctgactgctgagcgagcggcaan

SEQ ID NO: 93104 - DNA, 473 bp, Triticum aestivum
  unsure (1)..(473): unsure at all n locations
  Clone ID: PAT_TA_93104
gtttgaccaacaatcttataattcaacaaatccatttattttttgtccacttcgagggcaccaacatcatttaacctcatacacgttctgttatcgtcgattttaaccccctcatacgtacatcaatttgttacagagaggtgactagattgctttcaagtctcaaggcttcatgatagacgaaattttgagcattgttttgtaatgattacaattgtttacatattattttgaatctaagcagaaacaaacctcggaagcctttgcagttagcaactgcagattctgtaacttggagagcatccaaattttaccaatgaagaaagtctagacggcaaaaactggagttttaaaggntcaccattctttctacatcgtaaacccgacnaaggggcccaaaagnantttggnaatgcaaatacgaaagtggagcacaanggggcttaaactccgtattttacacaaaaanaaaa

SEQ ID NO: 93105 - DNA, 482 bp, Triticum aestivum
  unsure (1)..(482): unsure at all n locations
  Clone ID: PAT_TA_93105
ccaaggcggaggcgccgacccangaggagcccaaggccgaggagcctgccaaggaggagtccaaggcggaggcgccggaccaagaggagcccaangccgaggcaccggcggcggtggctgtcgtggaggagcccaangccgaggcacccggcggcggtggctgccgcggaggagcccaaagcggaggtgacggccgaggaggccaagccagaggagaaaaccgtcntggtggccgaggaggaaggcaccaaaaccgtggaggccatcnaggaaancgccgtccccgccgcgtcnganccggaggcancgcccgctggccganccgaaagaggagctgatttgggggcgtgccnctngtgggcggcgacaaacgcaacggacacngtgctcctcaaatttcctccccgcgccgcgaagttnaaagtcaaaagganggccaanggggatttctcaaaaggcnggccgttgcttgtggngcaaaa

SEQ ID NO: 93106 - DNA, 480 bp, Triticum aestivum
  unsure (1)..(480): unsure at all n locations
  Clone ID: PAT_TA_93106
agcaaccccaaccgccttccttcctccgcganttgcctggccgccctcantcanccgggcatggggctcctcancgatntcctcaacctcganctcaccgactccacggngaanatnatcgccgagtacatatggatnggnggntttggnatggatttcaagagcaagggcangaccctccccgggccggtcaccgattccaacaaagctgcccaagtggnactacgaagggtccaacaacgggcaagccccccgngaggnaaaggaggncatcctgtttccananggcaantttaaaggacccgttcaaggaaagggaanaaaaaccctgtcaagtgcgaaatggntanaacccaaactggngtggcaatccccactaaacaaaaagaaaaaaagctggntaagattttttacaaaccttaatgttnncaaaggagggnggccaagggaccggtattnggcaaggggtaanacccccnn

SEQ ID NO: 93107 - DNA, 474 bp, Triticum aestivum
  unsure (1)..(474): unsure at all n locations
  Clone ID: PAT_TA_93107
gacacttctcccgtcccgtccccagccaacctcccatccccgtctcgcgtcgcancgggagttccactccctcgccatgggcaagattaagatcggaatcaacggtttcggaaggatcgggaggctcgtcnccagggtcgccctccaaaagcgacgatgtcnagctcgtcgccgtcaacgacccctttntnaacnaccgagtacatgacctacatgttcaagtacgacaccgttcacggccactgggaagcacagtgacatcaagctcaaggacgacaagacgctgctctttgggganaagncattaccgtcttcggcgtcaggaaaccctgaggagatcccntggggtgaggctggtgccgattacnttgtgggagtccaacggtgtcttcactgacaaagacaaaggcgcngctcacttnaangggggnggncaanaaagggggtcatctctgccccaaacaaaaatgcccn

SEQ ID NO: 93108 - DNA, 485 bp, Triticum aestivum
  unsure (1)..(485): unsure at all n locations
  Clone ID: PAT_TA_93108
tttcactcttcctgtcggaaatatctgcattgaataataataagcagaatccattcattccatcacatcagcacttaaatctaatctcttgaggacgtcttccggatgaaggctcaatttgcttctctcttgctcctggtgcctacggcatgtggactgcaatattataaatgtgaaagtgggaaaaaatttgactattcaagttgttagaggttacacatcaagaagcctccttcgaccaaattcaagctaagtgatcctttatttgttggtgggnagtacctttggggcatatcgatttacagctaatagaccagatggaactccaacaaattacttagtccaatctgtcagtgtggacccataccaacggntatttgaactctcaagaagcccgatgggagaatatgtactctgttagattttgtcaaggtagagacatgattcaagagttgataattgttcaaacgatcatgactatatca

SEQ ID NO: 93109 - DNA, 210 bp, Triticum aestivum
  unsure (1)..(210): unsure at all n locations
  Clone ID: PAT_TA_93109
ttggattggaangggananctattggtcctcctttgtggngaactccatntaaanttcttctgntgnctcaatttcttttgggaatccctgtgctttcntgtggaggagtgtggnctgttttctcaagaatttgttganaaaggngggaanccancattttctaaaaagncaatggggcaaccaancantcctgnanttngggaatggga

SEQ ID NO: 93110 - DNA, 436 bp, Triticum aestivum
  unsure (1)..(436): unsure at all n locations
  Clone ID: PAT_TA_93110
ntnttttttttttttttntttttttttttttngcaaactcaggcaaatccattangaanaanaaaganccacnattacaattttttgtgctgctcaatcctaaacaanatatttgttttatttcatattcnaacaanacacaatctgatatagccagaccatccccttaccatgagatcacaccatgactcgcctagctcaatcggactattaatcccccatatanaaggntcaagtgtacaattcaaccaantattattccccataacgtgcataagtaaagttcaactaacaactgcatatgctttatacggtttcnccactaggtgcaagttggttcttcctccttgccgataaggcaantgtcatttccatgatccaagctcactcgggttcantcccgcagggaggncccaatcattcnaacttcaaaaac

SEQ ID NO: 93111 - DNA, 417 bp, Triticum aestivum
  unsure (1)..(417): unsure at all n locations
  Clone ID: PAT_TA_93111
ctcgtgccgaatttccgcacgagctccaggagtttttgaatttgatgcctttgcaaacggtacaaaagaaactctanatgcagcggtcgaagccgctcancaaggaaagattgtgatcatangtggaggngacactgcaactgttgctgccaagtataaggntgaggataaactcanccatgtttccacangcggtggngcgtcacttgaattattaaaaagnaaagagcttccangcgtcactgcgctatcgagtacataaaatgaaagntgctggatggctgcatcaaatttgccaaaacancacttcttcggtgtaacacatatctcttgcaagaagtgctgctttgtattttcnaaaataatttggnaaattgnaaggggnaccgntaccnaaagatgccgatgggcacgttt

SEQ ID NO: 93112 - DNA, 476 bp, Triticum aestivum
  unsure (1)..(476): unsure at all n locations
  Clone ID: PAT_TA_93112
ctcntgccgaattcctgcacgagggcaagaccatcaccttggggggggngtcctcgggcaccaacccacaacgtgaaggnaaagatncangacaaggagggnatccctccgggccaacancgcctcatcttccgctnnggaancaactttganggatnggcgcaccctgggctggactncaacatccaanaagggagtccancctccacctgggtggctcaaggctttcctgggagggnaatgcaaaattttttttaaagaacnctcaaacgggcaaagaacatcaacccttggnagggtgggagtcctccgggcaccaatccgacaaatgntnaaaggggcaaaganttcaagcaataaatggangggnaatttcccccgggaaccnaaacaagcgtctcaatccttccccttgggaaaancaaacttgggaggggatgggccgcnccccttgggcaanactaanaaacaatcca

SEQ ID NO: 93113 - DNA, 480 bp, Triticum aestivum
  unsure (1)..(480): unsure at all n locations
  Clone ID: PAT_TA_93113
cgaaattttccccaaagaccattgccagcttaactaatgtgcctaaaagtagcatcgcacaattaactctgtgcctctgatacacacaagctatatcatcagatcaaatatcattaattttaaccagatggaatcatacattaattgttcccaagatttgccctaggaaatgccaaccaaagttcttctgaacaacctaggatgtacgagttctgagcgagatagtaacatcaagttaatgtggaaggtaaggtatgaaaaaaatattcagaccatcagccaccagaagagctggcatcttttgtttaagcaggagtttcttggcatgagataattagtcatcaatcgctaatcttgtatgggacactagaagtgggaagctagaagcccttacctcttcagcctcggattttatctttataactggtgtgactgcggaaaagtaagctttttgccaagggtaatgcantaaatatagaa

SEQ ID NO: 93114 - DNA, 283 bp, Triticum aestivum
  unsure (1)..(283): unsure at all n locations
  Clone ID: PAT_TA_93114
ctgctgcacaanttgttaaagangaagangaggctaancaaaggctatgtgatnatntgaaccngttggttcaaaanagcgcggnttcacaaatattcnaggttngaaagagttnaagaagcgtttagaatgtctaaatcccatcagggcttctgtcgatgtttctggtatcaacattgtncancaggntgccacaaattcngtacctcagcaacccacttcanaaaatctaccnaatgcaattgcccctgcanncaatatccacaagcccnccaccaagcgg

SEQ ID NO: 93115 - DNA, 488 bp, Triticum aestivum
  Clone ID: PAT_TA_93115
ctcgtgccgaattcggcacgaggcgagatcaaggccgcttaccggcgcctggcgagggaggtgcacccggacgtcgccggctgcggcggagacgaggggttcatccggctgcacgcagcctacgtcacgctggccgatcccgacgagcgcgcgcggtacgaccgggacgtgaccagccgcgccgcggggatgacgatgcggcaggcgtcggcgacgaccggaccggcgttccggcggcggacgtgggagacggaccaagtgctggtaagacgtacggccgggcaaacgcggctgccctccggaggccccgaccggcggccgcccggttcggtcaggcacggcgctggagagaaggtcttctcgaccattgtgctgctccgtaagatcaggatttgacggcttaaattgggtgacgccggacgtgggagctctgttacacggcaaaaaggcgttttttaaagatttcttgtgccgccccggccaacaaa

SEQ ID NO: 93116 - DNA, 477 bp, Triticum aestivum
  unsure (1)..(477): unsure at all n locations
  Clone ID: PAT_TA_93116
agtccaattccaagaaataaatctaaaagttccaagcggtagccggatttactatgaagattggatatgaatgactgagccagcttacctaatattaagggaatcaattggaatcaaacaaggaaatctgttgtgtcaacaagagttgaaggtagaaagatctcggtctactttatcaagaactttttagaccccaacgcccgtaattagagtgcacaccttgcgaaattgcgtgccatattatcgggggatgccttccattaattccatggccccctctcgaccaacagtaataatcacgtcacccaaggtctttgttgcgaacccggcttcacagtagacaaagtaataaatccattttttgcgaaatacttctatctctctctctcccatttccttgtggtctctcatgagggcgggatttaatttttgattcgaaatttaatataaattcctccttccacaagcngcagagtn

SEQ ID NO: 93117 - DNA, 498 bp, Triticum aestivum
  unsure (1)..(498): unsure at all n locations
  Clone ID: PAT_TA_93117
ctcgtgccgaattcggcacgaggaaaaaaatatactataagcaatagaaaaatagtaatccctcaataagaaaatcaagaaagagatttccttttcttcctgggctcccttccancaacaaactctcctccgggcgggcgagttgtccccctccggntgggtcttctccgggggagaagggganctanggttgcctgttcttccntttgagnggggctccncccgnaaggggtggagagagatttctccgggaacctcngggaatggggggggtgttatgaatgggganttctccttatgccgatgaaaaacaccccaacacgggntttctgtgggngnaaaaantttttccgccanaanatcgccgccaaaattnnctcctcngcctgnttcttataaaaanaccccccgccgcgcancaaatgnatanaaangnctttttcgtttganttccccccccgttcgatngataaacaaagcaaaatcttgtaggttttt

SEQ ID NO: 93118 - DNA, 468 bp, Triticum aestivum
  unsure (1)..(468): unsure at all n locations
  Clone ID: PAT_TA_93118
ctatggcgcctttcatgatgagctttgccgcgcgtgatctcgcttcccaagtagggagtgagtgtacccgtaaaaagattagaggaaccgctgtccaactagatcagggcgaacggctggaactgcttcagtacgagtgtactgccgatggcaaaactgtggtgtgtcgtcctgtcgagcgattttaccgaagatttcagactggaaaaaaaagctggatgatcgaaactacggcatgggaaaatccaactgatggtggcaccaaaacataatagggctagaacgcacatctgtcgtcattgagggcatctaacgcttagcgactagttgtaaggaatacatgatcaaattttgggctttttgaagggaattaatattgcaacactctatacagcctgaacggcaactggtgatatgggaatataaatttcantgggaatggcgggcaaatgggagcaattatgnttg

SEQ ID NO: 93119 - DNA, 303 bp, Triticum aestivum
  unsure (1)..(303): unsure at all n locations
  Clone ID: PAT_TA_93119
ctcgtgccgaattcggcacgaagtgaggtaaccccgctccgctaaacctcgcaacaacccccgtgggngaccaacccagaccagacgcccccctctcctcaccaanncccgnagctcggaancagagccgcgatggtcgggaccgtgtccaanctcgncgccccgangccggcggncgcggggccgctcccctcgnaganccctcngngtcgccgcggttcggcttcgcntcctctngcccagaagcttncgcgtctccntcgnccggccgcgccnatgatnccccgtcattgngatggtttc

SEQ ID NO: 93120 - DNA, 470 bp, Triticum aestivum
  unsure (1)..(470): unsure at all n locations
  Clone ID: PAT_TA_93120
caagcgctggccgttggctgcgcctgaggacgcgccgccgggtaccacggtcgctcgtggagacgccgaggccaaaactaccggaagccgagacgtgttgtctatggtcgccggagccaccttcgccgttgaggccgaaggccagggctgtgccgctggtggactccgtcccgggctgctacgctgatgggcgcggcctttgtgcgggaagggcgaggtcgcggacgcagtcatcttcgcgttcgctgtgctacgagccgcctccacaagcaagcaagccgcgccgcggacgcggacagcctttgccatggccgaagggacgtgctcggaggagcaacgcctggggtgtcgcctggcgccataaggagtcggggctgatggcgccgccgagcgtccaangacgctgcgcatgtcggccgtgggccgtcgtccccaccaacgttcacggaacgaanctccgaccgggtgnt

SEQ ID NO: 93121 - DNA, 263 bp, Triticum aestivum
  unsure (1)..(263): unsure at all n locations
  Clone ID: PAT_TA_93121
ttttttttttttttttctttaccaaataggtatactcaatatctttttatattaacaaaacatgcccagcaatcgcttggatgcgatgcggtacttangnacaaaggataaaacatcagatattaaattggcatgcttaaaaggtgtaaaggcagctcccgtcgtcactcctcgccgttgggtcgaagttcttggnagtctggncngtgcatcctgccggtacaggcaaagtaccttgctgctcgngccgaattcggcacgag

SEQ ID NO: 93122 - DNA, 508 bp, Triticum aestivum
  unsure (1)..(508): unsure at all n locations
  Clone ID: PAT_TA_93122
ctcgtgccgaattcggcacgagcgcacctcctcgtcgggcgagcgcagcanaaatggcgaccctctccatggtctccggncccgtcgccaactcgtctctccccctctccaaccgncggcgngcctcctccgtctccctccccgcccccaaagaaaggaagnattggtcaccggggnctgcgggatngagtgcaacccgtatcggtggggtttgagatcccaaaacaaaaaaagggtggngtactccctgcantacaatccaagggaatccgggcgggaaccgctcccgccaaattctttttggncctcaancttccganaaacaaaggtcaccaaaggaacctctccgagggagggagggncatcacgctccgtnagggaggncaccaangtaacaatgatttgaaagggngancntaaaaggttcaancgtgttggcgaattgagaggatgaaggagattcggtgctacaaagggatccggnaaaaagctccggctccccggtcgt

SEQ ID NO: 93123 - DNA, 421 bp, Triticum aestivum
  unsure (1)..(421): unsure at all n locations
  Clone ID: PAT_TA_93123
taagatcgctcttaagccagatactccaatatctgcacaatccttcatgcagctaattataaaaatatccgagaaggctcaaataagccgtcaacctaggagttagctgcttctcctaaatagaaccaggcggtgatggtgttaaattagaagtaaaagctgctcctacgcccgctgtcccaattttaagctgtagacctttcatacacactagatccaccccatatctttaaatttaccagaggtagaagttgctgctctactggcaattattttgtgcttgcgctttttccccaaagctaacaaaacgtacatgtaatcgtaccctcaaatgtttccacaacggtaaccgtgctatcgtgctgtcaaagtcttataaaatcctcatccctctatttgagaaccgagctaaannaaaaaa

SEQ ID NO: 93124 - DNA, 442 bp, Triticum aestivum
  unsure (1)..(442): unsure at all n locations
  Clone ID: PAT_TA_93124
cttgagatggcgcaaaccatggngtccatgaccggcctgtcgcagggcgtgcgtctcccaggcccggccggcaggagcgccancatgttcatcgtgagggcgtcntcngcggangcggaggccgccggccgccgcgcggtccttggcctcatggncagcgggagtcgtcggcagcgcgttcgctcagagtggtgcacgccggcaccgtcgcggccatcacaggttggcccgccgtnngcccgctctccggtgnactccccggnaacgggacaaatctntangaggnaagggatttccgaccntgccccctgaaagnaancggttttaccctgccagtccgcctgccaccgggcgggaggcggcggntccgggggccaaanggagtcnggcccaaggacatcctcaaacctcanagccgcctcatctgacaanananccaatg

SEQ ID NO: 93125 - DNA, 473 bp, Triticum aestivum
  unsure (1)..(473): unsure at all n locations
  Clone ID: PAT_TA_93125
cggcggtggggcgggagttgaggagggaccggaggacctcgcgctgtcccggcgcgtgacgctcgacgccancgagggcgcggcggtagcgtccaangtggngttcatgttcctgaccaactccgacctcaccttcgcgccgctttgggaagcgcttcttcncggggcacgctgaccggttcaacgtctacgtgcacgcanacccggcggtgcggntgcgggtcccccctacgccttccttccgggggccgcttcgtctcgggntaaanncgacgcgggcgcggggacncgancctcatcgctgcggggcggggcctgttttttntccccgctactccaaagaacccggccaaaaccctaatttcgcgcngtcccccaaaaaaaanttcncgctccaaancccttccccnngttctcttaaaangggggtctttnccncccaaangggggggggaaacaaaaaacgcctccca

SEQ ID NO: 93126 - DNA, 486 bp, Triticum aestivum
  unsure (1)..(486): unsure at all n locations
  Clone ID: PAT_TA_93126
ctcgtgccgaattcggcacgagctttaagataaatgtacaatgtttgcgagttacacactctcaaatacttattagtgcaaccccaaatcccaaatacaatatatgtgaactcaatacacacaacaaaacattgaaggggggcagtagcaagacggttactccacagaagattcattcggcttcaccaacacctaatactcgacaacatgatgccctgaatgcaagggctgccgcgggggcaagtagcaagacggttactccactgaagattcattcggttttgccaacacctaatactcaaaaaccagatgccctgaatgcacgttctgccacggggggcaatagcaagacggttactccaatgaatattcatttggcttcgccaacacctaatactcgacaacaggatgccctgaatgcacaggctgccacgggatcaacctagacttcatgtccatcatcatcagagagganatanggatggg

SEQ ID NO: 93127 - DNA, 492 bp, Triticum aestivum
  unsure (1)..(492): unsure at all n locations
  Clone ID: PAT_TA_93127
ctcgtgccgaattcggcacgagcctgtctattcgctggtgtgaaaatctcgggaactaacgctgaagttatgcccgcgcaatgggagttccaggttggtccctgtgaaggaattgagttgggtgatcaactttgggtggctcgattcctacttcatcgtattgcagaagaatttggtgccaaaatttcatttcatccaaagcctatcccangtgactggaacggagccggccttcacagcaacttctcatcggaagagatgcgcaaacctggtggtatgaaagctatagaggctgccatgaagaaacttgaagctaggcacaangagcatattgctgtntacggngaggataataccatgcgtttaactggacgacatgagactggcaatattgattcattcacttaccggtggtgcaaaacccgtggnacctctaattccctattncccagagaggngaagccnaaaaaanggttttggggntcctttcnt

SEQ ID NO: 93128 - DNA, 667 bp, Triticum aestivum
  unsure (1)..(667): unsure at all n locations
  Clone ID: PAT_TA_93128
aaactaatgggattccccggggctgcaaaggctcgtgcccgaantccgggaacgaagcaatttcactaaccaatgggntgaaggaaattgcanaaaaatccntcaccggggaagatggccccnatntccangctngggcccctanttcccaagggcnatcaaagaanagncaaacaaacatctactggtcaaagncaagattcccgtggtggatnacnaagtggggaactaaacccttggacctccnccgnacttcnaaatatcggggcaaaattggacgggaagttttggcaattcaanaaacctttaagtggcgtgtactcaaattgcaagctnaactcccangggggggggccccnggttaccccaaaattcnccccctnanaanggggaggtccngtattaanggcggcggcctcaantggggccgtccgntttttacaaaanctncctggncctgggggaaaaaaccctgggcggntnacccaaaacnttaaatccgccctttggcnaggaaanaaatccccccctttcccccaancttngggggttaataaaccgaaaaaaagggcccggcaanccggattnggnccctttcccaaaaaagtttgccgccnaaccctgnaatgggngaaaatggggaacccccccttggttagcggggggg

SEQ ID NO: 93129 - DNA, 483 bp, Triticum aestivum
  unsure (1)..(483): unsure at all n locations
  Clone ID: PAT_TA_93129
ctcgtgccgaattcggcacgaggacgaaactagaacagatgcttccttcatccaaagagactggttgctccacaaaactgcacctgttcagctagctagctataattaagttgtttattcctgactgatgatacttaacctagcagaagcagaagcagaagcagaagcaggagcaggccctaaaaaggtaaaaactataactagagcaaatgcatgcgctcgacataggggttgtgcagccactggctgagcggctccccgcacccgacgaagcagccggtgttgccgcgggcggcaaagagcgggaactggaagagatgcagaagcttctcgatggactggcggaccagcgacgagccggtgaccctgctcctcctcccccagccggtgacgatgtcgatcctctcggggcaggagcccatgagcaagcatctgcctgtgggaccaagcgagcgtcctgnagaaaaaccntttccggggttc

SEQ ID NO: 93130 - DNA, 194 bp, Triticum aestivum
  unsure (1)..(194): unsure at all n locations
  Clone ID: PAT_TA_93130
ctcgtgccgaattcggcacgagcccgccccgccaacctcgccatgccatcctccgcccgcggcccggccccgctctgcgncncggnctcngacaatcncgcgnnacgctgtccanccgagntgagcggcgcanccgctgggaatctgcttcagtagcaagtgnactgcctnnatgcaaatacngctgttgtctc

SEQ ID NO: 93131 - DNA, 479 bp, Triticum aestivum
  unsure (1)..(479): unsure at all n locations
  Clone ID: PAT_TA_93131
agaagcagcggatcgatcggagcagccactaccgtccctccaccaacancacctcctccaccacctccccctccacccacctccacgaagccagccgggagcggccgacggcgacatgtgggaagggggcgtgcacgggagccaccangacgccgcccgcctgctgcccccctggctcggaggcggcccggccgcgttcgccgaccccgtcggcgccgcggttggggccgggttcggcggctacccntgcgacgttgtggggcaagcaggcggggtgttcgggttcgggttcgaggcggncgtcgtcgcngcgcagcaacagcatcancagcaactcgcggcggaagctgccgcggtggcngccggggggcancaaggccgtcgtgtccgggctgctcngggagcctgcaggcgggagctgggccggangnacccccgggagatnatggacgccaaaggggctgggccgccctccccgn

SEQ ID NO: 93132 - DNA, 481 bp, Triticum aestivum
  unsure (1)..(481): unsure at all n locations
  Clone ID: PAT_TA_93132
tcaacacaaacccctgcataaacctcgaattggcttcagataaactacctcttggacgtcaactanatacggtacatctgtttctcaacctctaagactcacttttaaagatggaagttttactcgggataactggcaaggacttcactctgattgctgcttccaaagctgcgatgagaggtccaacagttttaacagctgccgatgataaaacaagtatactgaacaaacaaaccctcatggcatattctggagaggctggcgatacaattcaatttgccgagtttgtccacgcgaatgtccggctctacagcatgcgcaactcaactgacttatcaccgtcagcaagtcgcgcatttcgttcgtgataatctagcatcttcccttcgatcccgtaacccgtacaatgttaacttgctactgggagggggtgaccctaataactaataagccctccctttattggggtggnttacttaac

SEQ ID NO: 93133 - DNA, 470 bp, Triticum aestivum
  Clone ID: PAT_TA_93133
gctcccggcctctctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaggccttcagcctcttcgacaaggacggagatggttgcatcaccaccaaggagctgggaacagttatgcgttcgctggggcaagaacccaacggaggctgagctccaggacatgatcaatgaagtcgatgctgatggcaacggcaccattgacttcccagagttcctcaacctgatggcccgcaagatgaaggacactgactcagaggaggagctcaaggaggccttcagggtgttcgacaaggaccaaaacggtttcatctctgctgctgagctccgccatgtcatgacgaaacctcggtgaagaaa

SEQ ID NO: 93134 - DNA, 469 bp, Triticum aestivum
  unsure (1)..(469): unsure at all n locations
  Clone ID: PAT_TA_93134
gttcangaagtcttacaaagggttcaggatcatgcagactacatgccctcctatcancgggatcaggtcttgattgagaatttaggtccaggctggcgagatntattttcctccttcgatgaaactcccctggctgcagcttctataggtcaggtacatcgcgctatactaaaatctaacggtattccggtagctgtaaagatacagtaccccggtgtcgcaaattctatcgactcggacctcaacaatctgaaagtgcttctcatggcgtcaaagctacttccaaaaggcttatatctagacaagacaattgataacgctcgaactgaactggcgtgggaatgtgactatgaaagggaagcanaatgtgggcgccgtttcaaacatcttcttcaagatgagtcccgacngtcttggntcccgagttttacgcaanaggcgtcagggagacaanttttgactatggngg

SEQ ID NO: 93135 - DNA, 195 bp, Triticum aestivum
  unsure (1)..(195): unsure at all n locations
  Clone ID: PAT_TA_93135
cccgtgtgccgccccgccgaaagcagagatctttccggngatnncccacgatcgccgcgcgcacancaacaaatccggnctcccgaatctcancgccgcctccctcgatcgcgcactcctctctccaacctancaacgccgccgccctcctcanagccgcaggagggatngcctgacccggggggagaaggggac

SEQ ID NO: 93136 - DNA, 328 bp, Triticum aestivum
  unsure (1)..(328): unsure at all n locations
  Clone ID: PAT_TA_93136
tatgaaactaaagtactggnantggnactttcatacctccaggttggagggaggacaccaacagntttgtaggnanccgagatagacnatgaatccggggactcaatgaggaatgaggcggnattttccgnctttgtcttttcgggtacgttcgagatgtttcccgtacaagcgacaagccttcttggntcaacantgtncagatcttctggngatttctgggggcaaggtccattagagttttaaaanntctaaggaatcnttgtgttccaggtgacaacttttacttttatgcaaacgccatgagagtcnctnangtaaacgaaag

SEQ ID NO: 93137 - DNA, 521 bp, Triticum aestivum
  unsure (1)..(521): unsure at all n locations
  Clone ID: PAT_TA_93137
ctcgtgccgaattcggcacgaagacaagaaagtcatagccattcaaagcctctccatctccgaagctccaacccaacctcgaagatgtcttgctgcggaggaaactgcggctgcggcaccgcctgcaagtgcggcaacggctgcggnggctgcaacatgtacccccgaggttgaggccgccggtgccaccctcctcgtctccgccaccgccacccacaaggngaagctccggcgggatggagatggcggnccgagaaaggcggctgcggctgcacccagtgcaagttgcggnaacaactgcgggtgctcctgctgcaggctgctagatcatcatccgatnaatgcattgcaccgtgccgttgcgtgcatcatccatngtatcgatctactacnaccataccaagttnccgcaaccttgatcgaggggcctttatnttcgcaacctngaccttgcatcancaagtcagggtgccaatgccaatgattgttaaaaanggccccctnanataanaacctccctt

SEQ ID NO: 93138 - DNA, 512 bp, Triticum aestivum
  unsure (1)..(512): unsure at all n locations
  Clone ID: PAT_TA_93138
cctcngtcttgaaaattaaatcttcaataattaacatcagcttttgccacttaaaaaacttcaatacttgttcaaaaatcaagtatatcaatttaaactcttgaatatcaagataatcttccaataagtctagtagagtgcagtatcaacatgaaattatttaaaatattttctaccaccttggcngttagtatgttcgaaacaaatgtagctgcancaggctttaattggcaaggggcgtggntattcacttccnatcatattgttggggtgatgaatctgggccttgttttacaagttaggatcaattgatggatacccaaaacccgtatatgccaagtcctaaaagcaaaaaggtgtgcanggtggtctcccaaatttccactntcangatcacacctaaaaaatcctgggagaggggggacctggttaagtaccgtgcctgtgtccgggcccgccggaggagaacaactggccaaatgntattttcaagatantngaatnggngggcg

SEQ ID NO: 93139 - DNA, 467 bp, Triticum aestivum
  unsure (1)..(467): unsure at all n locations
  Clone ID: PAT_TA_93139
gtcgtgcccaantcggcacagagactccctctcgngcccgccnccgccgntgtcgtcatctccgcangcaagnccaccgcnaaagcgaggtcgaaatcaanccatgngnaagncgccaaggncacgaacgggnggtcaaccctcccgcaccccgcaaagntnaatggaacaaacccgccctgctccgccccggtaaagcaagttcgtggctccgagggtcaatccaccncggngcccgcgccaaactgtcttccaaanggngggangcctgaaanggagaagggctcgncaaagggngtaccnatggtganaaggaancccaaanctgnatcttccgtcctttcaaaggttcncggcaacnccactttcgnganggcgggnanaggncctcccggggattccngttctcaatcctaccgaacaaaccctccgatgtcccggccnaagaaagtttcgcaggcccaaag

SEQ ID NO: 93140 - DNA, 454 bp, Triticum aestivum
  unsure (1)..(454): unsure at all n locations
  Clone ID: PAT_TA_93140
gagaccggacncaaaggacactnaatccttatgtgactgggaattccgtgattgcaatgnaataaaangatggtgtgatcaaggcatnttaaacnggggcctccnatgggtcaacctttccnatacnaaanttgttngagcctntcaaanggangttnggaaancaataaccctattttnagggggagtgggggaagttcaattgattttccaangagatttttgngggtatcctnggattgaaanttaactttngactgatnntaatgtngggaatgnacgggaaactcnattggggcccccaaaggaaaaccaaangcccncccnccacaanaagttaatgttcaaacaaaggggcaaatnaagtttngccccctccaatnggaacnccccngggtggccttgggnggagtgaaaaaaagggcccaaaagggggantaagaaataatcttgg

SEQ ID NO: 93141 - DNA, 459 bp, Triticum aestivum
  unsure (1)..(459): unsure at all n locations
  Clone ID: PAT_TA_93141
aaacccgttngttcctgagctttgacgggtngagggaaaaataatgggttatnaacttccctcaaatccgattncttgnctcccgtttgaaaaatngcggtcaataacctccccacccgccgagggggcaataattannnccaacttaaccaaacctccaattcngcaacctttaagcttgggaggccnacccggcaaaactgggcaagccccccgtcaacgaatttgcaatgggtcaaggnccttnctngggctctgggtgggaagntaagggttacgaagcaaccccggtgcaacaaaaaagctttcttctnatccaangcntgangggggtggcgcattatgcccnggtgtttnaactanggcttgggtgggaagaaaaggccganggagancgnncaaatgaacaaaatgggttgggcggggttccaaaaatttgganccgntggtcccnggant

SEQ ID NO: 93142 - DNA, 386 bp, Triticum aestivum
  unsure (1)..(386): unsure at all n locations
  Clone ID: PAT_TA_93142
anctcntggccaattctgcannaggcgggncngcttanggggaatccngaggnggccgccgccnggaancttanaagggnccgtncccaactccccgttcaaacaaanccggccggccggagngacgcccgtaacaaccgcgngacgngngggcgggnnnggggcaatgtccgcctcgtcntttttctttcctctaantcccgaatggtctttncaaatctggggccggtcggtccgtttctataatccccaanggtcctggccggatctggggctgggcgaaactggtcccttaactttggggcggggaatccgcggaatttnggtcncccaaataagccctcccccgaatcttgngggaaggancgncggaaccctttgggatc

SEQ ID NO: 93143 - DNA, 580 bp, Triticum aestivum
  unsure (1)..(580): unsure at all n locations
  Clone ID: PAT_TA_93143
ttnacattcttctcaaatcgttagtaggggagggncccaaaaatgttcangnatactgtgcanaantcngtgacttgcactcaaggacgaaatcaatattcaaccaataccgagccaccangctgggnaatnnttccaggtccaagacaagtattataaaacagatngaagaatttaaatactggnaagacccgcntatccaaagcctccgcgattttggggaagtttggggtggggcaagtaatgtacnctgaaaatcctggaataaagatggnctttcangaaaactangaanaaggggattccantcctcatcaaaggggacngacaaaaaaagttttggggaacgaataacaaatccaatattacccaatgggggtggggaaagaacctgggtnaaattgncacaaaagctggnaaggggctccaacnggaantaaccgcangggtgggngccaaacatnctgggtngaaaaaggaagnaaagancttngaancaatacaaggggaggtcatcaagatttaacaaatgcaactttgggtcnagattccttgccangctccgaaggttttaaggaag

SEQ ID NO: 93144 - DNA, 585 bp, Triticum aestivum
  unsure (1)..(585): unsure at all n locations
  Clone ID: PAT_TA_93144
taaacaancccaggcggtccncaaaaaaaactccctttggatgaattgaatgggggcngnaaacaaatggggaaagaaaactttaatggggccgttgaagaantngtatcctcaatggcattttgagattaattttacattaagaccggntnaaaaaccctaatncangatttcccgttggacgntnatcntaaattgccgggncctccgaagaagacaagtactccgttattgggntntgggccggggactgttcngcccgtcaaggccggtcgatgtttctcctcctccgtcngtggttaaaccaaagcaatttgcncctattaaccgattgggtgctcnntgaaagnccgctttcaaaaaaataattaaaaagtgtnacccgaggtgctttggccnaaagaagcnttatttacgcctgcctnaaagggaagcancaattcnttatngccaataaaangaaaaaaaggacgnagcctngggagcngtggtntcaaaagaggtaacaaggtnagagncctcctcaaagggnctaatncncaattttggttggtacggtaaanggggattaantgggttgcaacn

SEQ ID NO: 93145 - DNA, 452 bp, Triticum aestivum
  unsure (1)..(452): unsure at all n locations
  Clone ID: PAT_TA_93145
ttttttttcaaaaaaaaaacacnttgtattggnaagtgcacaactcaggcacaagtatgctatttatatcgggcctgctatggaggcgacagatgatttttgnaccacaatccaatgaagccgtccatgcatgggaacaaacgtgtttgcaaaccgcnagatgggtcatcgtgcaatggtcgtccaccctaaatgtcatgtgcacagtagtttcctaaaccgacaaagtgcangcaaggnaagtttaagaagggaagtgattgggattttggncgagatggatccatacatgtggcaactgttgattcacctatatacctnatggaaanggcgggtgatgnaaaatacaacagtcgacatatccctggcnagtaccangtagtnactggntcaatccanatgnttgggccaagntgaatnggtcnggaggnnccgcgaaccttggggggccg

SEQ ID NO: 93146 - DNA, 510 bp, Triticum aestivum
  unsure (1)..(510): unsure at all n locations
  Clone ID: PAT_TA_93146
ctcgtgccgaattcggcacgagaagacgaccatcctaatactgaaggntgcacaacagtctcaagatcatacgccatctatcttggattttaatgccattaagtctaagcaagcctacagaagaatcctatccgnttctctctacccgctcaatccacatcatcatggacgacaaaaagaacgaggattacactataaagatgcctgatgttgagatgcgcaactttaaccgggcgcaactctgaangcacagagagaaacatttctcccgcctaaagccaggggctccggnatcacctcccactctcaatagtatcaccaattctccaccaatatccaatctagcgtactgtttagcaaggcatttccatgactgnnacaaataaatactgcgtcaagcgggaaaaggatggaatttgnntttctttttatttagcgatccangngcctangtttgcaataattgctattacagtatggttaacnaaattggcttggttaangaatcnt

SEQ ID NO: 93147 - DNA, 235 bp, Triticum aestivum
  unsure (1)..(235): unsure at all n locations
  Clone ID: PAT_TA_93147
angagaccantcctggtctctcttccgctcctaatcctctcctcccctcctcgcgcngccgncggggggccaanccggcggggttcnggtccccccccccccccccaagccaaagtatnaatnttgnaaaactcaaagaaagatggcaaggtggccgttgcgnacccggangggaaangggtancantgncccagangaacgaaagaaaggctgtttcacnaangaccaaaattt

SEQ ID NO: 93148 - DNA, 610 bp, Triticum aestivum
  unsure (1)..(610): unsure at all n locations
  Clone ID: PAT_TA_93148
ctcgtggcgaattcggcacgangtgggggaagaaaaaacggtaangccaaaancctactggcccctcgcgctgccgcctcaagatctccgatnctacccggtccaaatggcgagcaacgggggcggncgaatgctgctgtctgctggctgctgttccgcgggtgacgcnggtccgcctnctnggagatgtaccnaggggctggtttcgcccgncgtccnaatctcaaaaacaatcgcccgggcgggnttccnttnanctccctcctcttccttccctccntccttcggcctttttaatcggggtaaatttacccaaaaaaaagcctaagntgnncgtttaagnaaacctggnggtngggggtngcaaatttgtttgttatccaanaaaccttgtttggntccttaaattgntagactgggcaacctggttcaaccngcggntttgncatnaacaaaanaanggcttccctgngtttctcctggcgggggngtncctttttaccgaagggnccancaaacctncnccggggggattgntcccccccngagggancccaaatccaaaagggcnaggcnggtanctgganggggaaanaacacaatntttttt

SEQ ID NO: 93149 - DNA, 216 bp, Triticum aestivum
  unsure (1)..(216): unsure at all n locations
  Clone ID: PAT_TA_93149
tgccccagggctctgggcaccatcaataancggngtcatggtcgccgttgagcancgacnctccggatnggcgcgtcactgctccggntgcacttccacgactgcttnctccaaaggntgcgaacgcgtctgttctgctgtcnggcatgggacaaaacgctatcccgaaccgcggggtcgcctgaagggggcttcggncgttcatcgacagcatca

SEQ ID NO: 93150 - DNA, 511 bp, Triticum aestivum
  unsure (1)..(511): unsure at all n locations
  Clone ID: PAT_TA_93150
tgatcatttcatactaaaagaattaagatgggaaaaggaaagccccgtgggttattaacggntcnaaagctccaaacccatcnccgggatnaacgatgggccgatctctcatacaaaaagcncncgctggaacggngttcaaatcatcnccattccggaggatcatctcacgcnaagggcattgtgcttgaaaaggncggagtccagggcaancanccaaactcggccattcncaagtgtgttcgggttcaattgatcaagaacgggaaaaaagttacggntttcgtgcctaacgacggttgtcccaactttgtttgatgaaaaatgacgaagtactactggcanggatttggnccnaaagggaaaaggcaaaggggagatattcctgggagtgcgggttcaaagggtagtggaanggtatcaaggtgtggggaactaacctggctcctttggaaaagaagaanaaagggaaaaancctagantaataaggcctggcaaccttttgtaaaa

SEQ ID NO: 93151 - DNA, 500 bp, Triticum aestivum
  unsure (1)..(500): unsure at all n locations
  Clone ID: PAT_TA_93151
gacacttctttagctgtgaaacttggaaaanatcgtgggnctcctgacaatccctcaggtagctccaacttgtagggaacttctcccatccgttccaaaatgcgatacggtcctataaatctcggggctaactttcctttaactccaaaacgtttcactccgcgcaagggngatactcccagatatgctctgtctccaatctcgtaggttacctccttgcgttttgagtctacataactcttctgcctggactgggcaatcttcaagtcggtctcanatnagttttaccttctcctcaagactccttgntcaagtctggntcaaacaactgtcggtctcctaactccgtncccatatcaatggngttctggnactgcggccaatatanggcttcaaaacggtgtcaatcctcaaaactggggtttgggtagctattgtttgttcgangaantcttgcaataaggggaaaatttgtcatcccaacctagattcantaatct

SEQ ID NO: 93152 - DNA, 483 bp, Triticum aestivum
  unsure (1)..(483): unsure at all n locations
  Clone ID: PAT_TA_93152
tacctcctctgntttgnattccgncttccagttncaattccaaccgcaatcaatgggtgncatgaagatngccctccttgccgtgggcgcgatgggcgtcttgctaggnancgcgtcaagcggtaacctacaacgtcggcgatnagggnggntggnccctcaacaacgactacagnagctgggtgtccggcaagaanttcaacntgggtgatgagatngtcttcaaagtnctccgaacccaacgcacgacgtnggtccgaggtcaaacaaagggccgggntaacnactcctgnaagcatcgaacgggggccatnaacaanttnggnctcccgggaaacgaacgtcaatcaaccctcaaacgccaaccgggaaacccgggtaattcatctggtnggggttccctaaancaattgnaaggccccaancggccgccggccaaggaatgnaaggnncgttgattaaacggtccgcctcccgggntcc

SEQ ID NO: 93153 - DNA, 517 bp, Triticum aestivum
  unsure (1)..(517): unsure at all n locations
  Clone ID: PAT_TA_93153
nttttttttcacaacaccaaaagaattacatttggagaatcgncgntaccatcaactccgtgaatacttacaagttatcgaccgtctgaaaaaaaacccgtccactgcatcttctaactgctttaaatcaacctgagtttctctgaaactgacgaggtttctgcagctcctgtntcaaaatctgtgctggttccagtttccgcagttcctccactaatagcagttccagtctcaagtagtgccattagtatcggtgttatttagtccaaacaggttggggataggaacatagtcttgggagggtcactcgtcaaggntggggtgttccatcaattatcatcnaccccgcgaagatgggggncagcaagaaagcgataagaaatacagtcaacatcattaangtaaaggaacttgcgtnncgccaaacgngtcgccttgcggtagtttgggattgnttcaananagtanaatangggggcctganttgtcnaacntgggncggnggcaaaaantanca

SEQ ID NO: 93154 - DNA, 493 bp, Triticum aestivum
  unsure (1)..(493): unsure at all n locations
  Clone ID: PAT_TA_93154
atatccngagggcgctnatgcaaacgcntggtnatgatcctnacaaggtgcangagctcatggacaagcatccgtntcatcggnctccaagtacctatcnacgtgctgggggttgacggagtcnactacggnttctctggatgccatcgctacgaggntnaacancgcctangactcccaaccatccgctgcaaagtncnccgaggganaaaagaaacactgcgggaccaaatgcgatgaatccgtgggtagcgattaatggntgattcatggactgcttcaaccancaaagtgtcatctgttntgtcctagtggtaaaaaaaaacnttctccccctngtatnaatatatacgtgtaaatgttncccnatccaatgtgttaaataagcantttgttcaactgggngattcctgctccntcaaaaaaaaaaaaagggggggggccggtacccaaattccccctatnatgggtcntattacgcccgctcactgng

SEQ ID NO: 93155 - DNA, 538 bp, Triticum aestivum
  unsure (1)..(538): unsure at all n locations
  Clone ID: PAT_TA_93155
aacaactccgcccctggctccaaaanaaaagnatccngctggaggaggatgaaccttctgcactgcnagccngaaatggnantgtgatnaaggccccagtgaatgaagaagggaaatgttcaaaatgattggctggacgggaccctgtcncnagcgantcctgggntacacaaaaaattgcccgtgtgtaaaatccttggtgggaagacaatttggcgaacaaaggcaggaaaaggctgctccantccagtgnttatctaagntgttttgatttgaagggcctgtttccccgggncatnatttttggnnaacgggtcagctccaantccaaggtncgtgtgcaatgctcaatttgttggtggnaacactatttactgttgaccccgtattnatctccttgccaatgttaaaaccaaggtttatnctcaattccaggtggttgctaattttggtgngtttgaccgggaaannttcctttcctttcaanttccagngtanacaaaagaaaaanaaaaaaaaccncnnggggggggggccg

SEQ ID NO: 93156 - DNA, 362 bp, Triticum aestivum
  unsure (1)..(362): unsure at all n locations
  Clone ID: PAT_TA_93156
ctcgctgccgaattcggnaagagncaagatttccgcanatggcaggnaaaccatctggnagttaaaatatgctgantgccaagacgaggnagaggcggtcctggttcnacggggaaggaacccccctcccaatgctccanctcccggccgtcccaangccctatgtccaaatgcaagcgatcttagatcgctacaaaggtacttgggggcacaggtacngtntagacgttactgaagccgggccgggggganttgacaattctcttgngagnattggggaanggcaangtccttgantggaaaacctggnccttccaatgttcanctttgctccgggggccggagggtnaacnttgggtnca

SEQ ID NO: 93157 - DNA, 539 bp, Triticum aestivum
  unsure (1)..(539): unsure at all n locations
  Clone ID: PAT_TA_93157
agggtgggncctgcaagcgccccaagctgggatcaaggaanggnttaacantgggagctncnccccatccccgncaanggacgncgcccccgccgtcgtctcgccgtccccatanaaatacgctctggtggnggcacggngggcgtctcccttcctctgcaagtggaanaactcgtcnacgaaattattgtnggttgaccgaagaanaanttggaataacatggtggattcgcgttgcgaaatcccccggtggctggtgggaagtttctggggcgccaagggtggcgggccgtngcccggattgaattgccccgggtggattcgaacgaaccttggcaaaaaggactaacgttngggcaaaaatnaangttgcttccaaagggtgaaacaaccggacggaactggcccaaaacatccgcaatccaaccttacgggnaatccgggaggcatcccccaaccgttgctcaatggttcaaanggacggggngaaaaaanaaaaggaaaagcggtcatccggggggccgtccccgaaaaacaan

SEQ ID NO: 93158 - DNA, 555 bp, Triticum aestivum
  unsure (1)..(555): unsure at all n locations
  Clone ID: PAT_TA_93158
gtccgtgccgaaattcnggacgagaaccgaccgaagctatctanggttcggcgcctccccgccgggtcgncggcccgcccgnncgatnctctcccccgcccgtncgnccaaagccccgctccggggcgctncgccngctcccgggattcgcgnccctccgacctcngggccccncccgccgnggcgcgcccggaaagattgaataaaaactttttanagaatcaangggggcaagaaanaaangaaagaagnnggnccaaactcaaatgggggggggcctcctggtttangaaagcaaaagtcccagggggaantttccgtctccaataaaagaataatntggcctgaggnctttaaaccctaaccnaaaaggnacnaaacttaanaaattttcctttcccaanaccgggaaaagggattgaatctcaatggaaacttntgaaaggctaactcctacgaaccctggaacngaaagggatactaatncttangggngggggtcaattcaacttttcaaaccttccaaaggttttctcccttncctaacccctcaat

SEQ ID NO: 93159 - DNA, 507 bp, Triticum aestivum
  unsure (1)..(507): unsure at all n locations
  Clone ID: PAT_TA_93159
ctcgtgccgaattcggcacgagctcgtgccgcgaaagtctccgtcgatccgcaaaaaatttctacttctcaactacgccggagtggcctatgcaaccaaagagatgccagacccatacgctgaatgatgacggaataccaccacgtagaagatttctggagcgagccccacttatctttatttgcttatcagctctgtggctgttgcaaaaatactgaaactgaaacccacaagcgcaagggccctccattcatgccttggatactcataagtgcctgatagtatctctatctgcatcccagttggcgctcttacaacgacctggagcctgaataggtacccaatcgcaaagagcattgagcgagtgcgacttttagaaatccttcaaaaaactacaattttgtcacactaccaacaataaatgatacttgagctaactgttatgggtatggncacaaggtactttggtaacttctgaaattgattccgtgcgaattattgaccaac

SEQ ID NO: 93160 - DNA, 517 bp, Triticum aestivum
  unsure (1)..(517): unsure at all n locations
  Clone ID: PAT_TA_93160
gctccntgccnaattccgnaacnaggggcaaaanctanctagctacaagcctanacaatncgcagcccaagntatagtgcaggcacatangtntgaaacccatctanacaccgcanccaaggggagtaantggagacgcccaaagctgggccattctgctncgcccctagccatgggcgggtgccatggttaacctttcccaaagccccaagaactccgcctcagggactacctcctcacctcacaangccgcccgcgccggccgtcggtgtgggcggcgggtgagctgggagcacgaaancttgcangggttcgcccaagangctacgcccaaccaggaggatcaacgacctgccaaagctcccaagcactcccggggggggccctacgggggaagaaacatcttcctgggggttcgggccgggcgcgggcctgggangggcgggcgggccgcnggtgaaagcttgtngggtgggacgaagnaangaaagggacttangactanggggtcccaacc

SEQ ID NO: 93161 - DNA, 486 bp, Triticum aestivum
  unsure (1)..(486): unsure at all n locations
  Clone ID: PAT_TA_93161
aatacggatatccggatagaaaactgngtcattggcctggataataatcatgtataaagtaacagttattatcctcttcaatctgtagttcaccatagattgaaaataaaactacctctgaccataagattgctcaagtgcctatgcttagactgtgacatctatccgcttttgatatggctccctcgggctctgagtcatcggggtcgggttctgataaaatctcctcgccatcattgtcgttataatcatgaataccttctattgcggggttaaactttgatttcgccgtaagtgctttaccatgaaaatcgcttgaaatatgcgtaacaatgtacagtcctttactctggttgggaagtcatcactcttttgttgtttttcgtaatatacatttcattttcattgaaaaatccattcatcccttgtcnacaatagtttcttgggaagaaacnagntttacccataacgtttggtacatataag

SEQ ID NO: 93162 - DNA, 322 bp, Triticum aestivum
  unsure (1)..(322): unsure at all n locations
  Clone ID: PAT_TA_93162
atatctcttgcctaactcgcctggaatacctggntttcnccctgantcctttggtgttacaacgacctcgaagtaacccattcacctctgccaccagagttagatatgaaggagngtncattgatacntatggnagntagacaccttaaatcctgcaanctcttcacatccaantcacagttgttaacngagatctggcacnnctgngttgctanaggaatacccgtcccgncccggcantnaacagcaaacacaccacntgnnttttgatttttcngntttgcnagcaacgatgcccgttgcgntagctttaanaattacc

SEQ ID NO: 93163 - DNA, 186 bp, Triticum aestivum
  unsure (1)..(186): unsure at all n locations
  Clone ID: PAT_TA_93163
aggaattccgcaccaaggaangagcgttncatgaaagaanagatgatcatgtcgtcnccgggctccaancaactcctccgctccccngccggcggngnccccngctccctccccgcgcctcccttgganntctcctgcgtngccaacggagccgcgccaacgagtatgagaacggngcggccgcct

SEQ ID NO: 93164 - DNA, 496 bp, Triticum aestivum
  unsure (1)..(496): unsure at all n locations
  Clone ID: PAT_TA_93164
gagagagagagagagagaactacgtctcgagttttattcaatcgccgacagtcgtgtgtngagcctctttctgctccattgataactttcaggnantctccgacaaaggtcntatccggcccagcttttcgtgaacctctttatatatcatggctccgtcaganagcccttcgtcccgcgcgacggactggtcgtggactctgggaacgaaactaccgacatcctatcgtgtggngctcgtgctcggcctcattgtgttcagtatcacgctcgtatcgctatgtgtcttaaccatctatatacgccaacaatatcgcttccgcctgctcttaagaggccgttccaagcnaggaagatgaccaacgtaaccgctacattangctcggacagcgctgctctataangccagangacgagtgggagagtttgnatgagaagcgcctgtcgcgcctcgtgacaaacgcngccccaaancgganacantgcccaatcctaa

SEQ ID NO: 93165 - DNA, 390 bp, Triticum aestivum
  unsure (1)..(390): unsure at all n locations
  Clone ID: PAT_TA_93165
agaaatgacttttttgtgaaccttctcgatcccgcaatatcatggaaaggaatagacgacgatnagntttttgaaggaattgacagaagaacggacgaaaagaaatggattggatctcgggccgacttggtctttggctctcangctgaattgcgtgccattgcagaggtgtatggcagcgctgatggcaatgaaaaattgatcaaagactttatagccgcatggaacaaagtaangaatcnaagatttatttaatttagctcattaaaggttattaanattaatacaaattcanctgcgtataatgtntgtaaaaaancacccccaaanaaatnaacgggggggcccggtacccaattcgccctatagtgagtccgtantacgcgcgcc

SEQ ID NO: 93166 - DNA, 356 bp, Triticum aestivum
  unsure (1)..(356): unsure at all n locations
  Clone ID: PAT_TA_93166
ctcgtgccgaattcggcacgagtgattattttgtacttaacgcccacttcacttttgccttggtgggttcttgggcagtcctatgttaattatggttcctatgtttgcaaacaccaaaatcctggccctgtttgtgtatgtgaaaacataacctgtaggcagctccgtactgggaggcacttctagctaacatttgtttgtagatttgcatatgctttccaaaactctcaaatggttgtagcagagcatgttggatggtgtggtcataggtttgaatagaactcgtgccgaattcngcacgaggggggggnccggtacccaattcgcccctatantgaagtcctantacgcccncc

SEQ ID NO: 93167 - DNA, 510 bp, Triticum aestivum
  unsure (1)..(510): unsure at all n locations
  Clone ID: PAT_TA_93167
agatacagccccccatccgatctcgccgggaaatctctccgntcgaagcgaagcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccagcagcgtctcatctttgctggcaagcagcttgaggatggccgcaccctcgcggactacaacatccaaaaggagtccaccctccacctggttctcangctccgtggtggtatgcagatatttgtcaaagaccctcactgggcaagaccatcaccctggaggtntgagtcctcaagacaccattgacaatgtgaaaggcaagatncaaggacaagggagggtttcccaccgggatnaagcaagcgtctcatcttttgccgggnaaggcaagctttgngggatnggnccgcaaccttnggaagaactaaaaaa

SEQ ID NO: 93168 - DNA, 507 bp, Triticum aestivum
  unsure (1)..(507): unsure at all n locations
  Clone ID: PAT_TA_93168
tttttttgcntacagaatgtgatatttataaactagtttgggtaaatcttaaataatttctaaaccaactgctcattgatacatgtcgtgacaggtccctcatgtgcggaggcgtttgcttgtccctacaatgantctcatcatgatgccgccagtaacactgtagaattttcagtttctggtacgatttttcaatgtacatatttgcatggatctctctcccttccaaatttanaanaaacaagtgtaacacgccagttttggtcaaaattaactttgaacttgtaggctggataatcatgatctataaaatcgattgtggctttgcgtacattttgttgtcgaaagagaacccattaantagccacgattttgttggaaatgtttgtaatcttcantggcatctaacactttatcctccggaatcatgacntttgntgcagtcataaatatgaggcaaatgcacgcagccaaaangctcaagaataacgggaatganaaggaang

SEQ ID NO: 93169 - DNA, 508 bp, Triticum aestivum
  unsure (1)..(508): unsure at all n locations
  Clone ID: PAT_TA_93169
ctcgtgccgaattcggcacgagcttccactcatctccctccactctatccaccaccttctctcccgctccttaaccccccatccatagacacattcatcgcgcccactggcactaaccgaccgtccatcttgaagtcacctcttctagccctccaccttgaacgcacacgactcctcgcccgtgcccgggactacctctcgctcctcatttctaaattctcctcgcccaaggagacgagcttctggagtcgagccttttctatcaaccgctctaccattgcgcctacggcactagccctacatcgtcaaatgtacctgtcctttgccgaaggcgactcatcggccttacagaagatatgcttaagacggcattctggataactttagagtacgaatcgccaagtcgaccgagggaagagaagctggtctgggagttggtgaaatataacaagtccgcaaggntcatttcaaacagagctgcgaaaacaaccatcgatggggatgttgg

SEQ ID NO: 93170 - DNA, 501 bp, Triticum aestivum
  unsure (1)..(501): unsure at all n locations
  Clone ID: PAT_TA_93170
ccattctttgggttccactggatacaccaaagtcccacaatggcaagctgtctgacntgttcnttctcttcctggggcanttccaaagtaagaatcaagtcttgcccagtgatcactttctcaaatatccactccgggaggnagacctcactctggctcccaacacttggatccgagttcctccttccgctcancatctctaacaccaagcattccaaaactgtacacatctgacntgtatgatattcccccaaagttccttgaatatagctcccggggcaatataacccantgtgcctcntgctgcaagttaaagtaacaatgctctggtcccttgcacatanctttgctaaggcaaaaaatctggagatcttttgggtttgaaagtttgtnagnccaacaaagatgttgtgaggntttgatgtcaaagtgggagaangcgcctgggtggatccccttgatgcaaagggnatccaattcccncgggcaaatgcccaaaag

SEQ ID NO: 93171 - DNA, 566 bp, Triticum aestivum
  unsure (1)..(566): unsure at all n locations
  Clone ID: PAT_TA_93171
ttcccccgggctgcaaaggtttttttttttttttttaactttaaaacangttttaatataatcccnnggaattccggcantttaatttaaaaccaaacgggttccaaaacgaggggnggttatgccangccggncctgcaatacatctctcccgaaaatagaacaatcatcccatcttcatcaaaggggactaaaattaaacgcccgcnggaaagcggaccanaacaaagggggagaaacaaactgtacaaattaaancggggcaagcaacccaccgggcgtcatcaaaacaacaatcattccatccaatcaantcgntataaaagaaagaacacggnacgcccgcccgtggtanccgctgcctggctgagacaccccccgccaagaccanaactctttatttgcccggnctcctcctccggcctcaanggcctaataagtggggtncctgttgtcngtcaacggtccgaaagttganggccttngaatggcccccgccaccgnggaanccctagtttctttggcggctccaacgactgggtgcctggcccnagggacganccgcc

SEQ ID NO: 93172 - DNA, 507 bp, Triticum aestivum
  unsure (1)..(507): unsure at all n locations
  Clone ID: PAT_TA_93172
ctcgtgccgaattcggcacgaggcaaagagagtggcgctcggtccatcacttcttacaggaccgaattgaggttctgtctcaaaaagcgctaaactgcactgccaatcgaattacaaagaatttggtctactcgatgtttagaaatattgttgactatgatgagatttacaagggtattcagagtctagtcctcgatggttatgaggcactggcggaggttacattaccggaaaaacacggtcactggcttgcgccaccgcactttgttgaaaatgttctccangtagctgggttcgtgatgaattgtggcgatgtcttcgatcatcgagataccttcactgtattccctgggctgggagtgatctacgcctcctgggcgctctcaaaccgggagaaaaactgcgcgcctatgtgcgactgaccccggggaaaaggtagccgggaatatctaagtgatgtgtttattcnaangagctgacgaaantaatgggnatgtgttctcaaat

SEQ ID NO: 93173 - DNA, 483 bp, Triticum aestivum
  Clone ID: PAT_TA_93173
ttttttttttgaagctacgaaaactaatcagtgcggaaataaaatttccttgagtacttagttttctgcgataatttgaatagctgggctcactcaaattttgaaatgctaatataggatcgaaaaaggtactcataatactattttgctccccttccgccgacctttctcctagatgaatccaaatttggtaccaatgctataactggtagtttagtgcctctattttcatcgggcttaggtataaatccgatggctacgagatatgccagtatagtaccaatttgttcttgactcacagttttaccatcactgctatctatgccagtccaatggtatgcatcatctcttagcacactaactgcattagagtcattaagctcaggcgcttttgtcgaactaggcaaatcatcaatacacatatgaaagagcggcatgagtgcgtgttgttcgtcttcaggtgtgacaacaatcgttgggaaa

SEQ ID NO: 93174 - DNA, 482 bp, Triticum aestivum
  unsure (1)..(482): unsure at all n locations
  Clone ID: PAT_TA_93174
aatgtctaccgctgaggcaacccgtgaggagaatgtgtacatggccaagctcgccnagcangctgagcgttacnangaaatggttgagttcatggagaangtcgcaaagaccgctgatgttggtgagctcactgttgaggagcgcaacctgctctctgtgggttacaaaaatgtgattggtgcccggagggcttcctggaggatcatctcctccattgagcaaaaagaggagagccgtgggaacgangcctatgttgcttcaatcaaggagtaccgtaccaagattgaaaccgagctcaacaagatctgtgatgggatcctcaagcttctggactcccaccttgtnccctctgccactgcaagcaanagtccaaagggttctntctgaaaatgaagggngnctaacacangtaccttncggggttcaangnagggtgctgtnaggaaaaaaacaactnagaacactcctgttggaaaaaaan

SEQ ID NO: 93175 - DNA, 368 bp, Triticum aestivum
  Clone ID: PAT_TA_93175
tggtgtgcaaatcatggacagcgcgcttgttgctgccgcgacctacagcaatcggtacatcactgatagatttttgcctgataaagctatcgatttaatggacgaggctgcaagcgcattaaggcttcagcaagagagtaaacctgaagaaattatgcgcttggatcaaagaattatgacattgcaaattgaaattgaaagcttgcggaaggagaaagatgtcgcaagcctagagaggagagaaaagctagaactagatctgtcacaatgtcaggaagaagccgcaaagttattataggtatgggaaagggaaaaagctggaattgaagaggttaagagagttaaacaagatctcgaaaaagctcagt

SEQ ID NO: 93176 - DNA, 474 bp, Triticum aestivum
  unsure (1)..(474): unsure at all n locations
  Clone ID: PAT_TA_93176
caagcttttaaatcattcagttcaatctacacaacgagttgttcaatcattcattccacacagtttagtccaaatttcatcaacatggacgtttcagagagcttagtttattgcccggtatacgcgccgttttttggcgccatgggctgcacagctgccatcgtattcacctgctttggcgcagcatatggaaccgctaaatcaggtgtcggtatttgtgcgatgggtgttctcagacctgatctcattgttaagaacattgttcctgttatcatggccggtatcatcggtatctacggtctcgtagtatccgttttgatttcagatggtttgaaacaacanctgcctctatacaccggtttcatacaagctcggtgccggtctcagtgtaggcttaacaagtctgggctgctggatttgccattggaattgttggagatgctggtgttagangtactgcgcaacaaccaaggg

SEQ ID NO: 93177 - DNA, 478 bp, Triticum aestivum
  unsure (1)..(478): unsure at all n locations
  Clone ID: PAT_TA_93177
ctggtgccgaattcggcacgaggcgcgaatggcggtctccgtgctcttcctcatcgccggcgtcgtgctcatgctcgcgctgcacgtcctcgtcatcgtctgggcggtccggcggggcgccgtgctgcggctgcggggtgcggcgcgggagcgggaccaggagcagggggaagcgacgggtctgacggccgacgagctgggcgagctgccgtgccaggacttcaaggccgccgccgcggtcgggacgggcgccgccgagtgcgcggtgtgcctggaggcgttccaggggggcgaccggtgccgcgtgctgccggggtgccaccatgggttccacgcgcagtgcgtggactcgtggctgcgccaaagccgccggtgcccggtgtgccgcgccgaggtggcctgccgcggcaaggcggccggcgcggnggttgtcnattaaggcgccacatcngagatngtcnctgaaagactgggaagt

SEQ ID NO: 93178 - DNA, 385 bp, Triticum aestivum
  unsure (1)..(385): unsure at all n locations
  Clone ID: PAT_TA_93178
ccgtagnccgcgcgatctaccgttagaggtcacgacctactggttcgtcgccgtgctctgctgctgatgtctggaanctccangctcctgcggntcgacgacgacccagtcgatgagtcccctgagcggcgcccgnggccaggcttgatcgggtgggtcggtctcggtgctcttcgtctccgtctgcattcngcngtgaggcttgntgtaaccgcnacgcaaccggcangggccgcgaccgccctctgtgncgnttcgttgagtcgcccaccatanctatnctcantccccccgttgnntcntaactggcttgctcctcaangggaaaggctncgnaggtctccntggcgngtntttgtagngnacngaactcccgggcctcgct

SEQ ID NO: 93179 - DNA, 488 bp, Triticum aestivum
  unsure (1)..(488): unsure at all n locations
  Clone ID: PAT_TA_93179
cggagctgcagctcccaccgctgcaagggggcggggccgggaaggagcggagttggcgctgtgaaggtgctgctgcgggccgtcaagccatggtcgccgcctcctcctccttccctcgtgctcgtggcgccagagcanggagccctcagccatcgctgcaaagacgcggggtgcatgctgttgtggcaggagttgcaaccggtgatgaaaattgctgctaccggctatgcggagatggccggcggcaactactggtgttacaaccancagctgatggggagggaagacngcnaccttttggtgatgcaaccggtgagactatttgctggaaccggctgttgnaaaaagctacaaaccacacttttcattgctggaacangacnaacgtcnagtcatcttttgntgggaacaacttttgtttttgctacnacctgcaanaattttttgcnggnaaaaaaaaaaaaaaaaactccangggggggcccggg

SEQ ID NO: 93180 - DNA, 380 bp, Triticum aestivum
  unsure (1)..(380): unsure at all n locations
  Clone ID: PAT_TA_93180
ctcgtgccgaattcggcacgagggcgagttagtagcagtaggtggcaaagtggctttgttacctattccattaggaaccgcagattttttantccatcacattcatgcatttaccatacatgtgactgtattaatacttttgaaaggtgttttatttgctcggagttcccgtttgatacccgataaagcaaatctaggttttcgctttccttgcnatggggcctgggccgagggggaacangtcaagtatccgccngggatcaagttttcttacgtttattctggatgtacaaangcaatttcggtaggcaatttccatttcaattgggaaaagcaantccgctgtttgggggactanaaantgatcaagggggtggggg

SEQ ID NO: 93181 - DNA, 481 bp, Triticum aestivum
  unsure (1)..(481): unsure at all n locations
  Clone ID: PAT_TA_93181
ctcgtgccgaattcggcacgagcggatgtatgtgaactcggagaaataccaaaccaaagccatgaaagtggcagctacggctaccggggtggagtcggtgacgctggccggcggcgacaagaatctgctgctggtgatcggcgacgacgtggactccaacaagctgaccaagagcctcaagaagaaggtgggcgccgcggagatcgtggagctgaggacgctcgatacgttcggcgcgtcgtcgctcccgctcccggcggggaccaanggggcagtggcgccggggcggtcgccgtacaacggctcgcagcactaccantacgggcgcggcgccaggcccgtangctcaacaacaacaacccgtcgccgctnggccgcgcaaaggnggntacggtttagggtaacgttaacggaacanctactcncnccgcggtggggcgcaaccaaccggggaactactccccnctggtcgagaangaan

SEQ ID NO: 93182 - DNA, 367 bp, Triticum aestivum
  unsure (1)..(367): unsure at all n locations
  Clone ID: PAT_TA_93182
ctcgtgccgaattcggcacgagctcgtgccgaattcggcacgagctcagaccttcgatcaaagacgggagggcgacgcagccacatcaccaccaccacctacaaagcctcctagcctggtctctaggtggacgtacatggagacgatggtggcgaacggcggtggggagggccgggcggcggcgaggtacggggacagggagcaanaaggcgcggggtgcggaggcgcgcgccgcttccagatgccgctgcactaccccgaggtacaccaaggncaactacgaggccatgccccgagtgggaanctcgaaccgcctcctctccgnactnacnggctcccccgtcaacgggaagcgttcaancaaaaa

SEQ ID NO: 93183 - DNA, 467 bp, Triticum aestivum
  unsure (1)..(467): unsure at all n locations
  Clone ID: PAT_TA_93183
ctcangcctatttctggagtgagatacatttcttcaactgcttaaattattaccgcaatgagggttcccactgccagtcaaatatatttttcagagtgcaagccatcgtaccttctattaatatcatcaagttagttattgtcctatgcaggttcatattggcgcctctatctgtgttgattctcctcgtctacaagtactggaaaacaaggataagaattgatgcagtcgagaagttcctccgtatgcaacaaattcttggcccgacgaggtacgcctacaccgacatcactgcaatcacaagccatttcagagataaattgggtcaaggaggctatggctctgtgttcaagggcgtgctactgccangcaatgttcaagtcggggtcaagatgctaaaangnaactccaactgcaacggngaanactttatcaatgaggnctctaccaacggnaaggtncaacaa

SEQ ID NO: 93184 - DNA, 488 bp, Triticum aestivum
  unsure (1)..(488): unsure at all n locations
  Clone ID: PAT_TA_93184
cgagcacggacgccgcttccgttgaactcagaaattcgcatccaagaagactgctacagataaccttcccaccatctctcatgccgccgactcgagctcctggccacaagaagcgcgggcgtcacccaagagcaccctcgcccgctccatcgccgtcgccgttcgccgctccgccgaaagcctcgccattgttagcccctccacatgtggtcaggnctctgccttccancccanagncaagtcatgatcctcaagttgctgccccagtcaaccctttgcatangcattcctggagaagcctacggtttgggcacggggggtggngcanctctccttgtcaagaaaacggggtttggtgtgtactgccgggcgaagaaagtgggtnatgtgagggcttgggtcanaagggtaaagcnggggaaatgcnncgagcaattgtgacaagtgtgccttcactgaaaacggtcaaagctgggnaacnacctgtt

SEQ ID NO: 93185 - DNA, 420 bp, Triticum aestivum
  unsure (1)..(420): unsure at all n locations
  Clone ID: PAT_TA_93185
ctcgtgccgaattcggcacgagatcgggactttaaatcatattctttactcggccatggtatgcacttttgcttcggcgctaggattgtgggatctgctatggcgtccatgcttcgggaaatatttaagttgaaaaacattagacgcgctcccggaaaacgtggccagttttcggttgttgagcacgcgcttggcgggacgcagatgcgaatgtacttgaacggaagcgccaatgaatctccaatacctaccacactaactcttgagtacgatgaataagagtttatgcgactgttgatcggggaagcacaaaattttttcggttgagatttccatgacgaatgttaattagtagatagcttcttgtatgttttaatttantctgataanttttaactttaaaaaaaaaaaaaaaaaaaa

SEQ ID NO: 93186 - DNA, 498 bp, Triticum aestivum
  unsure (1)..(498): unsure at all n locations
  Clone ID: PAT_TA_93186
ctcgtgccgaattcggcacgagtctctctcttatctctctctgactctcgatccgatccagagctcgccgatgcgcttgcctagacctcaccggccaccacgtcaacagatcctcctggcgccccgttcccgagctcctctcctccgctcccgcgccctgccctgctactcggccggagctcgctggagcaagcggcgaccaggccagccgcacctcgccggctccggtcccatccccgtcgcctcggcaactaggctagccgcagctcgccggncccgtctcctcgcgcgcctctccagncccgaccccancccgccgggcccgggcccgacctcatcgnccccancaagnncgaacccanccggcgccgcctngcgcgnccgcantggancgggcaaccgctagncgtgggaaaattctccanagaatgaantggttggatttccnggnctggtagnttctaataagtacggtggggganttgnggtaaaaaaaaa

SEQ ID NO: 93187 - DNA, 498 bp, Triticum aestivum
  unsure (1)..(498): unsure at all n locations
  Clone ID: PAT_TA_93187
ctcncatccgcatcgcaccgcaattgtcttncttcctcnacggncgcacgcacgcanatttnatccaagggaggtncaagatggntctcaccaaaattggtcttgctggnctccccctcatngggganaancttgccctcaaaaatggaaanaaagggttccccaactctgtctnaaaacaaggacaactccaagggcgatgagactgtccaacgcgccaaagctnaaangnaaccttcccctgtngggnttccaatgaacctgcatccttccgtcaactccattnaaaaagcacgcggtcgtcatcaagcttgtcaaaggtgggggcaccaattnttcaaaacatcggcaacgctcccaggaaancttggtggaaagggggactggcatccttntatngngggaaaccaagtggtttntngaaacacacaannaaagggggaagaaaggcgattggtnggagccnttggnccncccctaactnccgggatggggtgg

SEQ ID NO: 93188 - DNA, 470 bp, Triticum aestivum
  Clone ID: PAT_TA_93188
gacctgtatcgattgaagcatccagtgcatgatggacaagccgcatctgcatccagaaggcctctccactgcatcatatatattttgcagctccacgactccatggcaggtaggaggcagcaacaatggctgaagtttgtatcatcgacatcaaatttgtgcagctgtatgtagcgttggacagaacatgtactctgcaccaaagcaagtttcatggatctcaggtaaggagcacaatattttctttgccatctgattcatgtatcctgattcaatctggagaagttgagatagggtattctttcagggacgatggaatttagctgtaggagcattggccatgcagaattttttagggaccttataggatttcgctttgaggtaaaattaattaatattgggtctaacaggtacatgtcattgctcgcatggttaatccccagggggggcccggtacccaattcgcccca

SEQ ID NO: 93189 - DNA, 468 bp, Triticum aestivum
  unsure (1)..(468): unsure at all n locations
  Clone ID: PAT_TA_93189
aaattctgtgattacgtactattaagctacttcaactcgatatggatatcattaatgctacttcggattatcttgcagaactgaggggcgaagcaccggtcgaacttgaacattatttcctggaattcgaagaccaatgggaaagaaaactatggcatcaattgacggntacactcatcnaatattttaaacacgaaaaaagtgcattccagcgtttgcctctatatcgaaattttatacttcatttcgcagacaaaatcaaccaactaaaacttgtgnctcttgccctgagcgctgcttcacaatgccgagatanccaagaacgccttgaattcctatcatcagtggntaccaaggntgncaatcccaattcacaggacgcctatgtctacgccacantcgccgtagctacggtaaaattaaagttacgtgatttcgagagcgcgaaaaaagaacttgggaaatcaa

SEQ ID NO: 93190 - DNA, 484 bp, Triticum aestivum
  unsure (1)..(484): unsure at all n locations
  Clone ID: PAT_TA_93190
ctcgtgccgaattcggcacgaggagtctcattatcatacggaaaattagttttctttgcggtttttccttctgatacaatctacaaagcttttggaccactacaattcccctagccatcgagacgcaaataaaaccttcgattacctacagacccgatacaaacgaagaaatagctcaaaattattcacctaacgtagttcctccggctacactatcgcttgctagtaattagcacgatcatacacaagtgaaacaaaagggattaggaaagggtacctaaactacacacaaaaaatgccccaagcacagccagagctcaagaagtatcttgataagaagactatttgttcaacttaacgggnagtagaaaagtaattggtatactaagaggatatgatgttttcctaaaagtcctactgggacgacgccnttntaagagaaagaacggggntgngaanattccncttgggntangggttncan

SEQ ID NO: 93191 - DNA, 487 bp, Triticum aestivum
  unsure (1)..(487): unsure at all n locations
  Clone ID: PAT_TA_93191
ctcgtgccgaattcngaacgaagntcgtgccgnattcngcacgaagctaagcctggnaaatttcaaatcaagtgcanagagataatgatggttcanctcacacnacacacattactttnaatgttagctatgagactttgatggggatgattgcaagctttcgtactcaatgtcatatcttgaccaantcatcaaagggacgtcccccanagaccncgctcgatacnaattcancaagcgctccatcggaacggcgtanctccttacnttcacaaagatcattatncccaactcatagctcaccacctcaagatataccttaatcttcttatccctaaaggcatcaattgngcncncagtgggcttcaagccttcgtgcaaagaaangcgacaacnatagatttttcttggncgctgnctgggacttnttggggtcncaatactttgggagaacgcagctctttcttgnnancagagaangacggca

SEQ ID NO: 93192 - DNA, 376 bp, Triticum aestivum
  unsure (1)..(376): unsure at all n locations
  Clone ID: PAT_TA_93192
atcagtagcaagcggcagccgcacatcagcagcttgctctgttccatccggcagcaatggcggccaccaccaccatggngctctcctcccccgcgatcaagctcgccggagcctcctacgccctcggcggnggnggncgcatcaccatgcgcaaggncgcgcccaaggnctccgcctccaacagcccgtggtacggncccgaccgcgtgctctacctcggnccgctctccggngagcccccgaagctacctcaacggngagttcccgggcgactacgggtgggacaacgcggggctctccgccgacccggagaacttcgccaagaaaccgcgagctcgaggtaatccantgncgctggggcatgctcggggcgctc

SEQ ID NO: 93193 - DNA, 459 bp, Triticum aestivum
  unsure (1)..(459): unsure at all n locations
  Clone ID: PAT_TA_93193
gggaatccgagtgacgtccggggagtaactggagcggtggagagctacancggctcgatnganatggaggncaangncgccgccgtgtccctgtcggngccgctgccccggtgccgcgtcgccggngggaacgggccgctcgcgtgctctgcgtctgcgcgcangtcgcgcaagtgcgggtatcancanggngctcctcttatatcgctcgctcgcccctcctcctctgntcgctccttccccgccgggcgcgtctaancgatgggcgcggncgccaaggnggccggtgaaggagcaaagaactcntcttccttgccggtggcaacagggaaagtngggtccccgnaccgttaagggaagctcaacaaancttgggnttccgcgtccgcgccgggcggtnccgggangaaangaaaaggggggtccccccctccctgcaaaaaacgtngaagcgggttg

SEQ ID NO: 93194 - DNA, 493 bp, Triticum aestivum
  unsure (1)..(493): unsure at all n locations
  Clone ID: PAT_TA_93194
ctcgtgccgaattcggcacgagttcaccacatctccataccagtctcagtatcttcacccgataacctcctccaaatctttatccgtcgactctagctcgtcatcggcatatagaatacccactcggtctagccatcacttcccggaccccatcctcagctggtccccctaatccgctgcccctcccagtgccccatcctcgggacaaacctctactccattcacactctttgttgtcaatagtcttgccgtggagcaggacacaaccgcaaaactggcagtcacaagctcaagctccgagtcaggcctggggccgatggtctgatcatcctcaccaaactataggactcatattatactgtcgacatatccggaataattcaaacctatgactctagatnttcggggagaggcgacatggggcctcactacatggcggtccaaaacaatattcgaaaggttccatcaacaanaactccgtngnaaaaaaaaa

SEQ ID NO: 93195 - DNA, 289 bp, Triticum aestivum
  unsure (1)..(289): unsure at all n locations
  Clone ID: PAT_TA_93195
agctcgtgncgaattcngnacnagccgggcctctctctgtttgtnctcgcgntccgccgtnccacgtcacgtcccgnctgngcccncgcgtgtgntcgcncnccgcctccgatcnatcggtccaccaccgcgccggggggcatngcggggtcacctcaccgncgaccanatcnccgagttnaaggaggccttcaacctcttcgacaangacaggggatggntgcatcaccaccaaggagctgggaacagtcatgcnttcgctggggcacaacaccaacggaggctgagc

SEQ ID NO: 93196 - DNA, 520 bp, Triticum aestivum
  unsure (1)..(520): unsure at all n locations
  Clone ID: PAT_TA_93196
tccaatccaagcccccctccgatctcgccgagaagtctccgattgaagcgaagcgaagccaaggctctctcctcctcctcctaagatgcaagatcttcgtgaagacccttaccggcaagaccatcacccttgaggtcgagtcctctgacaccatcgacaacgtcaaggcaaagatncaggacaaggagggcatccccccggaccagcaagcgtctcatctttgctggcaagcagctcgaggatggccgcacccttgcggactacaacatccagaaggagtccaccctccacctggttctcaggctccgtggtggtatgcaagatatttgtcaagaccctcactggcaaaaaccatcaacctcgaggttgagtcctcagacaccaattgataatgtgnangncaaagatcanggacaaaggaggggnatcccaccgggncaagcagcgtctcatctttggctgggaaagcanctcgaaggatggncgnaccctttgcagactncaacatncanaaagggng

SEQ ID NO: 93197 - DNA, 502 bp, Triticum aestivum
  unsure (1)..(502): unsure at all n locations
  Clone ID: PAT_TA_93197
ctcgtgccgaattcggcacgaggtgcttacaaacctgatgttaatatttctgaactcccatgatctatgtctcaaattgttcccaccaggaaaattaatgaagacacaacttagatttatcattcgccaagcgctaaagatatgtctttgtgccacgtaacctgactaaatattcagtatctaaaaatgatgagttaaatctgaacctttgctaggatctatatttgatgaaattttaccagattccacccttcatctaaaaataaatcataaattgaagacaactgctcacttcaaatctcgattgtaactattgttatggatcagggcactgaaaaattagtctctgaatatttgacattgctccacatttaagtgctggaaacttcctaaaaagatcaacaaatgtttcagtgtaggtcttaaaaatatagcgtaacaaaaaaaaaaaaaaaaaactcnagggggggggcccggtacccaattcgccctatagngngtc

SEQ ID NO: 93198 - DNA, 485 bp, Triticum aestivum
  unsure (1)..(485): unsure at all n locations
  Clone ID: PAT_TA_93198
tttattgacttgaatacagaagttcgtcttaagacaacaatagattcaagaatacatgttggntatctatagcgcctgtccagcctaatttctgtgtctcatgaacgcattagacctccgatatctttttctatactttgaatgcgactttctaattctagctttttctgttctaattcctcgatttcaatttcttctttcctgatttcctcatctattccagactctccaaattcagcaggcaattcaaatttcgaagactcgtcatcgttacctaaatctccatgatttaagacgttctagttgtcttgtctgcttttctactaactcttcataatgtggaaggggccataaagtctgtgcgtggcggctcccgaaaatcctggacgcgtcccacaacgccaggaacgctgtagactgcgttaagtttctcgattcctcgcagtaagacgtcaatattgatctcataggtcccaattaccttc

SEQ ID NO: 93199 - DNA, 516 bp, Triticum aestivum
  unsure (1)..(516): unsure at all n locations
  Clone ID: PAT_TA_93199
ctcgtgccgaattcggcacgagttacagttggtttcccccattatctttccatacatcatataaaatagtatatgtatcaagagtcttctatattttcctgccagtctgtcatggtctcgtgagggggaagaaagctatgtaatcttggccaagtataccgggcgtagcgtcgccaaatttaggaacaaaaaatttcaagagcatgagctgacaccagtaacctgcagtctcggtacttttgattaatgcaataagctatcttgtcagaagatcgtttcctcgcccgtgtgggctggtccaacaagtgtgtcagaacctgcatttgggtgcnacgagcgggggtgacgccaagtataaagagcaagctaatcaatctcaatgacaagtgtaaagaacactaatggcgaataccatttgataataacaaacactgtgataattatctaccaacttggcgttggggggtaatttcttcanggacnaaagagtccaagttcccggnggcggtttggggg

SEQ ID NO: 93200 - DNA, 525 bp, Triticum aestivum
  unsure (1)..(525): unsure at all n locations
  Clone ID: PAT_TA_93200
ttcgaaccaaagtgtcagagaagctgctatatcttgtattgaggaaatgtacaagaacatgggatctcagttccacgaagagttgcagcgccataatctgcctacatacatgctaaaagaaataaattcaagattgaatagaattgaaccaaaggttcccgcatctgatggtactgcaacacagcataaagttgcagcatctagatccgttagtgttaacccaaaaagaggcaagcccacggacaaaaagcacaccgagggaaagcacattatttggaggtaatctgattgggtgaagtgcangattcactgggcaaaggaaagctgagaaagataaacaaattgccttcggagggagggagggagggaaaaaanagtatgtcttgcctaanagttagatgntgttcatttattcctgcatacaaaccaaaatgncccctttatatactctctgggnttggatacaattgaccncctaccttggnagngaaggtgatancccggaagattgatttgggnaaatnn

SEQ ID NO: 93201 - DNA, 513 bp, Triticum aestivum
  unsure (1)..(513): unsure at all n locations
  Clone ID: PAT_TA_93201
ctcgtgccgaattcggcacgagggcaaataaacatggagcanctggaggaggngccgacntccaccancacngtggggctggncangtcgcccaagcctgcgccgtcgagcaacgggagcaagaagctgccgtcncggttccngcgggtgtgcgtgttctntcgggagcaacccggggaggaagccggcgtaccaactggtcgccgtgcagctcgggcancanctggtggagcgcggcatcaacctcntgtncngcggggggagcntcgggctcatgngnctggtgtcccccccggtgcacngcggcggggggngcntcaccngcgtggtggcccggtcggtcctcccncnggaagctcatcancgaaaacgncccncgggggaaganggtgaaaggcgtntcctncattaaacaacncaaagnccgtccattgtnccgcccgcnnccgacgncttctttggtggctcncccgcggntattgcaaccctngtggaagctgctgngnggtcatn

SEQ ID NO: 93202 - DNA, 506 bp, Triticum aestivum
  unsure (1)..(506): unsure at all n locations
  Clone ID: PAT_TA_93202
tttttaattacccgaatacataagtcgacagattgtanaatatattatgtgcatgtgcatatacataggcaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggcccgtggtgagtgagctgtttaggccttgccggactcctcgcagcccggtggcttgaaggcaatgaaagctgacgcactgcacctgggcgcatgttgtcgaatccgatgatgcggacgtacgccgtcagggtactccttcttgacctcctcaactcgttgantaccctgtgtggcgtcnggtgcacccggaacatanggcagcntccacattgtccagtaaccgggcgtcgtagtaacccgggaagacnccattgntgctcaccgggaagaatnnan

SEQ ID NO: 93203 - DNA, 495 bp, Triticum aestivum
  unsure (1)..(495): unsure at all n locations
  Clone ID: PAT_TA_93203
ccctcaggaaacgtcaacactaattgtcagctttatgttgagaatcagccagtcacgggtgtgagtgttcaaacattggcatggctaagagcagcacaagcatttgtcaagcatggcaggcggcatggtcgttccaactaatcggatgcaccttccttctctggatgctgattatggcctaccgagtctaccgagaccatgtatagatccttgcaatttgacttactcaaactacattaagcagtaattgtctcgacaccttcacgctttcactgttgacaatcacatttgtcacatgctcccatttaagagcaacagtatatcaaaccctctgaagtgactagccataatagtctcgcagtaactaccaaatatgggngtatcaagagccttcgaaattatccttgtcgtccaagtcataatcgtgggtgagagtggtatgaaagtcncaagcaaagaataattatgggnatcataaaaactataaaagggggg

SEQ ID NO: 93204 - DNA, 500 bp, Triticum aestivum
  unsure (1)..(500): unsure at all n locations
  Clone ID: PAT_TA_93204
gtttttttttttcggatggnttaaaatttcganaatttaaggctaatgatcgaggtcgcaacaaaaaagacacaatccctaatacccctactgaaaaaagttcgctgtacaatgcctaacantaatggactttgntgaaattcttagaggnaacacctacgtactcgattaaatttantttcgccaccaanccgatttccaaaacgccagggttaagtatgtgccttgtgttatcttatgtttgaagttttattttcctaataagtacctaggggtcaataggtanccttcaagaaatgaantcncttttccccntcantgatttatccacnacnaatagganagaatttgaatgtngaatttgttatttaaggnanggnttgaagagcctcatcaaacgcacacagtattggggcanacataatctccgggatcatctggngtaacttttgtcaaaataccatctnaaaacaagggagtccggngctttttgggnaaag

SEQ ID NO: 93205 - DNA, 513 bp, Triticum aestivum
  unsure (1)..(513): unsure at all n locations
  Clone ID: PAT_TA_93205
ctcgtgccgaattcggcacgaggtaatttatcctgcaacttccctattgttaattattccaccacaagctacatcacccaactatcgccgactcattatcaactacctaaccacctggagtggcctaatcactgtctatcgagcacttatcgatctaaacaaattctataacgaacaccatgcttcttcaatcacaaataagggctcttgtcctgctcgccatcgcaagcctatccatcgcagcaccatcccgaagccatgtcgaaaaacgaagcttcaaagttgctcgagttcccaacccancctatatgggccgaactcccggggccggaacccgtggctctcatcaaggntcaccggaaaattccaagtttgatctccctcagggtctcctcgacaccatgatggnaagcaacgcaaggggctggngcccaagtgttgccaacaccccacaaaaaagcaacaacctctgctaccggtgaaagagccgncagccnaaggntagtggggacn

SEQ ID NO: 93206 - DNA, 232 bp, Triticum aestivum
  unsure (1)..(232): unsure at all n locations
  Clone ID: PAT_TA_93206
ganagatcnntcgtgcgtgtgaagnagncccgctaaacctcgcaacagnccccgtnggcgancaacccagnccagccncccccctcaccaancccggagtcgtgnngcaaagncgcgatggccgggaccgtgnccaaactcgccgcnccgaggccggcggnngctngggccgctcccctcacagtctctccgctccgccgngcttcgacttcgccccctccgcncgccgctt

SEQ ID NO: 93207 - DNA, 470 bp, Triticum aestivum
  unsure (1)..(470): unsure at all n locations
  Clone ID: PAT_TA_93207
agcaataataaagtcngcgctgggctcagcgctcctcctctttctttccccaattcatccaagctccccggtgccaattcggcagctgcctagctgtgatacactgttgccttttcctttccccggcggcgggaggcgcggcgatggancgggcggaggcggaggtggggatggccggcaacggcgacgccgtcnacacgccccactcggcgccgccgacggagccgtcggaagcgggtgtcgatttgggagtcggtgcgcgcgtgcggggtgtggggccgggacntcgncaangacgaagctgcggggcccgcntcgtcatgccgctctacgcgcgccgcgccgtggncgccgccgtcgntgagaaagacnaagccgccggnntggcggtccgnccncngcgggnaaggggnnttcccaaggaattttcaannacgggngggnnaacctccnggggcccatcgncctca

SEQ ID NO: 93208 - DNA, 185 bp, Triticum aestivum
  unsure (1)..(185): unsure at all n locations
  Clone ID: PAT_TA_93208
ctcgtgncgaaatcngcacgangttactctgcnntgaanaaaangantgnagactcaacacctcctttaaatctgagggcnaaaaacttacctgctgccgccaattgaagtttatctatcaggatcanaactccttctacttttgttgtgaaatccacacggggaaatagtcctacgtctactgt

SEQ ID NO: 93209 - DNA, 477 bp, Triticum aestivum
  unsure (1)..(477): unsure at all n locations
  Clone ID: PAT_TA_93209
ctcgtgccgaattcggcacgaggtagttaggagtcaatttctttaatcctagtgtagctgctctcttaatattgtctgtaggttcttaattgttggtgtctcaaaaactgaatatgttttcatagcataacttgagggatagtttgtttaagtaaagtgcgaatttagctatcccttactatatagatgattgatctttgtcgaaaaatatgtggatgattgatactacgcttcctgtttctnacacagtgcactctgttatgaactatatatatgctgcactttcttcgtccgagtcatcgatgtagacgttttcctgcttgttgttgggagtgaaaataagaacctcttcccctggttaagcaataaatactgcatgcgcaatgcctgctgttttctcctccaaacttttgaatgtcaagtgggatnaaacatctaatgtgccataaattgcattttccccttttttgcttggtg

SEQ ID NO: 93210 - DNA, 383 bp, Triticum aestivum
  unsure (1)..(383): unsure at all n locations
  Clone ID: PAT_TA_93210
ntgatnttaatcggtgggtncatagtacnanngattgacacaatttcttgcaccgtncngattcaacttctggcgcangatgctggaaaagatgngggancacgtggtggccggggctcncccganagacgggcctcgtcaaaactccggcaaaggcgggnacgccannacaaacctccccgttaancantcacaanactgcaacggggaaggcgaattanccaagtccgccngtccntggccagancgaanccctaancaancgncccgggtggatcgcctngttcgatctgtccgacngccccccccggccgcggggcgggnaanccgntgtgggtcgnttccgttttttccaaccccccgggnaggcaaacgcctggtcc

SEQ ID NO: 93211 - DNA, 458 bp, Triticum aestivum
  unsure (1)..(458): unsure at all n locations
  Clone ID: PAT_TA_93211
tcgtcataaaataggagactttgcccgattatacgcaaaagatttgaaagcagatgaggtgccgagtacgatcaatatattgaggttaatttgtccgaactggagccgcatatcaatggaccattcacccctgatcttgcaacacctatctccaaatttagcgaggctgtgaaggcaaacaactggccggaagagttaaaggtcggactgattggctcttgcacgaaccatcgtacgaagatatgtcacgtgcagcatcagtggctcgtgacgctctaagaccangggattaagtcaaaagctttatttactgtcactcctggctcggagcaaattcgtgtactatcgagcgtgacggacagcttcaaacgtttgaggagtttggaggaacggttcttctaatgnctgtggaccatgcattggacaatgggaccgtcaaggacgtcaagaaangaacc

SEQ ID NO: 93212 - DNA, 504 bp, Triticum aestivum
  unsure (1)..(504): unsure at all n locations
  Clone ID: PAT_TA_93212
ctggatcagcgccctttacccctccaattgatattccggccgatatctacaatgctgctttagacatcaaaattcctataacanttgctatcatttatgccttttctgcattaattttgaacgcatataatcataaatgtggaaataaaccatggaatatatcaaaaactagaactttctctacatttgtgtttcttcacaatattttacttgccgtctactcaggctggacctttttgggaatgtggggaactatgcaaagatcagtacccatccctagcgacgggagcaaccttgttcatancgttgatgcgctgtgcaaaattcatggctctcgtgggctcggagaatctaataganttggccattttacgtcactatggnctcctacctcaactcaagggtaggcattccagatctaggtacaatggggcgcaatatggaatgaggggcttgtcattttacnggctggctaatccaatttatccaaaattctaccgaagt

SEQ ID NO: 93213 - DNA, 286 bp, Triticum aestivum
  unsure (1)..(286): unsure at all n locations
  Clone ID: PAT_TA_93213
gccaaatccgtctccgccaccggccagccagcgagcgattcgccgccgccgcctcaccgccgccgccggngtcaagcccctctctccacccaagcaggctcaccctcgcggncccgccccctcacgggccccgcgtctcccgcgagaancgcgcccgcccgcctanggttccgncgccgccggagaggaggggaggagcggaaccanggcgaaatggccggacggttcttctgggaanctcctcgtcatgggcggnngccgtcntncggaagggnccgtggtccat

SEQ ID NO: 93214 - DNA, 460 bp, Triticum aestivum
  unsure (1)..(460): unsure at all n locations
  Clone ID: PAT_TA_93214
aagaattcctatgagaccaccaacaccgtatatatatatactaagaggaggtattaataaaccaccaattgcacatctacctggtcacaagaaaccttcaatagtggttaaatgttctcaattttctacaagcatcgcaagtcaacaccaccgaccagacatataagtatggacattcctccaccgatggaaacatggctgctcttccggaacctactacagctattccgagtctccaactcctgtcatggagccacctcctcttgtagtcccaggcgatgttgcgggatcaaagccatcttctgaatcgactgcagaggagattggcgacccccccatggtttttcaataccctatcggataatatatgctgtcgctaccgaagatacggtgtatttantgacacgcaacaagcaaactcctctttgtgttgtggcaaatcttcactgggcaacctttn

SEQ ID NO: 93215 - DNA, 320 bp, Triticum aestivum
  unsure (1)..(320): unsure at all n locations
  Clone ID: PAT_TA_93215
gnggntatgaaatccaccgtcgacggnacctgcggtgggccctgnaaaaagtatgatnggntcatgccaacatganatgttccncctaaaatgaaataaaagctcanacnagtgagcagcgtcatcgtgcctatgcgtgtgtgtgtgggcaacaaatatgtataccatatgccgtgtcttcgtccgctgtgttttctctctcnanaaaaanttggngttgcttgtgttcaaatatccggaatatcctccgtgaataagtaaatgattgtgcgttggtggcaaaaaaaaaaggggggggccggtanccaattcgccctata

SEQ ID NO: 93216 - DNA, 478 bp, Triticum aestivum
  Clone ID: PAT_TA_93216
ctcgtgccgaattcggcacgaggaaagactggagagggcaatttagacttatggggcattaaacgatgcgatgtacttgtagcctcacatgatgccactgtgttgcgaacagtcggaatcggcctccttcaaaatctttggtcaaattcaatatcggctgagctagcacgagactcccgctctcctgaagacctcctttcgaaatatcgagatgataatcattcttggatagtaattattaagcaggactccgtattaaaagtaaaatcgatggatcggaaggatgccactgatgtcgatattctaccagctcagcttctgtcattccttaaaggtgaaataagagagagagatcgaaaaaatggcgcaaatcaaagagaaatgctacagcagaactgtggcacaggtatagaagaaagagagcaagacgtgcgagttttaatttccgggactaagtctaagaaaagttaatcgcaaa

SEQ ID NO: 93217 - DNA, 454 bp, Triticum aestivum
  unsure (1)..(454): unsure at all n locations
  Clone ID: PAT_TA_93217
tcgagttttttttttttttttttttttttcgtgatcatagagaattatcaatctagaatcaagaaataaattatgtgttgtttgtaagaaaccagatattacctggggacactacgcaaggcacctcgggctacactaaagcttcgacaatcttcatgaaaggaatctccactgacaccgggtgatgctaaaatacaaataatgagttcaagagtcatagctagtgtcatagcactctgcacacaaagaactaggtattaacttgtacttctcaacaantgagcattattcgcgaggatgttagttccttaaaatgatgggcattagngatagtatgcgatttaatattcatttccggnaacctcatccccctcgttagaatcagttgcgactcctcataaatctcgttcctagagctgcgagatctcacgagcctcgggaaaattcgccntcc

SEQ ID NO: 93218 - DNA, 476 bp, Triticum aestivum
  unsure (1)..(476): unsure at all n locations
  Clone ID: PAT_TA_93218
cccgcccgcccgccgcgacgccattagcagagccagagcagtgggggagaaggttctagaggaagaggaagaggaagatgaaggtgatcgagaagatccaggaggcggcggcgaatggccggaccgtcttctccttcgagtacttcccgcccaagacggaggagggcgtggagaacctcttcgagcggatggaccgcatggtggcgcacggccccaacttctgcgacgtcaccctcgacatcgccaaccgcatgcagaacatggtatgtgtggaaacgatgatgcacttgacatgcaccaacatgccagtggcgaagatcgataatgctttggctaccatcaangtccaatggggattcaaaatgttcctggcactttcgangagaattctccacatgggcaangaacaaaattttgttcaagttgcctgggtggnttttcttgttgctcctanattctggtgggagcaacaatta

SEQ ID NO: 93219 - DNA, 462 bp, Triticum aestivum
  unsure (1)..(462): unsure at all n locations
  Clone ID: PAT_TA_93219
atcccccaagtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccaagaagatgaaatccgccatgctggtgatcttggaaatgtgacanctgggagcggatggtgttgctaacatcaatgttactgactggcatatcccccttactgggaccaaattcaattgttggccgtgctgttgtccn

SEQ ID NO: 93220 - DNA, 222 bp, Triticum aestivum
  Clone ID: PAT_TA_93220
ctcgtgccgaattcggcacgaagcttaaaggaaaataaaaaaacagcaacacaccatctatagtcactccgttccttcacaacaacattaaaaatgtgtccgaggatctcgacaagtaactcttctctcctttaatatgctccttttttgagaaaatgagctccgctgtaagaatctgatacaaaaaaatatttttttcttaatccttggggaaaaaaaaaa

SEQ ID NO: 93221 - DNA, 489 bp, Triticum aestivum
  unsure (1)..(489): unsure at all n locations
  Clone ID: PAT_TA_93221
ctcgtgccgaattcggcacgagctcgtgccgaattcggcacgagcttcgagcgcctcctcctgtctcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccancaccggcagctgctgatgtagccaagcagattccaagctggcattccaggtagccgggcgaacaactactaccgtgcagatggncangaacacgggcaaacttccttacgganccgtccttcaaaccaaggnttaatgctgctccctgggggtggctcctccctggggctacttgttttgggcggggaaagtgaatgttaatgantgctggcttnatgaacgaacgaatgaaattgggcctggtatcnctggttanc

SEQ ID NO: 93222 - DNA, 167 bp, Triticum aestivum
  unsure (1)..(167): unsure at all n locations
  Clone ID: PAT_TA_93222
agatcgataatactggagagtaaaactttttctgcgatcgcttgtaacctttcatcaatctcttcttctgttaangccctganatctgaacacgntcctgccttcccancnaccctanganctcccacaccgccgaccnccacatcgnttttcctgnccncnacgct

SEQ ID NO: 93223 - DNA, 465 bp, Triticum aestivum
  unsure (1)..(465): unsure at all n locations
  Clone ID: PAT_TA_93223
ggtcgtcagccgccattctcgtcgtcgatcggctccggcccagcgcctgatatcacgccagctcgatcgccgctttcttctaccgtcgatggtcacgccgctgccccgcttccgcgctcgcgcgttccgcggcgcggcgcgaggcgcgccggccgagataccgctcgccgtgaggcggacgtggcagcaagccgatgttggtcgccgccgccgattcggagcctgccgtgccgaattacttcttgtgcccgatatcgctcgacatgatgcgggaccccgtgacggcgccgacggggatcacgtacgaccgggagagcttggagggatgntggagcgcgggcacccacgtgccccgtngaccgggcggncgctgcggntggaggagctcgtncctaaacaacccaacgaagangggtgattcaaggagtgggtncgtcncccaaaccggggggctcggggtaaaaa

SEQ ID NO: 93224 - DNA, 316 bp, Triticum aestivum
  unsure (1)..(316): unsure at all n locations
  Clone ID: PAT_TA_93224
cgacgacgtccaagaagaagcagagcataccaagaagaagcagcgcaagtagtaataatactctctgggagggaggttagtttaggccttggaacaagaacccatactgcctacttgcaaatgtgtcatgaggaggaagatattttcaatcatttagaagaatcggtgaggttgatttagctgtctgtcgcattttaggctttattattctagtacaattggaggctgttaaagacaggccactctggtggactctgttttgtcttgtggcacctcatcattatgcaatgccattgtcttgttgcaatgaanaaaa

SEQ ID NO: 93225 - DNA, 241 bp, Triticum aestivum
  Clone ID: PAT_TA_93225
tcgagttttttttttttttttttttttttttgcccttggcatgtatatgatttgagactggcatgtgtctaaatacccacttatttacattcacttaattgggctatattatcccgttgttccatattaccaaagccattgtgcacgccatcaacctgacctcatctgccccgagccccatgccacccaccatccagtaacaaatgccatgagccctcgagtccaacgccatacaatccgc

SEQ ID NO: 93226 - DNA, 270 bp, Triticum aestivum
  unsure (1)..(270): unsure at all n locations
  Clone ID: PAT_TA_93226
gcattngttncaacttcaaggcnggagaagaccgcaccttcttcggacttcctcgagcgccgccgntggnactcgtcntctccngcatgggcgcggcgtngggaangnccaagaccnnagttgnggtggtnnctatggtngtgatggngtcaggagctgntgaatgngatcaatcacagaccgtcntcatgagccggtggtggctcggggatctacgagttccatcagttttcgtcancatctcacacccggagattaaacacccanggg

SEQ ID NO: 93227 - DNA, 460 bp, Triticum aestivum
  unsure (1)..(460): unsure at all n locations
  Clone ID: PAT_TA_93227
tttttttttttttttttttttttttttttttttttccccnggaattcctcccctcactcgcagggcaggtttcatgttctcgggagttagggaggtcttaatttctcctcacatgtccttttattttcagcagccttgtggtggttcgctgttggctagcctacttttacaattgcctttgcaaaggtacaataagtgcaatatgtagagtatactccatccgtcccataatataagactttattacatccaatagctaccttctccttctttaccttcgcctatccttcagccccctttagcttttcacccatcaaacacaaaacatctaactgcaagatcaggtattacggggaacnatgtctttactttgatgactcttctcaccaacatcataaacgtatcgcaagagggggattaagcttctcgctctgggcagtcatcctgtcatataaaccgg

SEQ ID NO: 93228 - DNA, 177 bp, Triticum aestivum
  unsure (1)..(177): unsure at all n locations
  Clone ID: PAT_TA_93228
cctaaaaccaagaagcctgaagataaaaaggngaacaagtcgaaatctgtcgacaacgtgaacaaagnagaagcaagactngaatcatcagaaagactccagcctctgcggacgataccgacgcntctgagtcccgctgaatcggataatgatgaatcagacagcggaatcagacaa

SEQ ID NO: 93229 - DNA, 227 bp, Triticum aestivum
  unsure (1)..(227): unsure at all n locations
  Clone ID: PAT_TA_93229
cacacacacgccaccaaattcatcaagaaacctggagaggatcatggncggcgtgancaccaagtgtggtcggnctcaagcccgccgcggcggtgacgcantccgcctcnccggncgacggcaaaagcgcgtgnaggtcgccccgcccaangaccggcgggcggcgcttctcggcctggcggtcgtctttcgccgtcaccgccgcctccggcccggggtcggctcaa

SEQ ID NO: 93230 - DNA, 582 bp, Triticum aestivum
  unsure (1)..(582): unsure at all n locations
  Clone ID: PAT_TA_93230
anggcaaatttacctccaattttgattttaancatcaagcaaatgggncaatcaaaacccctttggcgcaantgggggtaatgtgccccgagcaattttttccgaccgcccaactggcacttttgnccaanaaaacaactttnggnctttgatgctaaaactttattcccttcccgtcccgggaacggggtcaaaatggtaaccctcctttgcgaatcaagcccgaagattggatattgggaattgggcttgacaagaggggctgggttgcaggtcttaataaaagaagaatcttgaaanggtgacggccgggtttacaaggccttgtagggcacatacgttccaaacacccggttattgctgggcctatatcgaacaaggaaactcaancgctcctcctcagctcctaatagaatgattctaaaagaatgggcaaatgtggtggtatcacgaaatccggcaagncggntcttatgtgatgggcctaatgtactttgcgctcnnancaaaggatgggtttccatganggattcctttaaaggcnaagcccnttcaactttanctcccncnccaagacaantn

SEQ ID NO: 93231 - DNA, 295 bp, Triticum aestivum
  unsure (1)..(295): unsure at all n locations
  Clone ID: PAT_TA_93231
ggcacgaagccgctcgaaaacangccgaaaaggaagagcgtgaaagactagaaaagctaaagaaagccgaaattgatgcgcgtgaatccaagcgaagagaggctgcattgggtccaagctaaaggtaggggtaaatcgaaagcgtaaatttttttgatggtctcgtcaatcctgaacttgacgaggcgagtatatcagctcctcaattagtactatggaaaggtctgatctttcatatattgaaaatgtataatgcaggctgtattcttcggctgcaaaaaaaaaaaaaaaaaaa

SEQ ID NO: 93232 - DNA, 622 bp, Triticum aestivum
  unsure (1)..(622): unsure at all n locations
  Clone ID: PAT_TA_93232
agtttctaccgaaattgatggctgaaattttctttctctactgagggggatntggtaaaaaaagccctgcatattatccgaagctatacaaaatctattgggnatttgacaanatccgcgaagntctcaanaaaaaaattgcgtctacatggggaaggggtattcaaagcctgctcgtaatacctacagcngtggaccaatggcaatcaaatgtaaaatttggacctctcaatgttctctcaaaagtacaaagcctaattgcctggcccgcgngaaaagctgggcaacttttcctaatcctctccttttgttanggccggtaataactgggaattgggtacaaaaaagccnaaaaacctgggggaaggacatacnangccaaaggggnaacaaangancccgggggaagttgaagttcntggnttaaacaaaaaataattccgagttaattaataaaaaaaaggnttggggntaacaaaggaacctaatcggtcaaanggggtggcctcaattcaagaaaaattaattgggnggaagaattnacaaacaatttggggctgggctngtggattaaccttaaacaaatnctcctcccaaaaacctaattgggggaagaaacttg

SEQ ID NO: 93233 - DNA, 405 bp, Triticum aestivum
  unsure (1)..(405): unsure at all n locations
  Clone ID: PAT_TA_93233
tgcacatcgccggcgacccttcctaaaccgcccgccttctcccgccgcgttggtctangctccaggtcaacgcgggnccgtcatcgccgcccggggcactcccgcgcgcgcccaanagcgttccctccccaaggggtanctgcccggacctcggaagttctacaagatnnaggccatcctgaggccatggagggtgtcncacgtctcntcgggtttgctacaaatgggggatnanaggcgtgacggtgtctgatgtgcggggttatgggggcgcanggcggggtcnacgggagcggtaccaagggtcagaattttcaganagatacatttattgctaaagttaaaatggcanataagtccntgntgcaaaggagcaangtttgtngccantaanttgacaaaaat

SEQ ID NO: 93234 - DNA, 495 bp, Triticum aestivum
  unsure (1)..(495): unsure at all n locations
  Clone ID: PAT_TA_93234
ngccaccgtcgcacccttccaggggctcaagtccacggncggtctgcccgtcagccgccgctccagcggcagcctcggcagcgtcagcaatggnggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcaagcaaggttggcttcgtctttcgtgagcacaacagctcccccgggtactacgacggccgatactgggacaatgtggaaagctgcctatgttcgggtgcaccgacgccacgcaggtgctcaacgaggtggaggaggtcaagaaaggngtaccctgacgcctatgtccgcgtcatcggnttcgacaaacctgcgccaagtgcaagtgcgttcaagcttcatcgcattcaaggcancggggnttgccaaggagtct

SEQ ID NO: 93235 - DNA, 612 bp, Triticum aestivum
  unsure (1)..(612): unsure at all n locations
  Clone ID: PAT_TA_93235
cgntaanngacgttcaatcgcaacgctgttgggttgtgtnncctcccgaaaagggaaantntctngccccantggtgtggcaaaganccccgccctgnctgcaanggncaaaaatgncgaattccccaaataagtcccngcgccgggcctgggtnaagnccngcctgcnaaccctgggccgaacgcccccctgcngcccgncccgctgcttgcnnaacccggtggaagcaaagccctgccnangcgcaantnaatgccttgaantccaaaacaactgtnatttggtnaagncccctggttatgntctgggaatgttaattggnngtggtggtcctgngtgnccgtngattgtngggnaattaaaaaatgttcaaccggggatttggatncaatggangaacaaaacaattaaaatatattggggaaaatngttaatcttttagncaaaanttttntatactaaaaacctcngaaggggggggnnccgggttacccaaatttccncccctaanaagtgnagtncntattaacgccgcngnctccantgggcgcggtncgttttaaaaaccttngttggactggggaaaaaaccccggggggggttaaccccaa

SEQ ID NO: 93236 - DNA, 488 bp, Triticum aestivum
  unsure (1)..(488): unsure at all n locations
  Clone ID: PAT_TA_93236
agccaccgtcgcacccttccaggggctcaagtccacggncggtctgcccgtcagccgccgctccagcggcagcctcggcagcgtcagcaatggcggaaggatcaggtgcatgcaggtgtggccgattgagggcatcaagaagttcgagaccctgtcttacttgccacccctctccacggaggccctcctgaagcangtcgactacctgatccgctccaagtgggtgccctgcctcgagttcancaaggttggcttcgtctttcgtgagcacaacagctcccccgggtactacgacggncgatactggacaatgtngaagctgcctatgttcgggtgcaccgacgccacgcangtgctcaacgaggtggaggagggtcaaagaangagtaccctgacgccctatgtccgcgtcatcgggcttcgacaacctgcgccaaggtgcaagtgcgtcannttcaatcgcattcaagccaccgggttgcgaagga

SEQ ID NO: 93237 - DNA, 615 bp, Triticum aestivum
  unsure (1)..(615): unsure at all n locations
  Clone ID: PAT_TA_93237
actnggagtngtgcacctttngcaatccctttctctatccacaagtcaggtcctccctatttggnataancaaaacctccaatgttcncaaagnaggtgggacaccncanagcaaactttcatcngcaagcaagaatgatcttggcaagagatgggactgtcaagcaagactggaaaagcacacaagcgacanagaaagttgctacctccaacccgnactgcaaaatgaaaaagcatcctgcacggtttgaaaatccccctcaagacaaggaaaaccctcaagcaagggtttcacccatgggctgggcgaaaaagcgggaaagcgnggnaagttagtaactggtgttnganacaaactcctgggnaaatggctcctcaagttgnggcaagtgncctggtgggaaacctcttcccaaacccgggantcgcccacttcctaactggaaacaattgttaaacgccatcctgaacangttgcctaacctngaaaaatcctnagccatggggagggggcntccncaatcaaancttgaagcccaaacnttgaggaatttgcncctggaacnaagttttccgccctcaangaaggaaaagaaccggngccttccgagaaac

SEQ ID NO: 93238 - DNA, 203 bp, Triticum aestivum
  unsure (1)..(203): unsure at all n locations
  Clone ID: PAT_TA_93238
gcaaccccccgccccctcgccactccancaggaagcacaagcacaggnagggcaccaccgcaggcagagcccagtagaagcatacatactcttcaaccaaggcaaggcaagggagggagcgagggatctgcaagatcgatcagaggatgaacgaggaggcggggttntctnctttcttcntttttctttcntnttcntctctt

SEQ ID NO: 93239 - DNA, 594 bp, Triticum aestivum
  unsure (1)..(594): unsure at all n locations
  Clone ID: PAT_TA_93239
ctcgtgccgaattcggcacgaggagagcgcacgcgagatggcagcctccatgatcacctcgccgattgtggcgccgacgaagcgtgcccgtccctctcccgccggggctcctccttcgccgtcgtctgcaagcggtgggcaaagaagatcaaggtcgataaagcccctcgngactcgngaggcggcttgacaagtcgacatccgacgccaacgggcaaggaaagggtcngngcaaagaaaggggccgtgtaccaagtttgttggacanangtacgggtgccaaacggtccgacggggntacaagcccaaatctacacggccaangaggggaatgggtcctggaagtcctggtggacccgctaccgcccgggcgggaaacggacccggggggcttcttatcctgggggccggtcaccctccggccgggcctccctccggggncgggcgggcgtcctccctccgtcctaacaaacaccaagcggcctctccgcccgggcntaaaagaagaagcaatctacggtggtaacnacaaggggccgggggtctctgctttgcaatgcaacgntctctggtaatcctgcgntaggcctaccc

SEQ ID NO: 93240 - DNA, 478 bp, Triticum aestivum
  unsure (1)..(478): unsure at all n locations
  Clone ID: PAT_TA_93240
aattccctaagctgaccagttatttgcgcctaatgcgccnggtgaggcgtgaaggagcaacatatctcctttggctaatatttcatttggaataaatttcttgaacaaaaaaatggnagtctcatctattcaggacagaacaaacgaattcagatcggtcctaacacaagtacaaaagcggnaagcaacatcaaaatccagcacacagagacagtcccttcttacggnatctgagaaggtcgcagcaaatgctaacgaaaatggtgactcgaaacctcncagatnaagagtttgcaaggaaagctgcaaaaattgggagaggaattgcatcnaccatgggaaaattaaaaaagctggcgcaagttggnaaagagaaagacgctttttgacgaccgaccagtagagattaatggagctgacatccgatcatnaacaagacctttccgcattnaatcaacaaaatttcaatggccccaga

SEQ ID NO: 93241 - DNA, 492 bp, Triticum aestivum
  unsure (1)..(492): unsure at all n locations
  Clone ID: PAT_TA_93241
aaatcacagtagaaatgtctctatccaaagccataaccaactgcctcaatatcaattgtgcacgccgagcaattttaacgcttggacccaaacgtgcggcctcntcaatagccccnagttcacagcaaaagttactcgcagacaacttgaaagatgctgatccatcgatttatgagattcntcaaaatgagaaacgaaggnagaaacactacatcaaccttattccctccgagaatttcacttcncaagctgttttanatgcgctggggagtgtaatgcaaaataagtactcggagggttacccaggtgctcgctactacggtggnaataaatttattgaccangcaagagctactttgccaagaaacgtgctctgcaagcttttggcttgaatgaatcanaatggggcgtgaatgttcaaccactatccggatntcctgcaaatctccacacattctctgcactcaataatgtgcatgaccgggaaaatgg

SEQ ID NO: 93242 - DNA, 504 bp, Triticum aestivum
  unsure (1)..(504): unsure at all n locations
  Clone ID: PAT_TA_93242
cccgggcttcaacacctaaaaaatcttaaatttcacccatcaaatcatcatcaaatcatggctgaaattcgcaaaaaactagttatcgtcggtgatggagcttgtggaaagacttgtttactgattgtcttctccaagggcacatttccagaggnctatgtgccaactgtcttcgaaaactacgtcncagatgtcgaagtggacggaaagcacgtcgaacttgcgctttgggatacggctggtcaagaggattacgaccgcctgagaccactatcatatccagactcccatgttatccttatctgtttcgctgttgattcaccggattctcttgataacgttcaagagaagtggatctcanaagtattgcatttctgttgtggtctccccataattcttgtcggatgtaagaaagacttgcgttatgaacaaaagacacttgaggagcttcacaaaancaatcaagaagccagtggctccaaaacaaaggtgaagaaanccgaa

SEQ ID NO: 93243 - DNA, 487 bp, Triticum aestivum
  unsure (1)..(487): unsure at all n locations
  Clone ID: PAT_TA_93243
ctcgtgccgaattcggcacgaggtttttttttttttttttttccaacctcagttaaaaattaataatctctagcacgaaacttttggatgattactataaatctttgagtacatggctaaaaaattcactcaggttcaggtgaactacgccttgttagaattgtttgagctaaaattctgggcgtttaagggtctcatcagtgggatatccaaattaagcagccaagtcagtgtaattattttcgtccctaagcaaccataagaactctaagctacatgataaagcgtaaattggtatctagaggatggctacaactaagttgcggcttctgggtgtattttgtagccaagaacatcacgtatgctgtttagaaagttgaaggtaactctgatttgggttcgctttcaaggcccgaaataaacgcccaatgacattgctccggttgcntgagaagcgataagttgcatcagccgatgtttgatcgtc

SEQ ID NO: 93244 - DNA, 472 bp, Triticum aestivum
  unsure (1)..(472): unsure at all n locations
  Clone ID: PAT_TA_93244
gaacgctcccggcctctctctgtttgctctcgcgtccgccgcgcccatcctcgtccgcgcctgcgccccgaccgtgctcgccgcctcccgcccgatccaccggtccaccaccgcgccggnggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaaggacatgatcaatgaagtcgacgctgatggcaatggcaccattgacttcccagagttcctcaaccctgatggcccgcaagatgaaggncaccgactcaagaggaggagctcaaggaggccttcaaggtgttcgacaaggaccaaaacggnttcatctctgctgctgagctccgccacgtnattgacgaacctcggngat

SEQ ID NO: 93245 - DNA, 402 bp, Triticum aestivum
  unsure (1)..(402): unsure at all n locations
  Clone ID: PAT_TA_93245
agaatctccgncagatngangccaangntttctcntcctcctccccaagatgcaaatctttgtgaagaccctcaccggcaagaccatcacccttgaggtcgagtcatcggacaccatcganaacgtcaatggggaagatccanggacaaggagggcatccccccggaccagcagcgcctcatctttgctggcaagcagctcgaggatggtcgtacccttgctgactacaacatccagaangagtccaccctccacctggtgctccgccttcgcggtggtatncagattttcgtgaaagaacctgacgggcaaagaccatcacgcttgtggtggantcctcggtancantcgnacaacgtcaaggccaangatccaanganaatggaggggcatcccccccgg

SEQ ID NO: 93246 - DNA, 337 bp, Triticum aestivum
  unsure (1)..(337): unsure at all n locations
  Clone ID: PAT_TA_93246
ccgggggtggaggganctccgctcctccgnccaagncaatcctcctaaatccaccgccgccgntncgccgtgatggaccgcancagcagcagcaatagcgggggnggggggggnnanaacccgcacctcggggtcaataagcacgggcggaacatccggaatagcaacgcccgccgccgcctcctcangagccgccccgcccgccgtacccccagccggaggtntacnacatcagnaagaaccagttccncgacatgggtccatcangctcatcgccggnacgccttcccctccggccgnnctcaggatcancatcgncccccctccgccgntncag

SEQ ID NO: 93247 - DNA, 220 bp, Triticum aestivum
  unsure (1)..(220): unsure at all n locations
  Clone ID: PAT_TA_93247
cccctccccttcacatcttcccttgccnccgccngaggnanccgccggnaagcccgcanggtgtctattagggtggtggcgaggtcttcgnccgcggntctttctcgggaacgggtctanggttccaggcggcggactggtggnnagggcggcnccgtcccgnaggtcggcngcnttcnctggaaatgtgtccncctcccctcnggtgnttggntngcga

SEQ ID NO: 93248 - DNA, 471 bp, Triticum aestivum
  unsure (1)..(471): unsure at all n locations
  Clone ID: PAT_TA_93248
cattanccctaccaaccttcattgacatacgagcccgataaaagcatgcgatctttactcatcttagccgtggntgcccttttcacgtctattgacgcttctcatttcccatttcgtcggcacatgcgaagacgtctacataggagagaggaaccccaacagagctttgcctgcaggctcgccaagtacgacagtgccgacatagagagggctcggaatcaagcttgcgttcttctaactcaaggngatacaaccaagggaagtcacaagtttcctctcgattatcgtaacaaccacctctatcctgtcttaagtggcggnaagatctacactaaatggnccttccatgacacaagactttgacaaactacatttcatccttatgaatgntcattgcaaatttctaagtgttgtcaatgcttaaacaagatcaaagcaaacgaataactgctcgatgtttggttgcaaaaa

SEQ ID NO: 93249 - DNA, 334 bp, Triticum aestivum
  unsure (1)..(334): unsure at all n locations
  Clone ID: PAT_TA_93249
ccgccacacactctctgtttacgagttttagatatgtaggatacgattgggccggcgacgttgaacgtcttcgcgaaagcgcagtgattcaggcgtggtggaaaatcactcggcactaccaagccagtccggattgcgagatgcgcgagaaggccgatgatggcgagccggactggtggcagggtatagcacgcgcacccttccagccctaatttcggcgagagggactggtgcagcggggcgagagatagagaagattatatagttgtcgcaggctaggttaattgatttattctcttcacaananaaaaaaaaaaaaaaaaaaaaaaaaaan

SEQ ID NO: 93250 - DNA, 419 bp, Triticum aestivum
  unsure (1)..(419): unsure at all n locations
  Clone ID: PAT_TA_93250
tcgtgcctcctcccgcgtcacgtgtccccccactctccccccatctcccccgnctcatagctcancccgccggcggccgcagcggcgcncccccgaccaagtggngccgcgccggnggccagggcacgtgnanatggncttcgtcctggntcgncgcnttcttcctcggtcgtcacgnctcatcgtgctcgacatctntccangttgattgtgcattggaagaatcnggnagttcnagncacatcaaccccgtttgnttcatcctctcggaantcaataaaagtngggtangccatgaatttantanngtcaggnactttctaaagttgnatncattcctcttaanctgngccntttggtgcgnatgtttccttaggnttntctgccccnaantggngtnacccaatcanttatacgag

SEQ ID NO: 93251 - DNA, 362 bp, Triticum aestivum
  Clone ID: PAT_TA_93251
ctcgtgccgaattcggcacgaggttaaaccatcaaatatactcttggataacaactttgtgccaaagatctcagacactggcatatcaaggttgatcgtgagaggccatgaacatagcggaatatccattggtgacatggcttatatggatccggtatatgtacgaacaggcctactgaccgaacaaagtgatgtctacagttttggagttatcatcttggagcttgttactaggagaaaggccacacatatggacaaaaacagcttagtaattaatttcctggagaaccacaagcaggggaggaaatcgactgagttgtttgataaggaaattgcagtgacagaaaatttccttatcaaaa

SEQ ID NO: 93252 - DNA, 424 bp, Triticum aestivum
  unsure (1)..(424): unsure at all n locations
  Clone ID: PAT_TA_93252
gagctccctgncaaacgancccaagaaagttccgatcgaatcgaaagccaaggncttctcgcccacctccaagatgcagatctttgtgaagaccctcaccggcaagaccatcacccttgnggtcgagtcctctgacacgatcgacaacgtcaaggcgaagatccaagacaaggagggcatccctccggaccancagcgcctcatcttcgctggcaagcancttgaggacggtcgcacccttgctgnctacaacatccagaaggngtccaccctccacctggtgctccgcctgcgtggtgggcatcaantttttgtcaagaccctcaccggnaagaaaatcacgcncgagggccgngtcttcanacacnaattccaaaannttaanggggaaaattcaaggacaagggggggcatccctccggga

SEQ ID NO: 93253 - DNA, 470 bp, Triticum aestivum
  unsure (1)..(470): unsure at all n locations
  Clone ID: PAT_TA_93253
atcatatcgagattctaaattttaatcgaactagatcagatctagtcaaaattacttgccaatattagcctgggaaacttcagccattctatcggaagtattaataattgaacctcacaggaaatcaactatcgaaacagtagccgttaacatgacaaaccaagggcaaccctacgaacatactcacaagtcatcactatcttctcgggtatcaccatttcggcggcctcagagtcctgcctccccctctccgcttagacagactacaccgagtccatcccccactaagtcagcggcaacaataaccacaccatctcaactcgctcagtgctcttcatcagcgcttggagacacgcacatgaacagtttgaattatcgaccgagatacaatttcgagaaaaataatcaagcctcaactggtaaggntatcaatactagcctgcaacttggnggttccttatcgtcgagaa

SEQ ID NO: 93254 - DNA, 527 bp, Triticum aestivum
  unsure (1)..(527): unsure at all n locations
  Clone ID: PAT_TA_93254
caaggacaaacgatgtttgccaaaagggggtnaaaaanaattggtgctcccaactggcggggtgcgcctgccaagttgggaatcttccaatggncacaataattgcgcttgnaaagggggatgctttgttctgacancaaaccaanttctgccgcanaaaagactttcctcccccgcctgagtatanctttggtggncaanaggaggagccaaccccaaaaaccgctgtttgtcctgggagggagcgccatcanttcgccatncgggacantgtttggcangtnccaactatgaaggngagggcctcctcacagctgaactggacccttggngaaattgttcgagccaaagttttntttcaacgtccgtggggaanactaacgccgcgcccctgagggtgctgaagcctttgactggtgaaagaacccgaaaccgaaacaacgnccgtgtccttttcaacctccnactgggggggaataaagaaatccnaagggnggcaaaaagaaggggaacgaatngttttgaaa

SEQ ID NO: 93255 - DNA, 438 bp, Triticum aestivum
  unsure (1)..(438): unsure at all n locations
  Clone ID: PAT_TA_93255
gtactaggcatgctcccttctcgcttcctgctcctcccgcactgccccaccgcgccggncccgnctccgactccganancccccggcngggcncgctcgccgagctcggncgcactgcngttcngatcccccggaggcgtgcggcttcgtcgcggncgaaggtcnncggcggtctcaatggaatncgacnggacgcntggaggcggatcgcgncnancatccgcgccatccccaanttccccaagncagggattttgtntcaggtcatcacaancttgcttctcgatccgcatgnattcccntganaccactgacctcnttgtcgaacggtananngacaaagacataactgnagttgctnggtgtttgacaccaaangactnanttttgggccncccatntgcattngccaatangntgcaaaggtnttnttccaaa

SEQ ID NO: 93256 - DNA, 308 bp, Triticum aestivum
  unsure (1)..(308): unsure at all n locations
  Clone ID: PAT_TA_93256
aaagcacagcannaaatggntaccatcacgcgccgccgcggcgaccaccgtctgtcncccgtgcngccatcgccaggccgcaggccctaggtctgccccagctgangacgaggagngagagggtgagggtgcanctnctccaaggncgccaaggaggcgaccccggcggccgccgtccgcggggccggcgcgtccctgctcnccncggcgnncgcggtgaccgccntccgcggtgctcggtcgctcgcctcnggtacnncgancggattgtcnaantggggggcaccgggctcattcctcgngggntg

SEQ ID NO: 93257 - DNA, 470 bp, Triticum aestivum
  unsure (1)..(470): unsure at all n locations
  Clone ID: PAT_TA_93257
gcaagctatatacctacatagtacaagccatggcccccaccgtgatggnctcgtcgggcacctccgtcgctcctttccaagggctcaagtccaccgccggnctccccgtcagccgccgctccaacggcgctagcctcggcagcgtcagcaacggtggaaggatcaggtgcatgcaggtgtggcccattgagggcatcaagaagttcgagaccctgtcctacttgccaccgctcaagcacggaggncctcctcaagcaggtcgactacctgatccgctccaagtgggtgccttgcctcgagttcagcaaggttgggttcatcttccgtgagcacaanncatcccctgggtactatgatggccggtactgggacaatgtggaaagctgcctatgttcgggtgcaccgggggccacacaaagttnatcaaccaaggtggngggaggtcaaagaaaggagttacccntnacccc

SEQ ID NO: 93258 - DNA, 469 bp, Triticum aestivum
  unsure (1)..(469): unsure at all n locations
  Clone ID: PAT_TA_93258
ttgcatcgcaccacaactcttacctccacgccatccaactgccttgcatcgtctcattccaagcatgaatacctcactcctcatcaaaaagctctcagatcatgcgcgtctcccgactcgtggttccagcggcgcagccggatatgatatgtacgccgcgcacgccacaagtgttccagcacgtggcaaggtactcgtcgcgacggaccttgccgtcgccgtaccgcctggtacatacgggcgcattgcaccccgttcaggcctcgctgccaaacatatgatcgatacaggcgcaggtgtcatcgatgctgattatcggggtgaaataaaaattttgctcttcaatcacagtgaggttgattttcctatcaagcgaaggtgatcgcattgctcaattagtgttggagaagatcgtcacacccgaagttcangaggtagacaatttggaagaaagtgttcgtggaactgg

SEQ ID NO: 93259 - DNA, 462 bp, Triticum aestivum
  unsure (1)..(462): unsure at all n locations
  Clone ID: PAT_TA_93259
tcgtgttgaacaatcaggcgctctcttccgaaagttcaccgcagcggcggcaagcatgcagcggcaagaggagtccggcgaggacatcgtgatcgtgggcgccgggctcgccgggctcgccgccgcgctcgggctgcacaggaaaggggtgaggagcgtggtgctggagtcgtccccgtcgctccgggcgtcggggttcgccttcgccacgtggcccaacgccttccgcgcgctcgacgccctcggcgtcggcgaccaagatcaggaagctccacctgcacatcgaggggctgcgcgtcatgtcggcgtccacgggtgagataaccgaaggaggtggacttcagggacgagttcaacttgcgtcaagcggggacgtgctgctgcaagtcctggcggcnggaanctgccnacgggcaacaatcccgctactccctccaagattcgtctccaatccgacgagga

SEQ ID NO: 93260 - DNA, 462 bp, Triticum aestivum
  unsure (1)..(462): unsure at all n locations
  Clone ID: PAT_TA_93260
gtccccttctggggcatccactaacaattaacaggataccggctggntcaaaggtgcctgctaactcatctttcgctctcagcatagaaggagtaantttgtcanttggaaggngtgacagacgagagaatgtgtgaggagcacattgacagggtccancatggaggaatcttctggtttttttttcggagttgttttgattttcttgatttttcgtctctgtttaatcaagctgcacttttggtancgattcacnaggttggnacganttaggctgtnggaaagattacagggaaccctgccggctccgcctgtccttgacccaatgtggaaaacataagctttancttacnacaaantatgtagggcaaaattttncaaatcanaaacccgaggggggggccccggatacccnattccccctaanaantgaggtccctaattncgccncgcccaatgggg

SEQ ID NO: 93261 - DNA, 471 bp, Triticum aestivum
  unsure (1)..(471): unsure at all n locations
  Clone ID: PAT_TA_93261
nctcaagatcaaaagntacctaaccatcgaagaagagctacgttcaanctgcagaagatcaagtagagccgtacgtcctcgtccgcatcaactcatcaaggactgatggagtttctgggaggatcattggncgtgccgaggagcatgggaagcccgaanaggatggacaggaagagcggaggcgggtcgtggcggcangcgccggcgccggtgaggcaagctgttctgganggtgagacgcgccatgcngcngncgaagcgccgcgccgtgagcttcgggtaanactccaagagctacttcaaaaacttcganganggtctcttcccggctcacgtctctanccggnacccggncgcatgggccgtcttctttttctcgtgccnaatntccgntaaanggaggggggggncngganaatcaaattccntccttactgggaggccaaaattnatttcacngttaaangggnc

SEQ ID NO: 93262 - DNA, 459 bp, Triticum aestivum
  unsure (1)..(459): unsure at all n locations
  Clone ID: PAT_TA_93262
ctcctagcangctatatacctacatagtacaagccatgggccccaccgtgatggnctcgtcggncacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcaagcacggaggccctcctcaagcaggtcgactacctgatccgctccaagtgggtgccttgcctcgagttcaagcaaggttgggttcatcttccgtgagcacaacgcatcccctgggtactatgatggccggtactggacaatgtggaagctgcctatgttcgggtgcaccgcgccacacaangtgatcaaacatggtgggaggaggtcacagaatggagt

SEQ ID NO: 93263 - DNA, 458 bp, Triticum aestivum
  unsure (1)..(458): unsure at all n locations
  Clone ID: PAT_TA_93263
ctcgtgccgaattcggcaccaggtgcagtggtacaccatgcgggccgttctcccaagtagatactgggtacctttaacatctaccccattcggaacaagagaatgctggttcgggcccagtcagacccacacaccactctccctcgcggtggtaatgtacttgtcggatgatgaaagcacacgatgatagccttgggtttatcacgctcttccctgtgtatctgcaattgcaatctgagtgtgaggattctaatcgtcaaattgagccatcctacttaaggtacacatattccgataaaacctgcatgggcctcaagggngccaaatcaggtaaaaatgaattatatatatatatgtacactcgtgccgaattcggcacgagattctctngaaattttgtccaaacaatccatcaatgaagcaaccacgattcccgtgggcacgtatattaacaacgt

SEQ ID NO: 93264 - DNA, 453 bp, Triticum aestivum
  unsure (1)..(453): unsure at all n locations
  Clone ID: PAT_TA_93264
gagagagagagagaactagtctcgagttttttttttttttttttggaaagataaatgatcatttcattaattacaccgcttcctctccttgggttcctcaaactcctagcatacgtgactaatattatccacgaaagaatgtcctgttctgaacatcaaattattgtacatccacatctcccaggttactaaatttacgaactttccatcgatcaacgaatatttgttctcgtttttctccactaccacatatacctgtgttctacaattatagtttacccgtcatantcatgactatctcgtgactaaaaaattcatcttgtccttggtctaaaagtcattgagagtattttataatttaaattattnggacgttaacctgtgcctgggatnaattantgttcatgtgtcgtggaaatgtcaatgtgacaagctctggtctccattgctaag

SEQ ID NO: 93265 - DNA, 455 bp, Triticum aestivum
  unsure (1)..(455): unsure at all n locations
  Clone ID: PAT_TA_93265
agcaccgggcccgtgaacctgctgatgagccccggccgggcttcgccgccgcccacctccccgcagccgcgccacgggaggctggtcaccgtgccgagcatcgacggcggcggcgtgcgcgggatcatccccggcaccatcctcgctttcctcgaaaaaaagcttcagcaaaggacctctgggcttgttcaagagcatgatgggacccaagtacaacggccagcacttgcactcaatcctgaaggagctgctcggcgacacgcgagtcagtcagacactcaagagcatcgtcgtcatccccactttcgacatcaagctccttcagcctacgatcttctccacctacgacgccaggtgggatgtctccaaggatgctcttctatcggacgtctgcatcaatacgtctgccgcgccgacctaacttcccgggcaacatttcntaacaanggacaaaa

SEQ ID NO: 93266 - DNA, 391 bp, Triticum aestivum
  unsure (1)..(391): unsure at all n locations
  Clone ID: PAT_TA_93266
gtgacctctgcaaaaaaagttggggatttggtcaacgtanaagttgatcagctcggaaaatacgtcgagaaggcggtcgagagttactttctacaaagcaactttgaagaatcaaatggcttgcacaaaatgataacaaaaattgttgatgcgcggttatcgaataacaaataagacgtaaacacaagctttcaccaagaaatattaattgtggtctgcattcagtcgccttgttacttttgaaatccaagaattatttgctggatttacaacttagtatttggttatcttgtccccgcttgctaatcttgtacattacaaggtagatgagtaattacttttgcccttgtttgcctgatatgaaaaaaaananacaaaaaaaaaaanaaaa

SEQ ID NO: 93267 - DNA, 454 bp, Triticum aestivum
  unsure (1)..(454): unsure at all n locations
  Clone ID: PAT_TA_93267
ctcgtgccgaattccgcacgagcctcctcctagcaagctatatacctacatantacagccatggcccccaccgtgatggnctcgtcggccacctccgtcgctcctttccaggggctcaagtccaccgncggcctccccgtcagccgccgctccaacggcgctagcctcggcagcgtcagcaacggtggaaggatcaggtgcatgcaggtgtggcccatcgagggcatcaagaagttcgaagaccctgtcttacctgccaccgctcaagcacggaggccctcctcaagcaggtggactacctgatccgctccaagtgggtgccttgccttgagttcagcaaggtcgggttcatcttccgttgagcacaaatgcgtctcccggggtactacgacgggcncgctactggacaatgtggaaanctgcctaatgttcgggtggcaaccgangccacaan

SEQ ID NO: 93268 - DNA, 435 bp, Triticum aestivum
  unsure (1)..(435): unsure at all n locations
  Clone ID: PAT_TA_93268
gacaaacgttcccatgaaacggcgctcacaaccatcccaacaatgcagtacctctggttcccgacaatccacttcagtctggcatcacgataccatccagatgagtgctctacccttgtgtgcagcgaaaattgctggnagatagcacctgggagaatcgcctaccgagcatctatccatgagaccaggccgaatggcacgccgttgaaaattgtcaggcatgtctgggaaggaatatttcaagatttttctgcaaatcccttgaaggcctcaattgataggctaccctcaatcttattctctagactttggtcaacccgatctttttaatgtgatggacggcagtaaaagagttcagccattcatttggagtgtagcgttcaagaaacgaaccaagacccccgctatccggagctcttgacaaatgtngaggat

SEQ ID NO: 93269 - DNA, 441 bp, Triticum aestivum
  unsure (1)..(441): unsure at all n locations
  Clone ID: PAT_TA_93269
attcggcaccagctcccaaggaacggaaccaacaaatccccaccaatctcgtctccaatcgacccgaggctcgtccaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaaagcagctggaggatggccgtaccctcgctgactacaacatccagaaggagtccaccctccaccttgtcctgcgtctgcgtggtggnatgcagatcttcgtgaagaccctcactggaaagactatcacccttganggttgaagaagtctgacaccatcgacaaatgtcaangggcaaagattcaagacaangggaggg

SEQ ID NO: 93270 - DNA, 428 bp, Triticum aestivum
  unsure (1)..(428): unsure at all n locations
  Clone ID: PAT_TA_93270
ctgcatcgtaatatctattttcgcaatcgtcattctctctgtaataggagtgctattcaagtccaaccatcactcatttgtgggctccattgaagatcctcccaatggtgctgccgttgctagcacagttttctctgcggtaactgtttatgcgcttttcctcattggctgtagctttcaagcatacttacatgctcgcgaaaatcgaaaaggtgccatcaagaatctcgtgaacatagtgcaaggttgtatcaacgcgatgagattcagaaaattttgagcactctctaagctttcaagttgagaagatccgccggagatcccagtcttggagaaataattgtcattcangcgacatcggtgtatatacattttcatcgagcaagntacacatggactgtaattcaactatgcgtccacaatgaact

SEQ ID NO: 93271 - DNA, 457 bp, Triticum aestivum
  unsure (1)..(457): unsure at all n locations
  Clone ID: PAT_TA_93271
ctcgtgccgnattcggcacgagagtccacgactcgctctgacgacccgtagagcacagagcccacctaacctaaacctttttttttgaatgttacctaacctaaacctcgccgcgcctcctcctataattatccacgcctcgcagagcccggccacaccacagctgacgcttgcgaatcactccaccagaagcagaacccaacgccancgagagaccggggggtggacggacgcncgcgcccaggcggnatgggngtcctacggagcacgcanagcatgcaggcggaggtggaggagatgcgcgccgcgctcttccacgggggcggttgncgcccctcggncggcgacaagcgacgtcaancgcgcgggcggcggcgactaangcgcggtcgggcccgcgcaccgtgtgcgtcaccgggcggncatatccttcgtcggnttcncnaattcgtcgacc

SEQ ID NO: 93272 - DNA, 449 bp, Triticum aestivum
  Clone ID: PAT_TA_93272
tttttttttttttttcagtaaagagttgtacgattctgtgttggtctaaatattcataattgtcttttgcctacgctgtacaggattcacagctttactgtggattctgactagcgcatttgtgctgaggtcatcatgtgatccccacatgatgataaatcaacttttacgttttagataaaccgacatgactagaatataatggatgagagcgcctcctgaagcctttaaatgactggcaatttcttttcttacacaaagaagttcgtttattttggtattactttttagttcaatatcctagctttttcggcagggttgagccatgtaaccattatactctattagatatatttctcttgatggataagaaacccgaatttgatagtgggcattttgctccggatgcagggataaagggaagcttcaaaccttaaatcaatggataa

SEQ ID NO: 93273 - DNA, 304 bp, Triticum aestivum
  Clone ID: PAT_TA_93273
gagagaactcgtctcgagtttttttttttttttttttttgcacaactgaggtccttcattaggcatgtcgcaacgacgaaacaacaataagcaacaccaaggaactcaaacaaaactcatcacttaagatgtattaccaatcaaccaagtgctactgaggttcagtcttgagtcttgacctatcaaacttaattgacacaacatgagctttcaaaactttttcagtcaggataaagatacattaccgatcagctaagtgctactgaacttcactcctcgtgccgaattcggcacgagggggggg

SEQ ID NO: 93274 - DNA, 372 bp, Triticum aestivum
  unsure (1)..(372): unsure at all n locations
  Clone ID: PAT_TA_93274
agagaccagaggtccgaactgccgcacgcgcagctgccattaaggaaggtaaagataanagagctgctgctgctagcgccaagaaggcagagaaagccaanctggcaagtgcttcagctaaaggtcagacttcaaggttacagagcaaacagggcgcaaaaggtgcacccaagaaaatccaagcaaccacacgatagggagtatgaaaaattatgacattcaaatagaccacgggaaagacagtgctgggaaaagtacaaatgtgctcaaattaccggggaatctcgatactacagctgactcattgacatttccggtctgagcttcaggatttaattaatactgatacgtgtatgaggcacgtgaacacta

SEQ ID NO: 93275 - DNA, 192 bp, Triticum aestivum
  unsure (1)..(192): unsure at all n locations
  Clone ID: PAT_TA_93275
gaaatcaagaactcgccgcacgttggntcttgaccacccacacagatccgagggagagaggnccatggccacctcgaccgccgccgtgctgtccccccccaccgtggccgggntccgcctggccccntccccgcggncggncgtctcnttcctggcgccgggnccaggnggtccgtgngcggcncggggcgg

SEQ ID NO: 93276 - DNA, 454 bp, Triticum aestivum
  unsure (1)..(454): unsure at all n locations
  Clone ID: PAT_TA_93276
ctcgtgccgaattcggcacgagctcgtgccgaattcggcaccaggcagacagacagaacttgagagagcgcacgcgagatggcagcctccatgatcacctcgccgattgtggcgccgacgagcgtgccgtccctctcccgccggggctcctccttcgccgtcgtctgcagcggtggcaagaagatcaaggtcgataagcccctcggactcggaggcggcttgacagtcgacatcgacgccaacggcaggaaggtcggcaagaagggcgtgtaccaagtttgttgacaagtacggtgccaacgtcgacggctacagcccaatctacacgccaagaggaatggtctgagtctggtgaccgctacgccggcggaacgaccgggcttcttatctgggccgtcaccctcgccggcctcctcggggggcggngtcctcctccgtctacaaaaacaacggc

SEQ ID NO: 93277 - DNA, 462 bp, Triticum aestivum
  unsure (1)..(462): unsure at all n locations
  Clone ID: PAT_TA_93277
attaatcatggctacgcctaagaaagttctcttgcttggagcaggttttgtcacacgccccactcttgatattcttancaatgctggaattcaggtgactgtcgcttgcagaaccatcctcagcgctgagaaactcatcaagggcatcacaaatgcgcagccaatagctttggatgtaaatgatgcaaacgctctcgatatcgaagtatcaaagaatgatctagtgataangtttaattccatacacttttcatgctttggncatcaaagtctgcnntaagaaacaagaagaacgtgggtgaccacaagttatgtctcaccgggcaatgcttgaactgggatgaggagggncaaaacctaggcggggtatttacaagtatttgaantganaatccngtccnaagaatccttggggctttgatnnacctaataangcccaanttaanaaacnantcnaaaggg

SEQ ID NO: 93278 - DNA, 458 bp, Triticum aestivum
  unsure (1)..(458): unsure at all n locations
  Clone ID: PAT_TA_93278
ctcgtgcgcgaattcgggangagctcgtgccgctcctcctancaagctatatacctacatagtacagccatggcccccaccgtgatggcctcgtcggccacctccgtcgctcctttccaggggntcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcaagcacggaggccctcctcaagcaggtcgactacctgatccgctccaagtgggtgccttgcctcgaagttcaacaaggttgggttcatcttccgtgagcacaacgnatcctcctgggtacnaacgatgggncgggtaattgggacaantgtggggaaggctgccctatgtttcgggtgcactgac

SEQ ID NO: 93279 - DNA, 430 bp, Triticum aestivum
  unsure (1)..(430): unsure at all n locations
  Clone ID: PAT_TA_93279
ccaaagatggctcgattcatgctggaaacgcctctcaaatttcagatggtgctgcggcggtacttatgatgaaacgttcgaccgcagagcgtttggggcagcaaatcttgggcaaatttgttgcttcatctgttgttggtgtagcacctcttcttatgggagttggaccctgggctgccattccaaaagtctttgagaaaaccggattaacaaaggaagatattgacacatttgagataaacgaggcattcgctagtcaatgcctgtggtgctctcaagaacttgggctagattccaacaaaattaaccctcagggtgggagctattgctcttggacaccccttgggctgcactggtgcgaggcaagtcagtacattattgtatgggactggcggagaaagggaaggtcgtatangtattactaacatgt

SEQ ID NO: 93280 - DNA, 432 bp, Triticum aestivum
  unsure (1)..(432): unsure at all n locations
  Clone ID: PAT_TA_93280
ctcgtgccgaattcggcacgagccttgcttcattcaacaagctggaggagcagaataccatctggacacctccatggnaccaaactcagattctaaccagcatttcttctgagacaaaagagatcactaagttgtggcacttacagcaactcaagcatatcccaattgaagatatcatagtctatacagatggctccctttcaagacacaggaagcaagcattggctttgtggtatacttgccaatcagcagagagatnanatgtttctcaaatcaccttgggngacactatgggtatcacaantgctggagactcactgcctattgaaaagcaaactcaatattgtggaagagacatttttcaaccnaggcaatatatnttntcactggagtagccaagggntagcatcccttcggggttccaaacacaag

SEQ ID NO: 93281 - DNA, 515 bp, Triticum aestivum
  unsure (1)..(515): unsure at all n locations
  Clone ID: PAT_TA_93281
ctcgtgccgaattcggcacgaggcttttgccatattttattatctcataaatatgagttagaaataaaaaaaagaaaaaaagatacaaagatatccgtttcagggtaaaataaacccctttactttaattattttaaatgaaattattttatttgggattggggaaanttcccgcggggacctttttttactttttagaaagtaaagttcnttttccgaaagaatacccctggctttgnttaatgcctcgggttaagangaaatggactccaattcngccacncccacnaatcantcgacattttggncaaattttacnaacggggagctcctaatttcaaaattccggaaccttttttaaaccaagaanccaancctttgggaaaaanaantccccntcncctgngantttagaacttangatttattancccaaaaaaaaaaaaaaaaactcccagggggggggcccgggganccaaantcncccctaaaaagggggncgcattaacncgcgg

SEQ ID NO: 93282 - DNA, 522 bp, Triticum aestivum
  unsure (1)..(522): unsure at all n locations
  Clone ID: PAT_TA_93282
ctcgtgccgaattcggcacgaagctctcctccaacancatgggccccactgtgatgggttcctcgggcacctccgtcgcacccttccagggtctcaagtcgaccgccggnctgcccgtcagccgccgctccancagcgccggnctcagnancgtcagcaacggnggnaggatcaggtgcatgcaggtgtggccgattgagggcatcaagaagttcgagactctgtcttacttgncacccctctccacggaggncctcctgaagcaggtcgactacttgntccgctccaagtgggtgncctgcctcgaagttcaacaagggtgggttcgttttccgtgagcacaanagctcccccgggtactacnatggtcgatactgggacaatgtggaaagctggctatgttccgggtggaccgacgctacacaaggtgctcaaacgaaggtgggggggggtcaaagaaaggagtaacctgaacgcctatgttccgcgtcatcgggtttctncaaacctacgncaaggtgg

SEQ ID NO: 93283 - DNA, 490 bp, Triticum aestivum
  unsure (1)..(490): unsure at all n locations
  Clone ID: PAT_TA_93283
acagttgatgcaagactgaagtctctatataaaggacacttatcaagttgtacacaaggttgggattgcgcatttcaccgactcggtaactgccataataaaagcgggccagaaaacaaatgccagctatgagttttcggaaaccgtgactagagaaagaaacaaggcattggnacaatttgaaattgaagcccggaatcttacaatgaaaggcttgccatggagcaattttgagcagcaaatcagtttatttagtcaggaactaaagttagtaagcgcaaatcttcgcaaagaanaaatgcggaggcttgggacacgtaccgagagatgggtacgaactcgcttatcanaattagttggncttgaatttaataagcttggnagcgcaaagaagggagcaatacgcccgacaacaagcgaaactttaaagncgggaattagcctatgggatcgaatttgggagattttcacaagtaactatcccctgagg

SEQ ID NO: 93284 - DNA, 555 bp, Triticum aestivum
  unsure (1)..(555): unsure at all n locations
  Clone ID: PAT_TA_93284
cgggtgggcgggcgctctaaaactantgggatnccccgggctgcangctcgtgccgaattcggcacgagacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggncgaggncgccggggccaccctcctcgtctccgccancgccacccanaaggggagctccggcggcatggagatggcggccgagaacggnggctgcgggtgcacccagtgcaagtgcggnaacanctgcggctgctcctgctgcagctgctaaatnattgatcatcgatcatgcatgcaccgcgccgtgcaacatcgatcatatcgatctactactaacaaaccatgttaaccgctacctgatcgaaggggcttatctatgcaactgacctgcatcaacagtcaaggtgncaaggcatgcttgtttttaacaaggccccctaaataaaatctccctgggtt

SEQ ID NO: 93285 - DNA, 495 bp, Triticum aestivum
  unsure (1)..(495): unsure at all n locations
  Clone ID: PAT_TA_93285
cacgtactccgccatggncccagccgtgatgggttcctccgccaccancgtcgcgcccttccaggggctcaagtcgaccgccgggctccccgtcagccgccgctccggcagcgccgggctcaagcagcgtcagcaacggnggaaggatcagatgcatgcaggtgtggncgattgagggcatcaagaagttcgagaccctgtcttacttgccacccctctccactgaggncctcctaaagcaggtcgactacctgatccgctccaagtgggtgccctgcctcgagttcancaaggttggnttcgtcttccgtgagcacaacagntcccccggctactacgacggtcgatactggacaatgtggaagctgcctatgttcgggtgcaacgacgcaacgcangtgctcaacgangtggaggaggtcaagaaagagtaacctgacgcctatgtccgtgtcatcggnttcgncaacaagcgccaagtgcaaatgcgtcagn

SEQ ID NO: 93286 - DNA, 467 bp, Triticum aestivum
  unsure (1)..(467): unsure at all n locations
  Clone ID: PAT_TA_93286
cgcacgagggataatgaggnagaccccnaccataaaaacattnagctccaggggncgtttgttnangtcaaccatgccaatgcaatggngaaaaagctgattctccncattggngggaanacccctcccncaacgcaaaagaaccaanggaggggggctgccggtgggngtggggggaaaaaantttcaaaacaaaactgtgnggacaactttnaaaaaaaggtccttgccaatttngngganaagatgccacntccccccangggngagaagtgaantngcgcaaagtcccngctngcggggnttgagaaaangctttttttttatgggnnttttcacgagntaaaaannggantaaagaaaaagnccggaggctccaaatcccnangggcaattcaccccatngggcatgttgtagntttcaanaaaacccngnttnttganttgatttgggagaaaaanggtca

SEQ ID NO: 93287 - DNA, 500 bp, Triticum aestivum
  unsure (1)..(500): unsure at all n locations
  Clone ID: PAT_TA_93287
gncaagcgagccccanaaagtttccgatcgaatcgaagcaaaggntttctcgtccgcctccaagatgcagatctttgtgaagaccctcaccggnaaagaccatcacccttgaggtcgagtcctctgacacgattgacaatgtcaaggngaagatncangacaaggngggcatccctccggaccancagcgcctcatcttcnctgggaancancttgaggacggtcgcaccctcgctgactacaanatccagaaggagnccaccctccanctggtgctccgcctcaggggnggnatgcanatctttgtcaagancctcaccggcaagaccatcaccttgggggntgngtcatccgncancattgacaacgtgaaagnaaagattcaangacaagggggggaatncctccngggcaanaaanggctcaatcnttccctgggaaagnaanatttgngggtngggcgcaacctcnctngncctanaaananccaagaangggtg

SEQ ID NO: 93288 - DNA, 510 bp, Triticum aestivum
  unsure (1)..(510): unsure at all n locations
  Clone ID: PAT_TA_93288
ctcgtgccgaattcggcacgagagcagctggaggatggccgcaccctgggctgactacaacattcagaaggagtccaccctccacctggtgctcaggcttcgtggaggcatgcaagattttcgtcaagaccctcaccggcaagaccatcaccttggaggtggagtcctcggacaccatcgacaacgtgaaggcaaagatccaggacaaggagggcatccctccggaccaagcagcgcctcatcttcgctggcaagcagcttgaggatggccgcaccctggctgactacaacatccaagaaggagtccaccctccacctggtgctcaagcttcgtggaggcatgcagatttttgtcaagacgctcaacggcaaagaccatcaacctggaggtggagtcctccggacacatcgacaatgtgaagggcaagattcaaagataagggaggggaattcccccggaccancancgtccaatcctccnctgggaaagcaactggggggatgggncnc

SEQ ID NO: 93289 - DNA, 494 bp, Triticum aestivum
  unsure (1)..(494): unsure at all n locations
  Clone ID: PAT_TA_93289
gatacatcccagatacttgaaccctccgccgaatcttcactttccccggtcacgaacaaggcacacaggagatcaaagctattaactaactcgtatcgacacttctccacaggttgtggactgagaggcatcaaaagtgcttccaaaacagccttttctcctaccccgtcggctaccgaatacgctatagactacgctacattatgtcagactcctaatcttgatgaatccgattctgatccaccatctcgccctataagccgcaaataatagcagttttcgcgaggctataaccgaaaattcaagcggtaaataagtcgggggaaatcattaggattagaatattctcaaaaattagtgggacaagttaagaagtgatttccatcgaantaccacaagcangcgggaagtctgatgtcangtctggggacaagattcaagtgaggnggtgctcaatacaagggtaagtggttctaaatataaacnaccctgng

SEQ ID NO: 93290 - DNA, 190 bp, Triticum aestivum
  unsure (1)..(190): unsure at all n locations
  Clone ID: PAT_TA_93290
ggaacttctaaaangaggcggcgagggcgancaaggancggganagatggagaacgggggcagcaaaagngangtcccggnggacgccaacgcccattgccctgggacgcaatccgaggaggnanggaanggcgattcctgnnccnggtggccnaaccaacaaatttntgccancgcccccnangggccc

SEQ ID NO: 93291 - DNA, 469 bp, Triticum aestivum
  unsure (1)..(469): unsure at all n locations
  Clone ID: PAT_TA_93291
ggaaatccancaagccacggnctcggcggggtcgctcgccgaggngcccgtgcctgtcgccgccggcgancgcggnctgtccgtgtcgcangncatgtcaaaagtcatggngaagggcaagacggncttaatcccgtacatcancgccggngaccccgacctggngacgacggnggnggcgctgaggntcctcgacgccctgggcgcggacgtcgtcgagctcggcatgcccttctcggatgcctccgccgacggggncgtcatcaaagactccgcggcgcgcgcgctggccgctggcgcgacggctgacgccatcatggngatgctgaaggaggtganaccgcanctttcctgccccgtggggatnttctcttacttcanacccattgnacaangagggatggggagcttccncccccccgtcaaagaanccggnggtgaaaggncttataataacccgatntttctt

SEQ ID NO: 93292 - DNA, 411 bp, Triticum aestivum
  unsure (1)..(411): unsure at all n locations
  Clone ID: PAT_TA_93292
gcctgggtcaactttagacaccgagggtaagctttctgccgttattgctgatgtacgtaaacgaaagggtctaaaagtacaacttcctgcatacgaagactactacgacaaactatgattattccattcgtcattgcttaattctttttggcaaaggatctcatggtaaataaagtgtaaactacataagaaattagcaatcacgattgcgaataaatttccaaattggggatatagtactacggtgtcgattaacaaatttagacactactctgcccttatctttttttccacaaattaatctcaaagaatttagttgagttattagcgaagtatgcaggcttaagttttgttcnttggccgctcaacattcgtagactattcaagagaaaaaaaaaaaaaaaaaaaaac

SEQ ID NO: 93293 - DNA, 304 bp, Triticum aestivum
  unsure (1)..(304): unsure at all n locations
  Clone ID: PAT_TA_93293
ctcgtgccgaattcggcacgagnttttttttttttttttttttttttggnattcgntggncatttggcacacanaataaattgggttagttgtatcnctcaccaagttcccaaaaatacagaacgttcanattgatgatggggcnagaccatgttgtatccacnctgtttcaaancctgcngcncttnacaaatacagcaggggagcacatccccaatgggaggatttgggagcatcanctgacagacatgactttnnacaanccaanaactgggngacattantctntcagcaacaaaaaagg

SEQ ID NO: 93294 - DNA, 398 bp, Triticum aestivum
  unsure (1)..(398): unsure at all n locations
  Clone ID: PAT_TA_93294
tcggacgccgccgcccccgccgcccccgcggggganctcaagaactgggacgccgagttngtcaaggncgancangccancctcttcnacctcatcctgggtgncaactacctgaacatcaaagggntgctggacctaanctgtcanactgttgccgncatgatcaanggnaagaccccggaggagatncgcaanaccttcaacatnaanaacnactttncnccccgaggagggngnggngattcgcaaggagaaccaatgggcctttgggttaggagcatctangcgatgccaccgccncgctgaaagaacaaagcttagtattcgtcatgtctgtanttcancgctcttaattatgtctgtcgtaatggggttgtnantatcctccaggggggggg

SEQ ID NO: 93295 - DNA, 189 bp, Triticum aestivum
  Clone ID: PAT_TA_93295
gctgcaggctcgtgccgaattcggcacgaggtccgcttgcgcttctgttcgtgcgagcctggattccttgctttaatttgtgcactaagtagtaaataaacaacggaatcaataagctccgaacgtactgtttttaaaaaaaaaaaaaaaaaaaaaaaaaaaaaaaaaaaaaaaaaaaaaaaaaaaaaa

SEQ ID NO: 93296 - DNA, 520 bp, Triticum aestivum
  unsure (1)..(520): unsure at all n locations
  Clone ID: PAT_TA_93296
ctcgtgccgaattcggcacgagccanaacacacagaatcacacacacagcttcttgcgttctcaaacactgatcttgcagcttcaagtttcgtccaccgccggcaagaaggtatggcggggcgcgtcctcgtggtcgtcgtcctgctcgtgcacgtcgtcgctcggctccttggacgacgacgacgtggtctgcgtcgtgaagccgggttcccccggggcaagctgcagaaggcaagcgtcaagttcctgtgcaagctacgggggnatgatccttccacgccaccccgacggcgncgctccgctacgtcgggnggcaacaaccgcgtcctctccgtcgaccgccccctccaatttcacgaagctgcaacgggaaagctgacgggncatgtgcgggatggggaaggcggtgaagcctgcggtgccaagctgccgacggaggaactggacgcgctcgtctccgttacgaacaaacgaagaactncgggcnacttcctggaggangtaccgaccgccnccaag

SEQ ID NO: 93297 - DNA, 371 bp, Triticum aestivum
  unsure (1)..(371): unsure at all n locations
  Clone ID: PAT_TA_93297
acggcgggggggggggcggctcctaagaaactnagtggggttcccccggggctngcaagggaattcncggcaacgaagaaagtttcaatcaagggctcaaactggattaagttnatcaatggcgcttcctcctaagcaataaccaataatcctttcaaaaggcggcaaaggcaatcctttcctggacaagtcctgggctggtttccaactaataggaccaacaatacctggaggggaaaagtaaaaaaatttaattgtcaccaaaagctatatcaagtaaaaaaagattttgcaaggncaccacgggcaagagataaaaaagagtggnaagaaaataaactttcttgggcttgggtccggncccaaattga

SEQ ID NO: 93298 - DNA, 468 bp, Triticum aestivum
  unsure (1)..(468): unsure at all n locations
  Clone ID: PAT_TA_93298
ctcgtgccgaattcggcacgagcgcanacagacanaacttnagagagcgcacgcgagatggnaacctccaagatcacctcnccgattgtggngccgacgaacntggcgtccctctcccgccggggntcctccttcgccgtcgtctgnangggtgggaaaaagattaaaggtcgataaacccctccgactcngaggngggttgacantcnaaatcnaagccaaagggaagaaaggtccggaaaaaagggggtggnacaatttgtttanaagtaangggggccaaaggtccaacggttaaaagcccaaatttanaccccaaagggaattgggcctgagtctggggngaaccgnctaaccccggggggaacaaccggggnttcttatttggggccgtnaacccncgccgggcntcctcgggggggggggtcctccttctttaaaaaanaaaaggntttccnccgggttaaa

SEQ ID NO: 93299 - DNA, 484 bp, Triticum aestivum
  unsure (1)..(484): unsure at all n locations
  Clone ID: PAT_TA_93299
cgtccgtcgtgagcgccgcgtgcccgcgggatncccaaaccccgacccccctctccgagccgggccatgcttccctccgccgcgggcccgcccanccccgccgncgntcgcctccgcctctgttgtagcctccgcgccccctgctgcgtttgttgttgtgggtgccgttcctgaactgtctgattanctanggttgcggtttcgcttgaggcgatttggggagaatttggaggaaggnatggatctctctcggccagggtcgtcggacctctcgctcggggtncacccgcacgcgcacgccaacgcccannncgcgcgtgcangcggcgcgccgccacncccgctgcggggtgttccnacgaatccgacgacgtcaannaccggagggcaangtctngnggcggggggcgaccggngaangaagggggaatacacnaggggggccgaacaaacanttctcgctcctnnggtcantcngctctgg

SEQ ID NO: 93300 - DNA, 263 bp, Triticum aestivum
  unsure (1)..(263): unsure at all n locations
  Clone ID: PAT_TA_93300
agctcgtgccgaaattcggcacgangttcatcngccccaggnaaagagtgtcntgattganccanccaagtgggaacacagggcattgggctggncttcaatggntgcntgccaanggggttacaagacttgtacntcancaatgcccncattccatgagtattggacgacggaacaattcatctntgaanggcttttgggtgctgangcttggtcctcacccggagnccnactcttggtgaantgaanagggagctgtccca

SEQ ID NO: 93301 - DNA, 602 bp, Triticum aestivum
  unsure (1)..(602): unsure at all n locations
  Clone ID: PAT_TA_93301
tgaangtgggtggngggcngtgggcggtgagccggcccnganatggccggcgggaaggagccgntccaggtcaagttncggctcttcgacggcacngacatcnggcccaagcaaagtaacgacccccgccaacaccgtctccgcgctcaaggacttcatcctcngccccgggtgggcccgcaagataaggaaaataactccaaacaactggtcaatgacctgaaagcctcancaaattgggnggnaaaagataattgggnngaaataacccggaccactttgcccgaagtccnccgtgttacaataanggaagaaggtcccctgngcaggtggtnaantacaaatgcatggtgggtaantgcngcccctcccacaaagntgncnaaaaaaaccaaanaagcaagctgggcnaattcccccnaaagcanaaacnagaatgccggatgcnaccaataactggtggataaccgggaacccccccctggtggaatgtttcgaatggcaaccctaaccctggtnggaaaatttcctccttaangccttttntttgcggtcccaacngggnggccgggcgtngtaattcnaattttgaccatccaang

SEQ ID NO: 93302 - DNA, 480 bp, Triticum aestivum
  unsure (1)..(480): unsure at all n locations
  Clone ID: PAT_TA_93302
gatctaagtgataagtttaattccatacacttttcaatgctttggtcatcaagtctgcaataagaaacaaagaagaacgtggtgaccacaagttatgtctcaccggcaatgcttgaactggatgaggaggccaaactagcgggtattacagtattgaatgaaatcggtctaagatcctgggacttgatcacctatatgccattaaaactatcgaagaagtgcatantgctgggggaaagattaattctttcaattcaaactgcnggnggggctaccttcacctgaggcgtctggataatccaatangctataaattcctcttgggnctcgaggggtgttttattggcnttaangaatgntgcanaaatacctancaggaaagggcaaaatttataacagttttcggcccaaagagtttatnggaagcaagcaaaaaccctnacntcaataantcccaaggnntttgcggtccgtggggaa

SEQ ID NO: 93303 - DNA, 449 bp, Triticum aestivum
  unsure (1)..(449): unsure at all n locations
  Clone ID: PAT_TA_93303
ctcgtgccgaattcggcacgaggtgacagccacggganaatcgtcaggtcctccgccatgtctctcanggtctanttngttcgttctcgccaacgcgatggngacgccggcccgccggncgtcggcgcancaacaaaaaacgctgacggtggacttctaggcgctgagctacatcaacangctcgtggaggngttccaagcgttngactccgacaacgacngnctggtcacgggccccgagctccggggnctcctggnctccctgggcctggacaantcggaggnggaggggcggganatgctggggcgcgccnacgccgaccgtgaangncggntctgcgtggaggagtttctggacgtgatgaacgcaagnganctccggctgggcgcgctcggggcgctcctgnaaggccgncgtcccggngctggagtncttttcgggggcccaa

SEQ ID NO: 93304 - DNA, 506 bp, Triticum aestivum
  unsure (1)..(506): unsure at all n locations
  Clone ID: PAT_TA_93304
cgaagctctaagactaccacacagaattgccagagaggtgagcactagagctttgtatcgcaaaatctcccgagcgaactgaagaaatgttatttatttggcttgatctatcgtcttagacagctctgtcctagttgagcgcaaacatacggtctacatccgctcaagctagttgtacaagagccgccaaagtgccttcttcacctcgattttttagcaaggcttgtgctgcttacattcttcgacttttcgcacaatttctggtcgaagttatgaatgatttcaagattggaaggcggagacgttctagtagccttttgtaccatgaaccaccaagagacgatagagcatatgagcgaccaaggcgggccttccaaatctcaacgcgaattgggttaatgctaaaggtgcatgggacaatacatctaagttctaataatatgtnctcaaaatacttttcgatatcatacctggnggttctcaagaaanctcaagggncactggag

SEQ ID NO: 93305 - DNA, 516 bp, Triticum aestivum
  unsure (1)..(516): unsure at all n locations
  Clone ID: PAT_TA_93305
ctcgtgccgaattcggcacgaggttcttcatctacaaatcaagtttcaaggttagagccctttattaagggtgtcgcgccaagcaagtaaccctctcgcccgctgcctttccaaaaagggtttcggggtagactaagccacattttcctcgtcatcgagtgggtggcggtacaaattaagtatctgctgacaagagaattggcaagaaaaatctaaaatgagcttcaaaggctttcagaagagcattatcagggcgccccaaacgctgaaagtctaggttaaatttcggggagaacacaaaagatttagnttacattgacncagagaagacgcttccaggagttagaaacaagaaacaaaaaagttgcacgatgagagcaaaaaatactttgnagctatcagcgaaatgatgatgcaccaaattgaattctctcaagctatcgccgaaaatctataagcccaatctctggncggggtatcaaattcagactcctttagtccaaagaggggaatccg

SEQ ID NO: 93306 - DNA, 518 bp, Triticum aestivum
  unsure (1)..(518): unsure at all n locations
  Clone ID: PAT_TA_93306
ctcgtgccgaattcggcacgaggcaaccaatatttaccaagcattcgtgtttaaactaggggtacggccgtaagcacccaataactcaatcagtttcaaaacaaagcatctgtaacaactcatataatcttccggttcaggcgtccggatcattgcatttataccaaaatcagcttttatttaagggcattcatctccgctggatgtaattctcattcttcaattcttcaactgtttttagcgacttgataacttctgttcgtttttttaccaaacatacatatacccgcttctcacttaggtcataagctcgtgttcgcaatggtagataattgtgggcatgagggcaagcaaaatacacttgcttgagccggggaccttcagtggcggaggcaagcagactaaagtccccaagttgtcccggctaccaaaaatctatttttagggataaagtaaaggttctagtacntgatgcgcgggggacatcaaggcaagtccctgngggnttagnttcggng

SEQ ID NO: 93307 - DNA, 402 bp, Triticum aestivum
  unsure (1)..(402): unsure at all n locations
  Clone ID: PAT_TA_93307
ntccacacaantgaagtgagagctttgcgctgaaagttcatcaacaactatgaagggnaccaagctcgcggggatnctgatnctccangccgtcctggtcatgggagtcctctcgcacgtcaacgccgacttcttccccaagtgntgcaacaactgcaggtccttctcgggggtcgacgtctgcgacgacgcccaccccaagtgtcccaaaggntgctcggcgtgccgcgtggtgtcgacgagccccnaaatgtggngctgcgcggntatgaaatccaccgtcgacggganctgcggngggccctgcaagaagtactgatcggttcatgccggcatatnatatgttccgcctaaaattaaataaaanctcgggcgagatgagcancgtcatcgtgccaaaaa

SEQ ID NO: 93308 - DNA, 513 bp, Triticum aestivum
  unsure (1)..(513): unsure at all n locations
  Clone ID: PAT_TA_93308
agcaaactgaattgtggttacatataaaactatgcatcccatctaataatgacaccaaataaggcctcgcgattgcccggaagtttctctccaatagtgcaaccaccgttagattcacgatcaaacttttatcaagattgagacctcgaatccagatgactctgcaggacaaaaaaatcaagatcccacaactgagccctaaaacatcattaagtagcactccagctgcttctgttcaagtgcatggcccccgtcctctctatacactctctcaaggaaatagcagctctaagtaagcctccaagaactataatttttcgcgcccatcatctcacagnggcactactcgtccgggagcctgcatctcgccacatacccactggggnaggaancacatccaaatcttccaatgggagagntcgctcgaaatggtagattacactcttctacacaaaggaaggttcgagggctaccttcccaaccgcgggcgaatgggaatctaagtagtatggg

SEQ ID NO: 93309 - DNA, 387 bp, Triticum aestivum
  Clone ID: PAT_TA_93309
tttttttccatgtatttaggaaaccaacaaacttacaaattcaaaaaactcttcaacgatgaagtagtagaaacagaccttttgtgctttcccacattgtaccactcaggatgtctctcgtaatctatgggtcttgctccgacaacccacatgctaaatttgtctctcttcgacaactcatcataattagcataagcaatggccttcttagctttctggatgttattagacagatgtctattaacaccttgaacagctcggttcttgtctatatggcctttgctcgtgccacctcgaaaatcatgccaaatccggtctgactgcctttgggtctcttctgtgaagtctatattcccggctgaaacttcaaaaaaaaaaaaaaaaaaa

SEQ ID NO: 93310 - DNA, 523 bp, Triticum aestivum
  unsure (1)..(523): unsure at all n locations
  Clone ID: PAT_TA_93310
agatttcgtattacattagcagaaatttactatggntgagttagtccgaaagtcgaagatgagtctttcgaagaccaagcaagncggaccttctgacaatgaggacgaacaatacacaagacactgattctgagatatcgagtgacnaagacgaagatatatcaagaagatgaaaccctcgctgatcgattatatgccctgcgagatattatacctcctactgccaagatcatttatctccaataaattcgnaacaactacnaattggatcaagtcnggtttcaagctaggcggcaaaaccatatgggttgtgagtacgagtgtatactgttaggtgtccttgggcgctagctttcgcaagaagagcaacaaatgatnggaaatggggaaaagagatgaaaattgagagagatgggaaatgaggctactaatcccgcaaggttccgtcataccttacnggnaaaaatcccaagtttggggtggggtcnanaaggtaaanccaancaattgtaatggtcncttg

SEQ ID NO: 93311 - DNA, 541 bp, Triticum aestivum
  unsure (1)..(541): unsure at all n locations
  Clone ID: PAT_TA_93311
tgggggcgccnaaaatantggatccccgggctgcaagntcntgccgaattccgcacganggnaattctacctggcaactgggagctccgtcacccctgccggcatgtcncangtgaggatngtncacccgagctatgtctatgtgtcgganancgccgtccgggcgccggggncgatnaatntgaccgccatggaggngctgtggatngtcatcccngtgggtgcaagcacgtgntgctcnacnaggncgacgacgacangacgcccttccacgncattctncantncctccggtcctccctcnccgcgactttnttcaagcttctcnccgctcnccggcaagctggtccacctccacgagangggggaagtcggcatcaaactgctccgcctccgacggggncangttcntcntggcggngtggnaancaaaaatcangacgcctggncggcgacgaagagnaacacctgctggtgctccangggntcgtgccggaggtggacaataancaactgccggnccccntggtggtcgttgaag

SEQ ID NO: 93312 - DNA, 501 bp, Triticum aestivum
  unsure (1)..(501): unsure at all n locations
  Clone ID: PAT_TA_93312
ctcgctccgaatcantanctaagcagcaatcgnatcatcaacaatgggnttttgccgnccggcgtcccacgggtggctccaaggagattgctctcttcgtcctcgtcnccggcgggggnttaatgaaaaagctcccgtctgccttgggngccgctgggcaacgacgccactggtagtaaggcactgggtaagcaacgaaccctaaaacaaccctggcttttcccggtcgccggcctgggggaaaanccctacaaccgggtccgtccgttggaggaaaaattttacnggntggttaatggtaccaaccgggnaaggtgggccaagnccctaaattacaacccgtggnggaagggctcaatcntccaaaaaacaaatgcaaagggnttcggattggggnttnatggtnnacngggaacnggggggggctnanaacgcaattattactaaatatngggggnnataaatggaatgggccnccctanggntaatggnatggttaac

SEQ ID NO: 93313 - DNA, 549 bp, Triticum aestivum
  unsure (1)..(549): unsure at all n locations
  Clone ID: PAT_TA_93313
cccaaggccgcgcgcaacgcccggnaaaangcnggacttgtnaactcctccggctcccgtnaatttcgggcaattnaatngcgaagcccaatggaccctcaaaggnctcaaaaatggnaaggtcctggtgctgcgttnattcaatccgggattcaancccccggggcgcccgatngacccgccgcccggtgggaggccgcgctctttctaacgcctccgtggtcctccgtcgcccccgcaaccgtcgcgcaacttggaggtgaggggggaaaaaaggccgcttgctgaagcttaatttatcaaaagaagagtttgtntcccatgcaatttaaaanggattctgcacgccatgtcaaaaagantctgctaaaaaagtccctttgaacaaggtgactgggtgggaaactgaaaaatgaanggtgacaattttgaaaattncnaaaaagcatgggaaggtgaagaantttgttaaanggacttgagttcnttcaaccttgtttgctgctgttgctgaaggaagaaggtcaacaaccanatnttcatctcgtc

SEQ ID NO: 93314 - DNA, 521 bp, Triticum aestivum
  unsure (1)..(521): unsure at all n locations
  Clone ID: PAT_TA_93314
tcagatttttgtgaatttttttgaaaatcgatgaactttttcagtttttgtgaactttcttgaaaatcgatgaactttttttgaaaatcgattaactcattttaaaaatcgatgatcttttttcagattctgtgaacctttttgaaaattgatgaacgtttttcaaaactgatgaacttttttcagatttagtgagcttttttaaaaattgatgaactttttttcaaaatcagtgatcttccttcaattttcataaactttttttaggnacattttattctaattcatgattcctttaaatctgtagatttacaaaaaaaattacatttttttcaaaggaaatcacgtttctctgtaaatgttggcaatgtacatgcaaaaagtagtgtggctacatttttctgntcttanancgtccctctaagaggtaattcacaatgtgcccaagtagctcaagtggntgggccaaccacaatatttgagtaacgaagtgcgaggtgcgnagttccgattccacacag

SEQ ID NO: 93315 - DNA, 393 bp, Triticum aestivum
  Clone ID: PAT_TA_93315
ggaaggtatagttgaaccaagctttgtgtatcttccaggtattacaggtggcgcagaaattcaaaaagaagtcggcgttgacttttttctctgttccgattgaattgagtaccaacggagccgaaaaaattcaagacccaatatctaatgcaaccgacgatgaaaagaacctgataaaagcggcaatcgggggtttaaaagaaaatattgaaaagggaattaccttttttcacacaccgcaaagtgaatttctctaagattctctcaaagcccttctcgcaccccatttggaatcaggctgcttatctaactaaggaacatgtgcatcaagggagtaatcaaacctagcttgtagctttattcttaattagattaaaaattctgcctggaaaa

SEQ ID NO: 93316 - DNA, 506 bp, Triticum aestivum
  unsure (1)..(506): unsure at all n locations
  Clone ID: PAT_TA_93316
gtttcgcgagtctgccagccaccaagatgctactgcaagaagcacatgtagacgtatccactcgagccgagggtaaggaaggttctatgagagatttccgggtgttgtcctatttagtgagatttaccaaggtgagcgagccagttaacttcttgcggatcattacgaattctttccaaactactgtcccgctgccgcaccaagcatcccttacgtggaattatcgctgctctacaatttttgcaaaaaagtcaattttctgcttctgttcaatgcctgggttcacacagtagtgggctctgagttcccagcatctaatttgcggttttcaatgcgtagtcactgggccctgggggcaagatttgcccgtcagatcgctaagccaagggttcaatgttgtcgcaacttcttcctaacangactttattggnccgggnggcactccccctacgaangctgctgggactnctggcaaggaancaatttcaanggtaaaaaaaaacatt

SEQ ID NO: 93317 - DNA, 512 bp, Triticum aestivum
  unsure (1)..(512): unsure at all n locations
  Clone ID: PAT_TA_93317
cttttttaactcccacaatatgcactctgttacattcttttctattctactgactggcgtggtcactaccagagccgatgtggctcgagtggtaactgatatcaacaagatatctaggaattggggacatcttagcccttacgcaaacaatcgagatgatgactttggtgtcgaatatgtcggacttcctgccggctgccaaattgaatctgctcataccctccaacgccacgcagaaagatttccaaccaagggcataaacgatggnagaaataatcaacgtttcaagtgaaaaggncacaaaacttcacttcaacccatccaaaaagatctgttcactgggccccctcccgatttatgaattcgtgggatccaatcatactcaagtaatggcctgttaactgggaatgggtggcctnccggccgaggtttaaaggctggggggttgagnttctgggaacccgggaccgggaggaacaatttgntaattgcnaaggcngttgggcnaaatt

SEQ ID NO: 93318 - DNA, 517 bp, Triticum aestivum
  unsure (1)..(517): unsure at all n locations
  Clone ID: PAT_TA_93318
ctcgtgccgaattcggcacgaggagagaactagtctcggttaacgaaaatgcggctgatgccccgatggatgcttctgagggaagtaaagacgctattaatcagccaggagctcttgccgaggaagctacctatattaatcacaattttgcaaatcaagtcatgattgagaatgagagcaaaaaaagtcgaaatgcctaatgagaatccattctacaatccagctgaggaaaacgaacctgctgcaagcaaggcatataaatatagaaggtttgacctttctctgaacgatgaagatccagtacacctcataagtccgaaccgagctagatgccgttcagaagaatgcaattagcggcgaagatcaatttttaactgtcaaagctctaaatgagtttgaccacaaggcgcanggtagcggnggggctctcgagtggngggacaaaaacttggttaagccagcggcgggtgctgtcgtagctaccgaaatgaaaaataacanctgcnaagctaacaag

SEQ ID NO: 93319 - DNA, 525 bp, Triticum aestivum
  unsure (1)..(525): unsure at all n locations
  Clone ID: PAT_TA_93319
ctcgtgccgaattcggcacgagataaacttcatctatacagtgccctaccacacacatttagcgtacttgcagaaaatcatcaattcccatcgccctttatatgttatagtcagtatcaatcccgctcctagagtctcttcgtgtggttgagaaaaattttatatgcagccgagctagagaatcctctcatgacagacgtcggagatctatgtgcccataactatttgagtagctcccatttaccgatgaaatattaacaaaaaagggtataaagattcacaaggatgcaaaaacgtgattaaaatttttgcgaattgagttccgcgagtcaaaacaatcgcttcgctaccaatattccactagctccacctatacaccaacccattcaacctggataactccgcaatccgtantattccaatttaacaatcaacggagnaaatatggcnaggncgtgnataaagactcnggggggngaaccaaagngggtntggtaggactttcaagcaatcngagganaaaan

SEQ ID NO: 93320 - DNA, 516 bp, Triticum aestivum
  unsure (1)..(516): unsure at all n locations
  Clone ID: PAT_TA_93320
ctggactggtgctacctgcgtccttgaatggtctgaaatgctcatggcgataggggaaaaatatcgtggcgaagctggcgctgtgtcgccattaacatcctctatcgactggaatctcggctccgaatgtcgcgactcatcctgtggtaatctgcgactagagttgtgagattctcggcgctgacggcctgccatatgggttgattgtattacacttaaatagtaagtattttaagcttagtgcggctcgggacatctagatggtggcagaagacgaccactcgatagtttgacgaatgcaatagaacagaggaaaaaagtatattatgaattatttgatgatttaacaagagctcatcgaagggacagacatgaagctatgaacaaaacaaagcacatgagctccggccgaattcgggcacgaagctcgtnccgaattcggcacgagggagagaactantcccgagggggggggnccggtacccaattccgccctatngtggaggccntanttac

SEQ ID NO: 93321 - DNA, 191 bp, Triticum aestivum
  unsure (1)..(191): unsure at all n locations
  Clone ID: PAT_TA_93321
ctcgtgccgaattcggcacgaggttggnttctcctccccttccggntcgggntctgngttcggttcggcttccgttcgtcgagagagggcgnntangtagcctantctagggnttcggtaggngaggnagtgaagatccatggangatacggagtacngnctggcttcntnggcggcctcgcctgggccac

SEQ ID NO: 93322 - DNA, 486 bp, Triticum aestivum
  unsure (1)..(486): unsure at all n locations
  Clone ID: PAT_TA_93322
ggtttttttttttttttttttcttggaaagtaaaattggtgtatgacagataaatagatgaggtcttgtcaattaacatatacttcctgctcttctgcatatgaaattttcatttagaccgagatgcatttatcaagatcatctgaaaagagatttcaagcgattagccaaaagaatcaatattgtcaagagcttagcttcctctatatgtcgtgtagctatatggacccaacaatagaggaacgtgatacagccctcctgcctcgacttgaaatgtcacttcaactgttggaaaaaaggtattgccttgaccaaaatatgtttctgtatcaaattcaagtttccaaaggctgtattttttttctgaatccacagaatctgatgatgagtcgacccctttttgaaggacatgacaaaatatgtctgtagcnacaatgatattcgacgtcgaccantcgggtgttttctctgctagaaaacatctaa

SEQ ID NO: 93323 - DNA, 487 bp, Triticum aestivum
  unsure (1)..(487): unsure at all n locations
  Clone ID: PAT_TA_93323
caaaaagtcctcaatcgccaacctagacatgacataccttctcttttactcagcgtttctggtgctcataattaccacttttctatatctcactcgttcaatgtggattcgacatctgcctgccctaccaggctcatcatttatttattctcgactgccgtccaattttgtatcggatatggagaatggcctatcgtcccccgaatttgatctatcctcaaatattgcagctggtgacaccagaagaggccttgatgacaacagtaagagagagatacagggtatcatgaagagtcggcgtgtaaactttgatgaagctaggaggatatttactgaaggatgttttgcaaaaaatgatatcagctctggatggtctaccgcgaagatcccaaattcggtctgcttctcataacacaatatcgattccaacaatatttaacaaagctccatataacaagacgcctttacacataagcgccaataccan

SEQ ID NO: 93324 - DNA, 513 bp, Triticum aestivum
  unsure (1)..(513): unsure at all n locations
  Clone ID: PAT_TA_93324
ctcgtgccgaattcggcacgagcaatcatgtccactcagatgaatgaagcctacaatttacgagtcgaaagtagagttcaagaaactcaaattgttgatctgattgaccgggtcgtttggtatgcgcgggaaggtcttcaaattctggaagaatacgtgcttcccatggtcgctaattatcgagacctaaaggtgctaagcttcaaactgagggcaagtttttactatctatatacactcttccacaatcaaccccctcttaacttcgagtcaaaacaatcaaccagagcttggggacgaccacctacgtatcgaaaaattgacaagggtagagttgtagatcttanctacagccatccatcttattttcgtgggaccttctcccgccaaaaaaagcccgaattcttctttttcaggaggatcgcanccttactcggcattttctcggnantttatcgntgnttaacaaagaataacggccaatcaagcctcaataactttcnncgagggggg

SEQ ID NO: 93325 - DNA, 512 bp, Triticum aestivum
  unsure (1)..(512): unsure at all n locations
  Clone ID: PAT_TA_93325
ctcgtgccgaattcggcacgagcagcaaaggaactttaccgcatagatacaaacttcatagctggctcaacatcgaaagataacaatctcaatcatgttttatcacaggtaaaatatgttgctggccgtcttagctgtacaacaacagtctgaatatgatctctagcaaacaaaccactattattggagattgacggtgacatcgaaggaatttctgatctatatgtctaccatgaagaatagcagctatgaatgatctatctgtctaccataaagaatagcagctatgaagagtcctcagagaatcgttctaaatgtccagcgatagatctatctatcgtatctctgcctatccgcatgccttgcgcataacattgtaaatgatcgttcgtcagcttctttgggaacatgtatcatcatgaaccatgtatctatcaacaatccatacttatttttataaaaanaaaaanaaaaaaaactcnagggggggnccgggacccaattcgccctna

SEQ ID NO: 93326 - DNA, 519 bp, Triticum aestivum
  unsure (1)..(519): unsure at all n locations
  Clone ID: PAT_TA_93326
ttaaaatatggtgttatgccaatgacatcattcctctcaaaacttttcgatagactcagacctgctatcggagccacccccggaaaattacgcttaatatatatttccacacttgctggtatcgacaagccaatatcatccttaattctttctgatcttagaattttcacaagagcacgcataatttatgcactcacttcatcaaaggttgctggtgcagtttctcagaccggaatatacgattaccgctttaccgatgatcctgaaaaatcccatttcgggccaccagttacgagcttggagctcttctttcagggntagcgataatcataaaactagnaacactttatcaagtggggaaatcgcaatcgctggtccaacgggtgttggtggggaaatcgaaattaggagtgcaaaggaatgatgaatgnggnttttgggcattaaagtttaaaaaacatgaggtaaacaactccggtggtccntttttaaaccacaatgtagaaatggtagctcaag

SEQ ID NO: 93327 - DNA, 512 bp, Triticum aestivum
  unsure (1)..(512): unsure at all n locations
  Clone ID: PAT_TA_93327
ctcgtgccgaattcggcacgagagtccacctgcttgaggagggcctccgtgctgagcggtggcaggtaagacagggtctcgaacttcttgatgccctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggagggaggtcaagaaaggagtaccctgacgcgttacgttccgcatcaatccggattcgacaacaatgcgncaaagtggnangtgcggtcaagcnttaattgccnttcaaanccaaccggggcttgcaaaggngtnccgggaaaaggcctaaaaaaaactncaaacccaccaaagggggcacaanttnaaaggngccaattgaaanttttttncaacccccggaaattggcttttgggttttccctcnccccaaatttgccctt

SEQ ID NO: 93328 - DNA, 446 bp, Triticum aestivum
  Clone ID: PAT_TA_93328
gtcacgacctgtcccgctcagaggtcttaagtagtcgtaacatacacttgttcgttcagacgtggaggggctctacagccagtcatatgaaaaaagattcgaaattttgtcagccggtatcgatttataattactcaagatatcatctcatcaccggcgctttcatttcactcgcgaatactgctggctctatcctcgttcccaacatttgataaccgtaattaattatcaaaaatatcgagtctaacagttcccttgccccaagcaaaattgtgaaatgacaagggtacaaacaatttgaggccatttgagaagttttacggagcgacgataatcccatccatcctcacaattaatggccaccgcccaagccgaaatttccacgcttgtctatctgaaccctatttgagactggctagctgctaattgtttctcacttttccgta

SEQ ID NO: 93329 - DNA, 517 bp, Triticum aestivum
  unsure (1)..(517): unsure at all n locations
  Clone ID: PAT_TA_93329
cacaagtggacaactacgattaagcgaaatatcttgtagtatcttgaagctttcatcaactagacacaatgtcaggaaaatttgaacctcgcacccccacgactcttcagccccctaaagatgaccctataactctcgatgagcttcgaagagcagacggtgtgcagagtaatcattgctatgtggcaatcaagggcaaagtctttgatgtgtctggaaataaagcctatctccccggtggatcttaccatgtttttgcagggcgggatgcatcgcgtgccctaagctcttaccaagtgtcaaaatcgaagacgttccgacctgaatgggagggatctaagatgcaaaagaaaaaaaagacacttgacgattggatgatatttttcaagcaaacgatataatgtagtaaggnacnggcaaccgcttgagggggtccaaaggtataagggataagggcggggatttttcancaagatttatgnaattttcaatattttatttcaaattncgaactagg

SEQ ID NO: 93330 - DNA, 523 bp, Triticum aestivum
  unsure (1)..(523): unsure at all n locations
  Clone ID: PAT_TA_93330
gcgtaccaaaaatcaatacaaacactattcaattgggttcacaaaaaagttaacacaagcaagacccaggtcatcttccgtacttatgctcctgtgcacttcagaggtggggactggaatagtggagggagttgccacttggaaactcttcctgatgcgacaccgtttaaatcgctggagcaatgggctgacaagcttgagcctgtccataatgttcttgggagcagcacaagacccaagctgcctgggttagctatactgaacgtgacacaaatgacagcgcaagcgaaaagatggtcacctgtcagtttacatcagcccttcggggcctgtccccctgcgcaagacaggattgcaagccattggtgcttgcctggagttccngatacctggaaacgaactttgtgttacgccaatccttcatgaaaaagggnaanacaaatggatngggccaaaaaatggtttctccttgggtgcntcaangaaacgtttgancaacaaancnggactaaaaantcctgtg

SEQ ID NO: 93331 - DNA, 455 bp, Triticum aestivum
  unsure (1)..(455): unsure at all n locations
  Clone ID: PAT_TA_93331
ctcgtgcccaccggcgctacttcgggctgaggacggcggaccaccgggtgatcgagttcgagtgcaccagccagagggagtatgagctgtggaccaagggcgtggcccgcctcctcagcatcgccggcgagcggaagcgtcccctgtgactgactgagtgggctgccgacgccgggcttttggtcgtccgaactccggagccgtcccatgtgtgcgtttgtttgctaggctgtanatgtgaggcgaggggcaacagaagaaaacagcatgggctatgtatggggtgtacctcttgtcctgcaagagaaatggaccatcatgccgttgctacttgttaggggctggaagtgaactgaaggctgtgtgtttatgtgcatgtgggttgggttgggggttccaatcaactcaatgtgtgaagaaaagtggctanaagtgaaattcccccctttgctcaa

SEQ ID NO: 93332 - DNA, 420 bp, Triticum aestivum
  unsure (1)..(420): unsure at all n locations
  Clone ID: PAT_TA_93332
cgcctccccacctaacaattcacgtactccgccatggncccagnccgtgatggtttcctccgccaccaccgtcgcgcccttccaggggctcaagtcgaccgccggcctccccgtcagcccgccgctccggcagcgccggggctcagggagngntcaagtaacncgcnggaaangatcangntgcatgaagagtgnggttcgaattgaagggcatnaagaagttcnagncccctgtcttacttgccaagcccntctccactgcaggnncctcataanagcaagggttgacttacctgaatgccggctccaangtgnggtgnccctgcccttcgaagtttcaagcaangggntgggggttccgnnccttcccggtgangcaacaannaaggnccccccnggggctacctnacgaacnggttc

SEQ ID NO: 93333 - DNA, 516 bp, Triticum aestivum
  unsure (1)..(516): unsure at all n locations
  Clone ID: PAT_TA_93333
ttttttttaaacacagcttccctaaaaaacaagcttaggaaagataaccttggatttcaacaggacatgccaaaggtttgacaggaaatgtcgttaagactgaagtaacaaactgatagtcactactcattattgtgatatgatgatcatacaaaataaaacacttccaaccataaatagaactcatggttgttctaccagaaactaaccggattgacgttgttcctaagccattaagatgctccgttcgccgtcaaattccttcccattaatgtcctccacctgtcttgagcctttttcctttctacgtccagcgacaacgagccatcgacgacgagggtttgtggattgcgaggcaggtcagccaaatcaatctcatatgggcagaggaagtacttcttgggcacactcgcacagtcaatcttcctcatcgacctatcactgagggctggatagaaagaagccatctccatcaacccaagagnaacaacggaacaactccttgcccccgggaca

SEQ ID NO: 93334 - DNA, 499 bp, Triticum aestivum
  unsure (1)..(499): unsure at all n locations
  Clone ID: PAT_TA_93334
tcaagatgccagcttagatctttctaaatttggaaaaatggttaaattgataaactttgcgccttatagaggagctgcggaagctctggaaaatgtgaacttagtttctgaaggagtgctatctgactatcttcgatcaaacctcgaacttaatctcccaaaaccttcaaagaaacaaaaggttgtcctaggtgtatcagataaaaacttggctggtagcatcaaggcgacctttccaggtgtcgaatgcgagacctcagaaacatcagaagttgctgctgaccttcttcgtggcctacggcttcacatcggcaagctcttgaagggccttgaggatggtgatgtcgatagagctcaacttggcctgggacatgcctactcccgcgctaaagttaagttttcggttcagaaaaatgataatcatatcatccaagccatcgctacaatagatnacctcgacaaggctatcaacactttttccatgcgagttcgtgaatgg

SEQ ID NO: 93335 - DNA, 597 bp, Triticum aestivum
  unsure (1)..(597): unsure at all n locations
  Clone ID: PAT_TA_93335
gggttgctggctggttgcacctacttggggctggggcccccttccaaatttgtattttgggccgagggggtctggataagggaaaaaaagggaacggggcttccaacnaaaggaaacctcaaagggcccaagccatcggctgggtgatgtacaatcttctgggtgaagcaacgaaaaagtccatccantcccantacaaagtcccatgtgtatgccaaacccctgagaatgtgacaccaaaaaatcgtccgagaagcccgctattgaaatttgaccaaaaaagaaaaaggggcaacgatacgtccctgccgcggttccctggaangggggccttctcgaaacccccgttccaaatccnaaggggaaaaaagttccttgcaagcctggttttgccaaagttgggatggggaggatgtcccctgttttaaatggggggtcgaccgcctgaaattccccccaaaagaangggcccaaangggccggaggaattgggggggctcctcaaaaggggcggccaaaaaanggggttggaccaaaaatttccttggaggggtccccgggggcggcgccttcttgcccggcaaaggnaaaaaaaaa

SEQ ID NO: 93336 - DNA, 504 bp, Triticum aestivum
  unsure (1)..(504): unsure at all n locations
  Clone ID: PAT_TA_93336
cgagcaggggccccatccaggagaaggtgaggacgctgaggaagccggcgctcgtgaagagggaagcgtcgacggtgtcgtcgccgcggctctcgctcgcgccgttgagcagaggctcctcggaagcagagccgcccgtcgtcttggccgagaacccggcgacgagtagcgccacggctgcgaggacctcaacggcgtcgcgcgcccacggaagcgcgggcacggggaccccgtagcagaggctcgtcgcggcgtggacggcgagggcgagcacggagaggagcagaaagagcgcccaccaagagcttgagcggcgcggcgaaccgctcctccccgtggctccggtactggagctgcaggtaggccgcgagcagcaaccacgccaccgcgcgcgccgcggngtccgcctggtcgggcaacgcgtcgggcgccccccaaccgggcccgctgttgtcgaggtaccacgagacgagcgagtacgcgcccgaggaagacctcggacgc

SEQ ID NO: 93337 - DNA, 287 bp, Triticum aestivum
  unsure (1)..(287): unsure at all n locations
  Clone ID: PAT_TA_93337
ctcgtgccgaattcggcacgaggtaacgctcgattcagattgtccgttcaacaacctccggatagaatgctttgtgtaatacctagttacaactgtacctcctgcttgttcaaccgcctcgattgccgtggnagatgcccttgagactaatattttgatacgtgttttaagttcctcttttcctcgggccaatagcttnactccatcttttattccatgaatacaangtgatttgtacaagttctttgagggtcatcacntttggnaagggtcgnntacacccttgg

SEQ ID NO: 93338 - DNA, 403 bp, Triticum aestivum
  unsure (1)..(403): unsure at all n locations
  Clone ID: PAT_TA_93338
cgtgccgaattcggcacgaggttggcttctcctccccactcaagtcctcggttcccggtccggttcggttccgttcggttcgttanggtttaagtanccggggaannggnaggcatggntggaccgtcgagtaccgctgcttcngtgcggcggcctcgcctgggccaccgaccgaaccaagtccctccatanaagccttctncaacgttacgtggngaacntcattcnactcctatatgatcatcactgnacangggaagacgtggccgnttcccgcnnggttcaggggttcgaccaccntcggntcctgacagaggccnaatgcctccaggtngnattcggaggntcattgaaatntgnccanggaccgtgttntcggccanctattnattaacgntcaact

SEQ ID NO: 93339 - DNA, 496 bp, Triticum aestivum
  unsure (1)..(496): unsure at all n locations
  Clone ID: PAT_TA_93339
ctcgtgccgaattcggcacgagctccagcatttatccaaacagggtgactaaattccacagatctcccctcagaaatttctactcaatggcctcagccggggtaaatgtgttgcgctactcagtcttgggtgctggagtgatatatgggtttctgcatcaatcaaaattatcatcagccgcaaagcattccgcgattcaaaaagaatatgatcacaaagtagcgttaatcgctcaggctaaagcagaatatgtgaaaagaacttcaccttccaacccgaaagctgctagcaatactgcaattttcgatcttgaaaatccaaaattcgatctcgaggcatacatcaataaaatttcaacagatggccactagcgtagccgtcatagctctacaagatgaacgaataaaatcctagcgctttgcgaggaacatgggtgagtcttattttcggcaagacaaacttatagcaagaaatatatacccgaaaanttcgatgg

SEQ ID NO: 93340 - DNA, 483 bp, Triticum aestivum
  unsure (1)..(483): unsure at all n locations
  Clone ID: PAT_TA_93340
cagtcaccgtaccatctgnngcanccagctcagtatcgggcaagannagaaganatttattttcttcccccgcggggagatcgatcacagccggtcagnncatgggcgaggaggccccggncgcggtcaccgcggcggnggcgacgtcgccggcgccccacttgctcctcatatgcttcccgngggcagggtncacgtcaaccccatgnctcccgnctcgaccanggcnccttcgccggccaaagggtttcctgngncancttctcctcgancctcntangnttgggcggcananatcaacggcccccctcctggggtgcgacggcctggtcggccgacggtgttgcncgcctcgngccaacnggcacgattccgggngtcgangttctgtgcgancnacgtnttttccancggcaaacgnacctcccnnagaactctganngtagggcaccntggcaagtacccaccgngccccggntgggg

SEQ ID NO: 93341 - DNA, 487 bp, Triticum aestivum
  unsure (1)..(487): unsure at all n locations
  Clone ID: PAT_TA_93341
gaatcgagccatttggaaacttataaataatttctgtacaccaagtcactaacgaaaaaatggcatctaacactaggacgtactctttattagtagcatgtcgtcgcaattcaagacactcgctcttcaagctatctccctcacgctctgtttcgacagatacaaaattagagcctcttgaaaaacagcgcccaacttattttaaagacagtctaaatagtgtaccgtcattctccgaatttatgggggttgacaacaaatcacttgaaccgactgatgtattcaaactacgaacagcctttgttggtccgcccgggaagcagagacaaataactcgactccctgaatggctaaagactccaattccaaataactcaaattataagaagataaagaatgacttgcgaggactaaacctacatacaagtgtgcgaagaggctcgctgccctaatatctctgactgctggggngggagtgataaaagtg

SEQ ID NO: 93342 - DNA, 458 bp, Triticum aestivum
  unsure (1)..(458): unsure at all n locations
  Clone ID: PAT_TA_93342
ctcgtgccgaattcggcacgagatcacttcaacgagatttgaataacgcaacgagcaacaactccgcatacttctaatccatccatctagggcactaagccacccttttgacaaccccccactttccaagtgtcagcaaagccagttaaagtcgagaaattctccccagtctccagctcgacagttcagtcttcaccaatatgtcttcttacttagaacaagctgctgattctgtaaacgatgttgccgctatcgatcaagctctacccgataaccaggcgagtactgataacgccccgggaggagctcaactagaccctgttgcaacaagtgctgtagaaggacgccgtctttatatcggtaatctcgcctatgcgacgactgagggggagttacaagaattattcaaaggatatttgattgaatctacgtcaattcccaaaaacccgcgcaccgan

SEQ ID NO: 93343 - DNA, 483 bp, Triticum aestivum
  Clone ID: PAT_TA_93343
ggaccatggctccccggcttcggattgggtaagggatgtaagggcggaggacgcttgtcaacccaagcgcatgcacggtgtcgagatcttcaggaccagggacgcgagccgcgcccgcgctcagccgccttggagcctcgtgcggcgcatcatcgttatcagctgaggcgcctggacatcccaacggcagcgggaggatctacgacctcctcgtccttcttggcgcttctctggtgctcaacgtattgtcatgcatgatgttttacatcattggcagaaaagcgagtctggtccgtccggagagaagcaggacagggtgagcatttttcaggtctgtacgtttacatgggttctgatctgatggttccagccctgttacaacatatcattcttatgttctgttgtgccacggtgatttgtgtgtaactgaaattcaaaatgaactcaagttggcaatgtgccagtgcctgcgaatattctcag

SEQ ID NO: 93344 - DNA, 501 bp, Triticum aestivum
  Clone ID: PAT_TA_93344
ctcgtgccgaattcggcacgggcatggcgctggcgagcgcggaggccggcgactccgcagcactagtaggtaccaccgaggagaactccttactccatgtggtagcgaccgacggggacggccatggctacctgaagagcgcaaaggtaatccatggcaaggcccatcggctgctgctcgcgcgcaacaggcacggcgacacgccgctgcactgcgccgcccgggccgggaacaggcacatgatttcttgcctgatcgagctcgccgccggcgacgggatggccagggccatggtgggggtgcaaaacgaggatgggaggacggcgttgcatgaagtgatcggctccgacgacatgcagatggtccaggctttgatggcgcacgacaaggagctggcccgagtggatgcgtccgatgggacatcgcctctgttccttgccatctcgctgggtcatcaaccggattgctcgctggcttcacgagtttgacaaagagttatcc

SEQ ID NO: 93345 - DNA, 351 bp, Triticum aestivum
  unsure (1)..(351): unsure at all n locations
  Clone ID: PAT_TA_93345
ctcgtgccgaattcggcacgagctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcaaaccngnttcaancaataagggcggcagnnngcattcctaagtataattanttgatgccgtctccataatgttttgctggtgcncccaaagccncanccgaattgattt

SEQ ID NO: 93346 - DNA, 559 bp, Triticum aestivum
  unsure (1)..(559): unsure at all n locations
  Clone ID: PAT_TA_93346
ctcgtgccgaattcggcacgagctcgtgccgaattcggcacgagattattcctcgccaacccgcaaacaacttcgtccctcatacaatttcaataaaccttcccaaataggaatacccggttaaatatcttggaggacaatatcgtctcaagcacaaactttctgccactcaaatacaagccaagctttcacacaattgcatcagaaaaaatcacaagggactatttcgggagcaccactaaanaatggagaccattccaaacttttgtctggctattggcaagtcttcaaataagtttgaaaggatagttagcgggggtggaatctttatttgggggattggttaaagggggtaattccaattttatttccgaactggtccaatggctgccgggtgggggaaatttgggnctttttaccttcggcangccaagggtttctaattagctggggttaccccctcaaattttggcccgttacaaacaaccctcctaaccgggactgggacccagaaccgaaacggtccgacaagntttccaactaaacaagaantactggg

SEQ ID NO: 93347 - DNA, 469 bp, Triticum aestivum
  Clone ID: PAT_TA_93347
ctcgtgccgaattcggcacgaggagagaactagtctcgatggcacctgccgaatctgggacttgagaagtagtagatcaggtactaaagaagaagggaacggggtcgttagtgaggcagtctatgttattgaacgtgaaggtcaccagggaaagagaccagttggtggtgagggtatcaaagtattcggagtacattgggataaagaagttggaatggtcagtagtggggaagacaaaaaagttcagattaatcacggaagaggtgttaccagactcacgacttgattgagttttcattgcaaattaatgcacattttgctctcatatcttgtcagacttttcttcaacagtccattctccgaaccaaacctttaaaggtgtacctttgggtatatgctcgatttatcacacatccaggctcgtaaattagcgaggcatgcggtacgccttatcgacatgatcttctac

SEQ ID NO: 93348 - DNA, 313 bp, Triticum aestivum
  Clone ID: PAT_TA_93348
ctcgtgccgaattcggcacgaggtggtgccaaggggcgcttcttgcctacaaagccccggcctgaaacatccatggtgttgcccaaagctacgattctgcagatgtgtgaaggtattctgaagaagctcatgactcagaaatgtagtcatatttttaatgttccggtagacgtggaaaagctgaacattccagattataatgacattatcaagcacccgatggaccttgggaccattaagaagaagctagattctggttcctacacaaggccatctgattttgcagctgatgtcaggctgacctttagcaatg

SEQ ID NO: 93349 - DNA, 239 bp, Triticum aestivum
  unsure (1)..(239): unsure at all n locations
  Clone ID: PAT_TA_93349
ctcgtgcngaattcggcacgaggntccccanccacacatagaaagagcgtctaagctccaggctagcttgcaatggncgccgcactgagcctccgcgcgcccttctccctgcgcgtcgtctgcgccaccggcagccnccgagtggccctncgcgccacgcggtcctcagcctcgccgncgccaagnangtgcggggagataggnttccgtcgcntaaggnnacggntacnaaggtgact

SEQ ID NO: 93350 - DNA, 336 bp, Triticum aestivum
  unsure (1)..(336): unsure at all n locations
  Clone ID: PAT_TA_93350
ctcccggcgctgcagttcctcaacctctccaacaaccacctcgacggccccgtgcccggctccctgctcaggttctcggacgcctccttcgccgggaacagcatgacgcggccggcgccggtgtcgccggcggtcccgccaccgtcgctcgccccgccggcggccggcgcgcccgccaagaaacggggccggctcagcgaggcggtcgttcttgccattatcgtcggcgggtgcgtcatgctgttcgcggtcgtcgcggtgctgctgatagccttctgcagcaggcggggcgggntaggangggagccgngcggtgtccgggaagggcggggataa

SEQ ID NO: 93351 - DNA, 458 bp, Triticum aestivum
  Clone ID: PAT_TA_93351
catcgccgcccactactgttaatcagacctcgactacgcccatggctgcacggcgtcaatcgctggaaaagcagctcgcccagcgccccactgctcccgagctccgcgctcgccatattctgcccgagacggcggcggcgcctgcgctccaaggtgccgctcacgatctcgctaagcagatgctcgccgatagcctccatgagaagctcgcgcgacgccctgatgcggaagagctcgtccagaaaggcatcttgacagaggccgatcgtctctacgaggaacgcatcgaggaggaatatgccaagcgtgaaggaggagcctaacgccgtctgctgggagtgctgagatctatgcctctggcgatgtcttatcgttcagcgctggtcgagggtgctttgaatccgccactgaaggctgtaataatatttatgcgactacaacactcaatctcctctccc

SEQ ID NO: 93352 - DNA, 460 bp, Triticum aestivum
  unsure (1)..(460): unsure at all n locations
  Clone ID: PAT_TA_93352
gccgccgccgctccatcccttcgtagttgggattgtacgagagagtgccagatccggcccgggagccgccgtagagcctccacctagcagaggagcagcagcatcaacagccacacagctcgcctcgccgcaccgcaaaacatcgagggcaggggcacctagcagaggagcgcgcggcaagctcgtcaccatcaaagccccggcccctttctcgccgggccatggcggcggcggttgacggcacccggaagcacggggcggcggccttcctggacgacccctttgaggtgctgcaggcgaagcggggccggtgctcgccgtccgccgccacggtgcggtcaccgacctcggcatcaacatggagttcgaccccgtcgaggcgctccaagtccgtattccccggcgccgattcgcagatgtanccggaggtgaaggggaaatttccggnagccaaaaaaaa

SEQ ID NO: 93353 - DNA, 449 bp, Triticum aestivum
  Clone ID: PAT_TA_93353
ttcagattacacttgatctaatactcacgaatactcccttcgtcacacagatttaaccgcattataatttaactccgattaagatacgagccgagaagatgtcaggcgaaacatttgaattccaggctgagatatcccagctactatctctcatcatcaacacggtctattcaaacaaagaaatattcttacgtgaacttgtctccaactgttcagatgcgcttgacaagatcagatatgagtcactcgcggactctagtaagctagattcgggaaaggaccttcgagttgacatcatcccaaataaagagaataaaactctaactatcagagacagtggtattgggatgactaaagctgatctagttaataatctcggaacaatcgctcgatctggaaccaaacagttcatgggaagcattaacggctggggctgatatttctatgat

SEQ ID NO: 93354 - DNA, 433 bp, Triticum aestivum
  Clone ID: PAT_TA_93354
gcacgaggaacagagctccagcgcaagggcaaggcttcgccatggctaagctacgttcctcacatctggctcccgcgacggccatggagcagcagctgcaccagttcatatctcgcgcttcgaatttctacacgagaatcacagggcaatgagataaacccgaacaccttagctctagacggtgtcaacgttatggaagaacgcttagcaaatgagcaaagtgctatatgcaactggtgattggaactcgaagggattcgttctcaaggaaacaagtatgattgagtatcgcaatgaaatcaacgtgtttcaacgctctccggcatttggaaggcttgcagaagacaattgcccaagaggtgaactttgagctcaataagcaccactacaacaaaggatactacctagtgaatgatatctatcttcattgatc

SEQ ID NO: 93355 - DNA, 433 bp, Triticum aestivum
  unsure (1)..(433): unsure at all n locations
  Clone ID: PAT_TA_93355
gttcaaactcaccagccgaggttgtgtgagtcttctgcgctgtcggaagggtataagacggccactttttctgggttggggaaagccagaaaaaccttattaccatacctctaatcactgactctgcccacaccgaccaccccgaaattttcgtccaattttttcccatcgccagcgcctccccctccataccaccaccactactaccaccaccactgctactattaacactactacaactaccattaccaccaccactaccaccaccaccacctctaccactcactcacgcttccaccaaccccaaaactctggtgccgactcgcctcccaacatcgtggactccgataacctcactctgtgtcggccatagcatgtccttggtctcccagcctcccttcacgaactcattcanctctagcaccggnagccg

SEQ ID NO: 93356 - DNA, 436 bp, Triticum aestivum
  Clone ID: PAT_TA_93356
cttcggcctggcctggcttgtctggcgacctctctctctctcgctcggtttcttcctccctcctcctctgtttcttccccagatcctcaaattcccatgtaatttctagatttgtaactaaatccttgttgattgagtagaactagtagagatatcctcacaattggtatcagagccgttcgattctgcaccaaaaatccacccaaattttttcccaatcaattccatggactcacggcggcgcgccgagctcctggcgagcctctcgccggaaggtcgggcgacgtatgaggtactcagggcccagctagcctgtgatctgggccatgtcttcccccgacgccaagcacggccccgacctgggcgttttcgacttcgttaacaacgcgctcgggccaagcctctgtgcgtctcgagcaacgggcatcacaaccga

SEQ ID NO: 93357 - DNA, 558 bp, Triticum aestivum
  unsure (1)..(558): unsure at all n locations
  Clone ID: PAT_TA_93357
ctcgtgccgaattcggcacgaagctcgtgccgacggcggcgacggggctcctctcggcggcgggcaaccggccactgattggttcgatctttttgtcggagcccgattgtccgggacggggcaggcgaaaaggggatccgccggcgggagcgataatctagggctatcccgtcaagccaagaaaaaggcccaaggcttttaatcaagcggcggggcggcggcgggctgctctgccaaacggatggggacccgcaaggtgngcgggtgcaaggggccggggngaactgggggtgtccgggcgggttggacngccgcctgcctggaaagccttgctgttgccctggaacgggttgaatcgggccctcccttccctggggcccaacccccgccgggggcggcaagggtggggttggccccaaaagggcccaaccctttcaaangctggcctcaaacaaaaggctccgtccttccgcgcctccttccctgccccttgcccctccaatctttccgtggcaaccctccgggcncaagttcccggttcaacggcctcccaacaaa

SEQ ID NO: 93358 - DNA, 407 bp, Triticum aestivum
  unsure (1)..(407): unsure at all n locations
  Clone ID: PAT_TA_93358
gcagctcaggatgagtgatgctaacaagtcttcgttggccacatcggcatctggacaagaagtggactaaacgtcatccccgcacatcaaatgcgaccagtaattacggctggacttctgggtttgtccttagtcaaacatatttaagtttgatcaaatttatgaaaaaataaatttcaacgtcttatatttaggaatggaggtggtaggagattgaagtaggtcttggcatataaacttgaattactagatgaatgctccgaacgtcttatgaaatatatttctgtatcatatttattagattatgtacgtcttggcatataaacttcaattactagatgaatgcttcgaacgttgttgtgggagtttgtatgaaataaaattgtgctggtttaatcacganacaa

SEQ ID NO: 93359 - DNA, 480 bp, Triticum aestivum
  unsure (1)..(480): unsure at all n locations
  Clone ID: PAT_TA_93359
ctcgtgccgaattcggnacgaggagtttttttgctcgtccctccaaggcttcgtatacttttaagaagacatatgaatcagtgtnaccgctgggtaggcggntctattgccgttaaacttctcgaatgaacttggtgggatggncccccgacatccttgcaggatcttttacaattacaacttttgggaanttctcttctanaacattgctggancactggaccatcttcaatgacggttgttctcaagctcacgtantctccatcaacaatgtggggacacatccaccgtctnggatgactgggtcggaatgttgcttggttggggcagacatngtgtcaanaaatgaattctgtggttccgtgggggcaaagcgaaactcgaaatcctcaancgcccgttatccccttcgtccgtggtcnccgtcttccgtgntantcgtcgggcgnnanctcctttttccgttaaggcggttccaag

SEQ ID NO: 93360 - DNA, 596 bp, Triticum aestivum
  unsure (1)..(596): unsure at all n locations
  Clone ID: PAT_TA_93360
ctcctaagaaatangtgggattcccccgggggctggcaanggctccgcccgccaatgggtggcctccgcgtgcccctcctcccctccctccctcggtcgggngccggcgcctggctccctggggccctggcgggccgggncgcggggcgcngggcgtccaaacgaagngaggggggaacgccgcttggtacgcgctgccgggattgccgggctggtcgggacccccaacggnggtggctccaagaagnctggggatncccaacccctccgtcaaancccctgcaacctgggttccaacgtcaacctgncgaacacccgccaagccggcggtcgtgccgcctgggatttaaggcaaactccaaacgtctccgggctccatcgggccccgagctcaagccgccttggtgaaatcttcaagtacctggnaggcctggtacaggaaacaacctcaaacgngcggagatncaaaaangaagtttggggcaaagctgaaangaattttgattaagcttgggnttctgtnatgnccaatnaaagctcaccggnaaggaatcccccaangtccgcctttccaaagcttaagctccgctnnaaga

SEQ ID NO: 93361 - DNA, 297 bp, Triticum aestivum
  Clone ID: PAT_TA_93361
ctcgtgccgaattcggcaccaggttttctatgatcgaaggccaacgccgatacgtgcgacgcgtggtcctcaagaaatatgaacctaaaactccggatcacatcttattcgtaaccctcgtatacaactacgagtcttagggaaaataaattttcttgttcagataaagataagaatctacactatgtaaaatgattggtataagacgggcaaattcttccctacgacggacctttcacttatatactagttgctgcgggacagatagcaaataaacaagttcataattaaaaaaaa

SEQ ID NO: 93362 - DNA, 284 bp, Triticum aestivum
  unsure (1)..(284): unsure at all n locations
  Clone ID: PAT_TA_93362
gggaaatnaacggacttccgctattgcnacttggncttaacaagtcttcnaggtctacgcanttancgcaaatgttgtcgaatccgattttatttgtgaccaggatattatccccaaggacantattaatactgcaatttatcacgcctgttcagcctctcagcactccattaggtaagactaaatatccctgttgcggttcgatgccctcaantttattctttagtcacgacgccaagtcttcattctccttggcnctgtctcaaatgggagaggagnaatca

SEQ ID NO: 93363 - DNA, 390 bp, Triticum aestivum
  unsure (1)..(390): unsure at all n locations
  Clone ID: PAT_TA_93363
ggtccttgttttacagttaggatcaattgatggatacccaaaaccgtatatgccaagtcctagagcaaaaggctgtgcaggttgtctcgaatttccactatcagatacactaaaaatctggagaggaggacctgttaagtaccgtgctgtgttcggcccgctgagagacactgtcaatgtattttcagatatagatggtggtcaagaatgtgtgagtgcataaaatattaattaacaagnactaaactgtaatttcaacacatggaatatttaagngaatatgcaagtataataggtactgaattgntacagccttgctggaattatgnatcaaggtaaataggaaataaanaattctttaccctcctacaggaaaagcannnaacatcg

SEQ ID NO: 93364 - DNA, 556 bp, Triticum aestivum
  unsure (1)..(556): unsure at all n locations
  Clone ID: PAT_TA_93364
cgcccccggtgagcgagcatatccgggctgatcgaaagtcagtatctttatgccgactcgtcgggatctatgtctaacctgcttccgngctttgtccagctccgcgtccatctcccggcccgnagaaaccctanccacgagggaagggaggacaccatgagggggggaaangaagcccgctcaagggaagctcacactctcccgtgccgggcgcaaggaagacgccccgtcggataaaagttcctggacgcgcgaagccgngttatcgttcaaagagacgggtgaaacctgcngaacttaaatcaaaaaagaagggttttgcaagctttatcctcccgaggggannaaacgggnaggantggaaaccatcanantcaaacaaaaaaaatgaaagggtgggnaagantgttgcaagtttaatcnanatggggattgaccctncgangaatgganttcannggtccatttggtaaaaggggggaaagtggggtgggtgtttggtccaaactaagttggcgggcaacanaagntgggggtgggggcnacaatttttatt

SEQ ID NO: 93365 - DNA, 435 bp, Triticum aestivum
  Clone ID: PAT_TA_93365
gcctgctctactggatcgcccagctcctgggctccaccgccgcctgcttcctcctccgcttctccaccggcgggctccccaccggcaccttcgggctgaccggcatcggcgcgtgggaggcggtggtgctggagatcgtcatgaccttcgggctggtgtacacggtgtacgccaccgccgtggaccccaagaagggcagcctgggcaccatcgcgcccatcgccatcgggcttcatcgtgggcgccaacatcctggtcggcggcgccttctccggcgcgtccatgaaccccgccgtctccttcggccccgccctcgtcagctgggagtgggggtaccagtggggtgtactggggtcggccccctcatcggcggcggcctcgccggcgtcatctacgaagctgctcttcatctccccgcacccacgaagcaggctt

SEQ ID NO: 93366 - DNA, 559 bp, Triticum aestivum
  unsure (1)..(559): unsure at all n locations
  Clone ID: PAT_TA_93366
ctcgtgccgcgaaacagatccagctcttgctgctcctcgtctccgtcttcttggccgggaagaaaggaagggaaaggcagcggcggagaccaggcgatggcggcgccgctgggagttcctggaggcgcagggctcgacccggccggnagctgcgtcgtggagtggtacgcccgccctcgcccggacctctaccaagccggggaagctctgggcaccaaactcaccctcaaagcntcgnaccaggttccntccgccctccggccgtcggtccaaggcgggggtggaatgcntcctggatttcaagcctggtatacctcantttcaatcctcctgaatttccgaaggaggcaaagantcaactccttccttanaaattttggctcaaccttccgccgggctagntaangttttcaacggcccaaggtaatttcaangantanaaaggaatgcctgggntagtaaaggcttaatcctccgaaaaggggcggtaaattttctaaangccttgncggtgnattacccaaagngganantcaacgggggtttgaaaggangcccn

SEQ ID NO: 93367 - DNA, 447 bp, Triticum aestivum
  Clone ID: PAT_TA_93367
ggctgcaggcaaaaatgcatcgccaatgacatgctttactcaaaaacaggtagaacaatacttgcctgccacagtaacgtgagctggatcttattcgactttagttatctaaatattcagacatataatgaatatggtctgtttgtcgattagattagattagatttttattatagtcctatctgagcctacgactataaaggacttctagcttctaaatgaaagagacaaacaaatttcgataaattcaaccattttaattcccaatattttcttatagatggtgaggaaatgtttgtcgattatgatgtggctgcgattgcagttggatgtaaatattgtaaaggtctttatcaagtatctttaatatatatatttattatggaaatatcctcccgtgaagtctactatagtatgtacatgtaaatgtcttcttttattgatatt

SEQ ID NO: 93368 - DNA, 445 bp, Triticum aestivum
  unsure (1)..(445): unsure at all n locations
  Clone ID: PAT_TA_93368
tgngcaatgtcaagagtanagagggaattccgcctaattcacgaaagcaaatcggtttatctagtgatttttgttgaaattcctcaacgccgaatgacgctctaaaaatcaatccaatttctcttctgaacgaagacccattcacatctccacgccctcaanacacttgtttctaaggattgggggaagggagtaatttatatttgggctaanaacatgggnacatgcctttcattcaaagaaaagcctttaacttacaaaanaccgaggggcaaataagaccctggcgggtcctttatacgntatcantccaaattctcttggtnttttcaagantttgcaagnaccccgntttttaagnttaaaacggagtattgggaggctantcctaggcctatggagcaaantaaanatggttangaacccctntangntggtttcaggg

SEQ ID NO: 93369 - DNA, 483 bp, Triticum aestivum
  unsure (1)..(483): unsure at all n locations
  Clone ID: PAT_TA_93369
aagctatatacctacatagtanagccatggnncccaccgtgatggcctcgtcggtcacctccgtcgctcctttccaggggctcaagtccaccgccggcctccccgtcagccgccgctccaacggngctagcctcggcagcgtcagcaancggtgggaaggatcaggtgcatgcaggtgtggcccatcgagggcatcaagaagttcgagaccctgtcctacttgccaccgctcangcacggaggccctccttaagcaggtcgactacctgatccgcctccaaagtgggtgcccttgcctcgaagttcagcanggttggggttcatcttcccgtgagcacaacgcaattccccctggggtactacgaattgggccgggtacttggacaatngtgggnaagcctggcccnaattgttncgggattgccacccggaccgcccaacgccaaaggttgattcnaaccgaagggttgggtagggaangtg

SEQ ID NO: 93370 - DNA, 278 bp, Triticum aestivum
  unsure (1)..(278): unsure at all n locations
  Clone ID: PAT_TA_93370
ctcgtgccgaattcggcacgaggacaagagaaagggcancaccaccgtcgtcgtccttaattgttcctgcgtctccccccttccttccaaacagcggtgacctccaccacctccaccaccacccaagagccggagcgaggagaagnagagaantnggagatcnaccntggctgcggccggcgggaggtgggtggggcctggcngttggganttctcggngggggangccgcntcggngctggcagtgggcggccggtacaaancttggctccgccgcc

SEQ ID NO: 93371 - DNA, 508 bp, Triticum aestivum
  unsure (1)..(508): unsure at all n locations
  Clone ID: PAT_TA_93371
ctcgtgccgaantcggcacgagctcgtgccgaattnggcacgaggtttttctggaattggaacacggagagtgcgcctgaatggcactttcaaaatttaaccagggctggattgattcctcagccattgggattcgccgaaaggtaccaagccagtgtgggcacatcgcagngccttatccctgggaattaagggagtcattcattatttggggaaaagaacctgcgaagttttagtagcgggattatcanacattttattaataatctatattcctctgggaaataattattcaaaaatttgctttccttctaagaccgggncgnanacgtnacancattctccgaaggggggggggcccgggnttaccccaaattccccccctaaaaggnngaggttcgttattaccggcnccgctcactgggnccggtcagttttaacaaacngtcgctgaactggggnaaaaaaccccctgggcgtntacccaaacctttanancggccnttgg

SEQ ID NO: 93372 - DNA, 579 bp, Triticum aestivum
  unsure (1)..(579): unsure at all n locations
  Clone ID: PAT_TA_93372
gctcgtgccgaattcggcacgagcaacttcantatatatacanccanagancgtatcttcactgttgaaatantgggcaacaaatgccttaggtcacacattatncaggaccaggactcgacaacggtcacacaaaacacccgggntccttgccatggggtttgcttacacanntattacaagaccannaantacaggatagtcatgcttaagccatcacaagccanngancaacgnttcgataacgaatacaanttacggtagggtgngctccaaatcangaatggaatgcactaagccagngtaatgcactnaggccaagggtaancccaanggttcggagtctaaggaactcccccttggtcnggggnaaacaagggganggggggggaagccaggcnnncgggggaaccaaggnnttgnaaaccagcaaccctgggctgtttggccccaacttggggggtccgccggaatcctggacccncaagaacaggaacgggtccaaccccggnaccaatccgnacaaaggccttttcccggctcctccgcccaaagncggnggggtctnacccaagcccn

SEQ ID NO: 93373 - DNA, 550 bp, Triticum aestivum
  unsure (1)..(550): unsure at all n locations
  Clone ID: PAT_TA_93373
gttaaccttgagaaggaccagctattttgtcttcttggnccaaatgggagctggtaaaacaactacaatcaagttgcctgactggtatcacaccaaattaccggcggcgatgctttgatttatgggtcattccgttcgaaaagctctgcggggtatgtctaatattcgccaagaatgattgggagtctgtccgcagatttggacatcctaatgggggatgcattgnaccggcctaaagggaagcaacatgngaagtttgttttgccaagcaatcaaaggggggtttgccatccaatcaaacaaatcaaaggttcgggtangctaagnaaacaagtcacctangccccaaaggntganagcctcaagcccaagggccaagcctaaatggtttatgagnccangggtaagcctancaaggttgggtgngtcnatggaacaaccggccgggnttaaaagttggtttggccgaatntggcctcctnaantttggngtggaccccanacaaaattggggtgggttttcccttnaagggaggnccgaacnaacntg

SEQ ID NO: 93374 - DNA, 495 bp, Triticum aestivum
  unsure (1)..(495): unsure at all n locations
  Clone ID: PAT_TA_93374
agatcacaatgcctctcccagtgtcaagttatgttcccgccatcaccaatccattaactatatacagatcgttgctggccaccaaacgaatagagcccgatccatctcagtatagacttgctattcatcttcaaaatctctatttccgcctcattgactactctccgcaccttgaatactctcagcggctgaaggatctaagccggctagttagaaatcccacgcanaatgatgaaaacactcatgtancagctttagngacacccactaagacaagaatcccttattcgcctcgcctattttccaaaggaaaggtgcaccggagaatcacttgccctganccgtgtgcntcacangcctacggaaatcgggntaataagtcttttcctcaccacanangggnctacttggtacnancgggtgnaagtagggaaagctggggaaagtcaaatgtttngttcnaacataactggnctggaccggggccttccaaaa

SEQ ID NO: 93375 - DNA, 391 bp, Triticum aestivum
  unsure (1)..(391): unsure at all n locations
  Clone ID: PAT_TA_93375
ccaaagctcccagctttttccccttccgtccgtcgccgccgccgctctagggtttcctcttcccgatccccgatccggntccangcagcagcagcgagcgaggcgatggcggcngcgggagacgccgngcgagaagaagatgatcacgctcaagagctcggncggcgaggagttcgaggtggaggaggcggtggccatggagtcgcagatgatccgccacatgatcgangacggactgnggcncgacaacaggaatcccgctcctccananggncaactcncaaagatcctcctcctaaggtcatcgggganaantggcaancatgtnnacgttccaagggncaaagccccgcccgtntcggtnggccggctggcaccgtccgtccnggaa

SEQ ID NO: 93376 - DNA, 380 bp, Triticum aestivum
  unsure (1)..(380): unsure at all n locations
  Clone ID: PAT_TA_93376
ngcgaancggggggtggcgaccgctacggaccggcggggatntccccgcgcgcctgtctttacgggatctgaccgccgtccatccgtcgtcatcgcccgaagaggaatgttgcgaggtangagaagggcactaccacnatgggtttaanacgaccgttccccaaaaggggagtcncancagaaccaaggcgtggaaggccctgcggccgggcgggagcgctcgccccggagcagcaaacgcggnggagaagcaaggtcaagccgttgacgctgcgggcctggagcagctggggaccgaagccccggacagacnggcgaatctggccgcgcaaggcacggacgcaggctgtccccaacccgcgctgtcaacgaacaagatg

SEQ ID NO: 93377 - DNA, 287 bp, Triticum aestivum
  Clone ID: PAT_TA_93377
ctcgcatgtcaagtctttgcgtgtatttggttagcagctaaggcccgagaaattcgatgagaggtgtggttatgggaatgaggatgtgctaggccgtacctgtagacttgatgaggcttagataggaatccatctcattgtgagtgaaagattaacatggcggagtattttgaatcattgcctcatgggccaactctgctttctttttttaaatcatttaatttgtatgcagttatctagccataacacatgatcggtgctttgtatatttaaaaaaaaaggggggg

SEQ ID NO: 93378 - DNA, 376 bp, Triticum aestivum
  unsure (1)..(376): unsure at all n locations
  Clone ID: PAT_TA_93378
gaatgtgnttaatcattaatcaaaggattaggntangatcaaattggcggaaatcaagttcgatccatnaataaagcttcgagaattantgcgttaanttgttgcacaatccatccaccccacncccaaactcttcgtggtcgcagaaggaaaaacaggacantcaangaaantcccatcttctgccgcgcgccagntgaaggccgatntgtcagcaagagttccntcctcaanggaaacctgacgaactgggaancagggttcatcctggccgnncctggggctccgcanggttcgccggaagaatcatggggcttcgcacgcgggcacgccgtcngaccctcccggggaancncggaggccctgggcctaaggg

SEQ ID NO: 93379 - DNA, 491 bp, Triticum aestivum
  unsure (1)..(491): unsure at all n locations
  Clone ID: PAT_TA_93379
gttcgccgtcatcaactcatcacacangcacacaccangaagtnaaacanagaatgagtcntcgtgctcntgcgtangtncacncttanccacacctttgcatccgggaggagtgacaagggggagcatacatacatggncggggggccatggagcggatgnaaacggcggcggcgngcgggcgttgaaaggtcaagttcatccgaagacgcaagttcggtcaagctccgancgccgcccaacttcaaagtccgtcgtngcagcgggcttaccgggcaangntactcnanataatgcccgccngcccgccgggcgggncctccggtggcaacaaggcccaaccgcccccgaagggcccgtggcggggnaagaanccgggcccaancaaangggggcgggtccggtggcggtcctcccgggcaagcgggnccaagccttgaacnaacggnntggcngcccggggcgaagggccaaaangggggggcggggcc

SEQ ID NO: 93380 - DNA, 486 bp, Triticum aestivum
  unsure (1)..(486): unsure at all n locations
  Clone ID: PAT_TA_93380
ctcgtgccgaattcggcacgaggcggctccggccccggcgccggcttctcgagcttcatcgccaggcggcagcagcggcgggcggcgacgcgcgggctggacgccgaggtggtcaaggcgttccccaccatgcggtacgcggaggccaaggcgctgcgcgtggggaggaaggcggcgcccctgctcgagtgcgcggtgtgcctcagcgagttcgaggacgaggacaggctccggctgctgcccaagtgcagccacgccttccacccggactgcatcggcgagtggctcgccagccacgtcacctgcccggtctgccgccgcaacctcgaccctaagcaaggacggtggnagcgacgaacgangcgagtaaccccccggtgcttggaacccaaacagcaacctccagcgnaaatcgcccgttggtttcggcaccaccaaggnaagancggngccgncggggcanccgggccgtgggttcaatcgaat

SEQ ID NO: 93381 - DNA, 595 bp, Triticum aestivum
  unsure (1)..(595): unsure at all n locations
  Clone ID: PAT_TA_93381
ctcgtgncgnattcggcacgagcagacgccgacaaagagcccgaatccanaagtgacgcaagaataatggggattccaacatcaaagctcctcgttcattgtttgggtgaaaagcctatcaaaggncaaacctatacctcaccgtccgacacaaattatgaagcccatgcactgctaaattaaagtggcttacccgccgggcaaagcaaagcccgggaaaagctaaaagcctaaaatcattgtttgcaaaagaaaaccctgcaggtcttgggtcctccccgggaaaatatatttgggaaacaaagctccgacaaaacaagtctaaacaaaccangaaagcctggattgganatcccaaaagtataaaaattgttctaagcngaaatattttaaaaaagggggtaagcaaanggaantttcgnatttattaaaagggatttacttttgggggaaccgaaggggatataaaaactggccctttggaaggtaagattcccgtttgggacaagggccnttcaaaggctaaaaaatttggcnttatcctaataaaggacaaaaaaaacnttttttctccttttcccntccgggcccctgg

SEQ ID NO: 93382 - DNA, 578 bp, Triticum aestivum
  unsure (1)..(578): unsure at all n locations
  Clone ID: PAT_TA_93382
gtttatctcctctcgccgcagcctccaccgaagccaagagaggagcagggcgaaaggaggccgtcgggagatgtcggaggaanaagcgcgcccccgggcccgcgncaagggacgagggtgggtgacacgccgaagtacaccgtcaaccctccacaaagcgcctccatgggatgcaccttcaaaggaaagaaaggcaccaaaatgccatcaaagggaggatcaaggggaaagtttgcaacaagaaaagggcccatggggggaaccaaacggatggtccgcaattgaacggtggaaagcctccaaacaaaaggcacaatcctgggganggcaaagtggggcaatcaagggaagtggtcccccgaagngaaggaagtccggtggtcaaagggganttgccccggcnaaggaagggaaaatggaaccgaagggaagggaccgncttaaaggggaggggaagcctggttaacctcctctgggttcaacaaagatttgcctggaaaagtttcccccaagggaaaaggggtctntaaaaaagggttttgggggttaccaaaaggtttgttgnggaggggaatgnn

SEQ ID NO: 93383 - DNA, 538 bp, Triticum aestivum
  unsure (1)..(538): unsure at all n locations
  Clone ID: PAT_TA_93383
ctcgtgccgaattcggcacgagctccaacagccgttgatagaacgcgtgtcctattccaaactttatacacctctgacgggtggcgagtggcaacctcaaattccaactttcataaataccacgcattttctccatgattctccaatctcccggccgtctatcgttgaatcaccaagattgactgaatttatccgtactagctggaaagagaaattaccatcacaagcaatggggtctcaagaaacgaaagtcctccgccgaaatgcggctgcagcgccaaataaaancaaacaaagaagctttccggggaagtcatggggccccggtcgcaaaagccgaggcgnggcaacttttacaaantcttgaatanggcagttggggtgggtatctaanggattcatttttttaanccctgggggnactacctcccagngaaggcggcctcacggaaccaacccccggtacgggtccctttttgaacggggaaccttganatttctttcaanggtttccctggttgnttccttnaantacatt

SEQ ID NO: 93384 - DNA, 501 bp, Triticum aestivum
  unsure (1)..(501): unsure at all n locations
  Clone ID: PAT_TA_93384
ggctgcaggctcgtgccgaattcggcacgagctagtctcgagttttttttttttttttttgttcatcgcaaacgtactctcccttcatccttggtaattacatcatgtgtagctgctaagttacaaggggagcaaaacgcgtattatgtttgtttacacttaaagctaaggcaagattgaaagagttttttactcgctactttgcagttcacgcgcctagcctgtcccaagcaaggatgtacatacaagancagcggcagcagggcggcggccgggaggatgagctatgtcctatatgaagatggtggccgtcgaggccggggtgcatggacgccggcggacccatgagcgggaacgagcaccacggcgcgtacatctgcccggccatggcggngtcctcgacaccgccggggcgcacggggcacgggctgcgtccggcgcgccgctgcaagctgccgggccgtgnctggtgctgcctggcctatgggccnccggcggggc

SEQ ID NO: 93385 - DNA, 475 bp, Triticum aestivum
  unsure (1)..(475): unsure at all n locations
  Clone ID: PAT_TA_93385
atccaatcaaccatctcatctcagctcatcgaacatacgtctttaattaaaattttaatcaaaaatatgcagctttctacttacctcgctgtagccatctccgtcggcagctccaatgccttatatcaaggatttaacgcacaagtacgcaattctgatggatcgtgcaaaaaacaagcagattgggaggcagatttcaatacgacactttcgctcccaggaaacttcaacagcttacgtctgttctcctctttggaatgcgacgccataaacctcattgcgcctgccgccattgttaccggtggtaaagttctggcaggtatctcgatacaacacccaagaactttttgcaagtagaaaagcaacagctattggaaagctgtcaaacatcacggttccgaatggctcgctgctgttntcggttgggtacgacgatttaaaaaacagcgagatcttgtctgattccccaagctaa

SEQ ID NO: 93386 - DNA, 304 bp, Triticum aestivum
  unsure (1)..(304): unsure at all n locations
  Clone ID: PAT_TA_93386
ctcgtgccgaattcggnacgagctcccctgctctcccctgcttctgcttcttcttcttcttcctgtcgatcactgtacctgcactgcaanagacttctttaccgatcnttcaaancaaagcnccgaggntcnatttgatcgtcaanggatnatctgctgcaccacggggcacnagatnangaggncgtncgtgcccngccatgaangcggcgctgagggccgtccaaaaacccgccggccaaaaccgtgntgcgcgggcggagggcttnnntccccggcgccccaacgcccggccaaagggtgg

SEQ ID NO: 93387 - DNA, 521 bp, Triticum aestivum
  unsure (1)..(521): unsure at all n locations
  Clone ID: PAT_TA_93387
ctgcaacggagagcttgtcggtggcttctggnggtgcgatgcagcgcccgtgcggagtcatagaactcggcgctgcatcggagcttcaccggcggagcccggagccgtgatgcagcgggcggtgctacaatggagctaccccggcggccttgagctgcgatgtagcaagcgggtaggcgatgcagtgtagcttcgccggtgacggccgacggctgcaatgaaacttcaccggcgctgcattggagcttcacggcgaagcccggagctgtgatgcagcggggcgggtgctgcaatggagcttcacctcgtgcccgaattcggcacgaggggggggccccggtacccaaattcgccctaanaggtgagtncgtattacgccgccgctcaactggccgtcgttttacaancntccnctgactggggaaanacccctggcgtttaccccaaactttaattcgccttgnaagcacaatcccccctnttcggccaagcntgggcggnaataagccgaangaagggcc

SEQ ID NO: 93388 - DNA, 491 bp, Triticum aestivum
  unsure (1)..(491): unsure at all n locations
  Clone ID: PAT_TA_93388
agntcggtgccnaatcggcacagctcgtgccgaattcggcacgagctcgtgccgttttttttttttttttttcacggtaagataactttatatttatttccgcgcctttcaattttccggctcttcaacttcgtcaattgtctccggctcttcttcctcgaagctaccaactggtacttcgtaaaggcggagcatgggtttgtttgggtctttcagtagcacatacttgccttcctcacgctttaagcacatgtcagcaatggtgcgcacgataccccatccatttgaaaggctaagattcatctgctgagcaaaatcacgcggcttccacccaacaacaccaagtatgacgtgacgatcattaagttttaggattagctcgagaaacaaatcctaagcttcatgatatctgcactagccattatactttgagttgtccatccttgctagcttgcagctgntattttttcatttcgggnaagctacgacag

SEQ ID NO: 93389 - DNA, 498 bp, Triticum aestivum
  unsure (1)..(498): unsure at all n locations
  Clone ID: PAT_TA_93389
cggatgggaaaaattactaatatgcattccatgatattgagggtcagtttattgcacctacttttcangaaggatgaaacatccaagcggccctccaagccttcagttcanacgctctccaaaagctctccaaaaagcaagactggaacattccngatagatttttcttctacgcctatcctaagcacataaacgcttgaagggatgcaatcgcaaaaccctggagctggaagtcaagaaacttaagcaagtgggnacccacaaaggcgttatggaaatctatggtcaaatccaataaaattggattggcttttatcaactcctcaaatggggcgaaatgggaccgaactccaagtttatcctttgtttttgggggggaaaagatgttcgccttttccgggtggggcgtanttcangatgttngtcctannggtccnaactttgaagnaagataatggggggcccgaanaaggaagtcttttanntacacccaaccta

SEQ ID NO: 93390 - DNA, 561 bp, Triticum aestivum
  unsure (1)..(561): unsure at all n locations
  Clone ID: PAT_TA_93390
ctcgtgccgaattcggnacnaggtcccgtccaagcaccagccagacgccgaaatggngaacactacctccctcttctccctcgccccgctccgcctcacccgccggcgcctcctctcccccanccccggcacggnctccccgcttccggacgctcgcctcgaanaaggngggcgcctccaccgtctcccgggccccgggcggggggcgccngggagcgggctgctctcggtgctcgaccggggcgctcaaccgacgaaggaggagttaccgccgcggcgcgccgcccaagtgtaagcgcaaggggccgtnggaggggcgggagggggtaacccccgttccgagggggatntccngggtggggccggggcaacngaagaaccttgccgtnaacccgttgcccgttcccctcaaanngttcgccccttccgaacatnnggggccggggggccccgcctccttccgcccggttgcngaacaagggaccaaccttcttcaatcaacccaagggnccaacctccgaaacaaaaatnggggtgggnccttnccaaatnggtactaat

SEQ ID NO: 93391 - DNA, 504 bp, Triticum aestivum
  unsure (1)..(504): unsure at all n locations
  Clone ID: PAT_TA_93391
ctcgtgccgaattcggcacgagattcggaaaaaatattttaatcgctaccgggaagtgaggccaccccatttccaggactcgaggtccgacgaaaagcgcatcataaccagtacaaggtgctatcgcgttaagcaaggttcccgaaagtatggttgttatcggcggtggaataatcggccttgagatgggctcaagtttggtcgcgattaggtgcaaaagtcagcgttgttgaatatttgagccagattggcggtcctggtatggatgctgaaatctccaaatcagtccaaaagatcttcaagaagcaggggcatagaggttcaaactcaataccaaagtaattggtgggagatgccagcggtgaaaaaagttaaagcttatggtagaagctgctaaagggcgggttaaaaccaagaagacttttggagtgcagatgtcgttcttgtgggcctatttgggacggtcgancaatacaactgcaaggtcttgggattaagaaaaat

SEQ ID NO: 93392 - DNA, 506 bp, Triticum aestivum
  unsure (1)..(506): unsure at all n locations
  Clone ID: PAT_TA_93392
acnctatccgcctcntgnacgcttttcctccggncnccgncccgcctcgagcaagntcaggaacgcgcgcagccatggcnacggaggaccgagaccttcgccttcnaggccgngatcaancagctcctctcgctcancatcaagaccttctactccaacaaggagatcttcctccgncgagctcatctccaactcctccgatgccttggggcaagatcaggttcgagagcctcacggacaagaggcangctcgatgcgcagcccgagctcttcatccacatcatccccgacaaggcgaccaacacgctcacgatncgtcgacagcggcattggcatgaccaagtcggacctcgtcaaacaacctccggggacaatcgccaaggtcggggaaccaaggggngtttcatgggagggcccctcgcccgcccggcggccgacgntgtccatgaattggggcaagttttggtggttcgggttttctaantcccggcataccttcggtcggg

SEQ ID NO: 93393 - DNA, 499 bp, Triticum aestivum
  unsure (1)..(499): unsure at all n locations
  Clone ID: PAT_TA_93393
gggctgcaggctcgtgccgaattcggcacgagggttaaacgacatgtactaaaactaacgttaagataggactttagtgctcactcaaactacgtcgagctcgctctacgagagatgggctatcgggatgtatttccacacacaggagtttcgaccgaattaaatattcagggccactatatctatccgctaacaactggaactttcggtgccgttgatttcctgcacagtgtccttggagaggcaaccgatcatttcactcaaaccgaggtagatgaaatggatttagtattaaagaatgccgaaaaaattcaggatggcgacagtcggaaatctagtctcttcggctcagggagcgacttgatccgtctccttaaaaaagtcccaggcttagggctagacctttcttcgactgccaaaaatcttaaaatcancttcagaaagcgaaacaattaagaaaanacacaaatcgaagccgggggtcatggggngggatttt

SEQ ID NO: 93394 - DNA, 222 bp, Triticum aestivum
  unsure (1)..(222): unsure at all n locations
  Clone ID: PAT_TA_93394
ctcgtgccgaattcggcacgagatgtgaaccattgacttgatagtttcaagtctaaaagcttcaattctttgaaaatgatgcccttgtatgaatggccacacaggctaagagactttatttcataaatgagatagccatagatttgtttagataaattatatcaacaaatgaatatttttggacttctaaaanaaanaaaaacananaaaaaaaaaaaaaan

SEQ ID NO: 93395 - DNA, 518 bp, Triticum aestivum
  unsure (1)..(518): unsure at all n locations
  Clone ID: PAT_TA_93395
ctcgtgccgaattcggcacgagcttctcccgtcccgtctccaagcaaacctcccatctccgtctagcgtcggcggnagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcancgtacgacaccgttcacgggcactgggnagcacaagcgacatcaagctcaaggacgacaagactctgctctttgggggagaagccaagttaccgtcctttggcgtcaggaaccctggaggaagatccccgctgggggntgaagggctggtgccnatttacgtttgtggaggtcccaccgggtgtctttaactgaacaagggacaanggccggctgctcaactttgaaaggggtgggtgccaacgaagggtgggtcatctctggccccnaaggccanagatgg

SEQ ID NO: 93396 - DNA, 424 bp, Triticum aestivum
  unsure (1)..(424): unsure at all n locations
  Clone ID: PAT_TA_93396
aaataagagatttattttatgggcgtcatcgaataccgctctggcagtgaagctgtttagttccacnccaagacatttttctatttattcgcaantttaattttgggcnaaatcccaaaaggngtgtttagagttangatacaaatacttttataaatatcctcgcacgtccaatgacacttatatgccatggagtgactccntcatcactaaacctaaagtttcaagtctccaancacataacgacaagttttatgtctcaaagagatagccgatttgaaagtccantggatttgggtttcttccgggctaaatcaagagattgaagatgcgaaaatctgaggngtacntangcaagcnacnanatctggaanacataacatgttgggnttatggntttagtcccgggaanccaaatttcgcg

SEQ ID NO: 93397 - DNA, 501 bp, Triticum aestivum
  unsure (1)..(501): unsure at all n locations
  Clone ID: PAT_TA_93397
caaaaatgaaagagtaaatgaattgcaacgcgaggctttgaacaagttagtcatgttcatccataaaatttgtactgcttacactacataaaggtgcaactcgctcgattgttgaagcgcgcctcaaaaatcttgggctgcgcctgattcgacttcctttagaacaagaggcaacagataggcacgttccaatctttgtttcatcagaattgaagagcaaaaaaagaataataatcttattctatgagcaacagcaggatctcgggatcctctcatacagaattatttgcggaaagggcggaataaatcatggttctgttgtcaatatggttaagttcatacagtcaacgcattgctctcctgatagtcaagactctcccggcataatactagcnaatatgggacaacttcggtggtggcgtcgcggtaaaaaagcactcactcaaaattcatgggatacaantccgtcaaaaagcttagttgatccgtgctatcaatttt

SEQ ID NO: 93398 - DNA, 516 bp, Triticum aestivum
  unsure (1)..(516): unsure at all n locations
  Clone ID: PAT_TA_93398
ngctaactcgttgcacaagaattcctcccancctcgccgtctcgccgccgtcaccancgcagctagataagagaaaaaaagagagagaagaactcgtcgggagggctcgagatctgtgttcggagaggggaattcttgaggtcggaatcggaacaagcgggcgcgctcgggatcggggttaccatanaatttttcccangaanctttagtgaatgtgctaatggngtcaaagggtggcaaaaagtctancagtagtagttcccngatgtacgaagctcccctcggctacagcattgaagacgttcgacctgctggaggcgncaagaagttctctgctgcatactcnaactgcgngaagaagccaacctgatatcgtttttggnatccccntccccgtagtttaggagttttatgcaattttattctgagncttttctcccancaaactctctggggtgctgcttcacnaaaatcgaccaagttctcctaagncttctccctcctgttcctctccgg

SEQ ID NO: 93399 - DNA, 519 bp, Triticum aestivum
  unsure (1)..(519): unsure at all n locations
  Clone ID: PAT_TA_93399
ntcgtgcccgaattcggcacgagcacaaccaagcaggacgaaggntgaacacctgtcagtggtgccctctacgaacctgggggtgaaatattctcccagagccgagattcagtcacgacaaagggtgaattcgagagttttcgtcnagttggcgatcgggaggagtggtgctggcaaatttttggtcgaaaatccgacttgcagagatttcacgactgcacaactcaacgaaatcaaccatctacaccccaggtacgaaccgcaagataggctataacctgtctgatgttcgtatcacaacaaccgacactttcaggatcttattttctttttctctgggnaattcattctcagccaaactcatctcgcgggcctctccacaaacatctcaccacctacagaagaaatcccacacctccaaaaagccaaatcgccatcaaagaagcaagaagatgtcagnccctccgcaactgccaatcgctgtgagggtaaggtccgaaataacgggctcagatgctg

SEQ ID NO: 93400 - DNA, 419 bp, Triticum aestivum
  unsure (1)..(419): unsure at all n locations
  Clone ID: PAT_TA_93400
ttaaccggtgagcctgtggngccagcgagccacagtcgaccccgccatggtcgggtccaccgcggtgctggccgccatcctgctcatcgacatcntcgccttcggcctcgccatcggcgccgatcagagccncccctcggcgagcctggagacggncgctaggaaagagtggacctactgcgtgtaccgcccggacgcggccaccgggatgggcggcgcngcgctcgccctgctgntcgtcggccangcggtggcgggcgtcgccagaccgctgcttctgctgcggcgcccgcgctccgacccggnnggaggccngcgggttgggccctcatgntcttcccctcctcctgggnttggcatttctcanttgcgggaggggatgcctnctggctggggcctggggnanttccgcccnccaa

SEQ ID NO: 93401 - DNA, 290 bp, Triticum aestivum
  unsure (1)..(290): unsure at all n locations
  Clone ID: PAT_TA_93401
ccaaagancangaanggngtttcaagcgaacaaatgcntccgggagttggaaataaacanaaattcggggattcccaaatnggtcaacctttttaactgcctggtnaatccatgngcangnaagagacaacctngggnactgnaacatcttaataaccaaangaaaagaaagcaaaagcgattcccgttgtaaccgccanccaaatgggngcaacctnaaccctnaaaacggggttgtgggngaacaataaaaaccttntnctctnaggnaaagcggtttttgttgcccc

SEQ ID NO: 93402 - DNA, 389 bp, Triticum aestivum
  unsure (1)..(389): unsure at all n locations
  Clone ID: PAT_TA_93402
cgaattccgcacgagaacaaacaaagcccancaaggnaagcaaaancaaaccggngagaaacccccgacatccggngatggnttctcangcgatnnatgagcancggtcgggcgcggatgtgcacacagagctgtgcgaggncanggcccgcgagttcctgntggagctggggctccccgacggggtcctcccgctgccgtccctcctggaggtggggtacaancgcgccacggggttcntgtggntccgccanggncaantccggngggctcacccacaacttcaacgccatcggnaaacangtctggtacncccccnacgtgacggccgttgtggagcgcngccggatgcacaacaattaacggggncaagancaaagaggtgctca

SEQ ID NO: 93403 - DNA, 516 bp, Triticum aestivum
  unsure (1)..(516): unsure at all n locations
  Clone ID: PAT_TA_93403
tgcgtctggagatgcaaagattctactggtggggagcancanaacctcctatgttaaatgactccaagggangnaggtagactggtacgcccatctacaaacaccaaataattttcaatcaccacgagcctcttgtgataaatgaatcttccattannnagaataagtcttaatcccanaaaatcaactcctaaagcagttatgaacgaagagcgaatcttaatcntaacaccgcttcgagacgccgcatcttacttgcccaaatactttgaccttctatctgaattatcatacccacatcatttgntttgatctcggntttcntgtcggngattcgacagatgatactctcgctgttctttccggntgnnctacaacgtatacaanaaaagagcggatacattaaggcgaaccatttcggtagnggccctatcaattggaaaaaaggctttggggactaagaanagcagaaaaacnttnnaagaacggtnacggggttttgcangcggcaaaggg

SEQ ID NO: 93404 - DNA, 513 bp, Triticum aestivum
  unsure (1)..(513): unsure at all n locations
  Clone ID: PAT_TA_93404
atgtatcgaaaccagactcttcaagcgtttgcgccaacgcctcataagctatgtgccaccgcataataatgctacaatcaaccttgatgaggaagtgaaactcacagagtctaagagccgagcgagatctccaggattctctgggcagaggttttcaagtatccttgtaacactagatgagattgaaaaagcgtttttgaaagatgccatcgcagtcagtagttacacggaaatctgcgatcgattattaaagcagtataaagcaattctgaacgatgaagccgtgtctcgagaatttgtcgatctagagacttttaagaatacgtgggagatcgaagttccaagagctacagagagagtccgaattggtctaccaagtacaagttactgcancatncatgaatccaacatcagctagggggaagtaatataaaacngggctctaaatcctgggnaggtacgcaaggacntcaataaacttttctgggatgcgctcaaagttgggnccntttt

SEQ ID NO: 93405 - DNA, 519 bp, Triticum aestivum
  unsure (1)..(519): unsure at all n locations
  Clone ID: PAT_TA_93405
ctcgtgccgaattcggcacgagctcgtgccgattcggcacgagggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaangaatggaaaggaaggatgttatgacgaaaaatgtttcaatctacaaagctcaagcatctgctcttgaagctcaagcagnccccaattgcaagggtctgggttgttgccaacccaacaaacaccaatgctctcatcctgaaggagtttgctccatctatcccctgagaanaaaaacanttgttttganccgcctagaacacaaacaagggcactccggtcagatttctnagng

SEQ ID NO: 93406 - DNA, 509 bp, Triticum aestivum
  unsure (1)..(509): unsure at all n locations
  Clone ID: PAT_TA_93406
cgacgccacacaggtgatcaacgaggtgggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactctgacattgctttgggttttccttctccatttatctttcttgtttgttcctaagaatatgtgtatgtccangttcatgtaccaacatgtctcgaagaaagcatgctcgtatgtgaatgcaatcggtggctatgtatatgcacatgcacataatatatttatacaatcctgtcgactatgtnttcgggtaattaataatgagaaacatcctccgtgccgaattcggcacgagggggggggncccggtacccaaattcgcccctanaagtgagtcgtaatacgcccgctcactnggccgt

SEQ ID NO: 93407 - DNA, 351 bp, Triticum aestivum
  unsure (1)..(351): unsure at all n locations
  Clone ID: PAT_TA_93407
ccgccgccgcaatcgccgcctgnctcgagccgccgtccacaatggngagaaggacctgcgagggtgctatctncanatcaagaacaagccataccccaagtcanggnactgccgtggtgtgcctgaccctaagatcangatctatgatgtcggcatgaacaanaagggtgtcgatgagttctctcactgtgttcaccttgtctcatgggagaaggagaatgtgtccagtgaggctcttnangctgccccgtattgcttgcaacaagtacatgactaatnatgcaangaaangatgccttccacctcaagggtcaggggtcaaccgttccatggtgttcccgtntcaacaaa

SEQ ID NO: 93408 - DNA, 510 bp, Triticum aestivum
  unsure (1)..(510): unsure at all n locations
  Clone ID: PAT_TA_93408
tggtcatttaaatgggcaattaaggcaaaattttctgcaggaatttctctttctacaccgtcaaaatatttaccccaaaatctggtcaaaatcaagatgtttcatatagattgggttgggctctcggtccctttggcatacatatgtgtccttgtaggttccttgattacattctcttcagtatatcgaaggcgtaaagcagctgcatctgcatcgctcgcgccttggtttccacctcacattcaacgtgatatctacctatcgctacttcaccttgaacctgaaaacaaggacggaaaattactcgttgtgcccgacagtcttaaacgtgctgcgctcttgagacgagccttgggagatatccatcgcatcatacaaatccgaaacgcaaagcaggcatgctcttctttgctccaaagaggaagcgtcggtgatgatctttggcagagattcttgcgaaccgagaatgaaatgggaagaagagctangtgatgtantaatanaggcaaa

SEQ ID NO: 93409 - DNA, 523 bp, Triticum aestivum
  unsure (1)..(523): unsure at all n locations
  Clone ID: PAT_TA_93409
tggttgcgactgtgctccctccgtcccctanctcgcctgcttttttctccccctccctccgtcaccgtcccctccctcttcatcacnccccctccctcgtctctctcgccgggccattcctctttgcaaagcgcgtgcgtcggagagagacggagatattcctgctggtggagagagtacgtgcctancancggcaggcagcaggcggcaggagcaaaagaggaaaaagagaaaggtgagggcggtgctggtgctggtgctggcggtgactgcttgcgtcgtttctttcttgccgtgcgcggnggacgccgggatgagaaaccgtgttgcgggatttgtgatcttctttttcgtgcccttgatcccccggtttcaagcggttgccggccggcgatgctgcggaggaatggtgtccngacaaaggggcgggctccgggnggcaacggtnganancccaagcccccgccggtggnggganncctgttcgcccgttcccnggtcntnaaacgngctcgngggccgc

SEQ ID NO: 93410 - DNA, 509 bp, Triticum aestivum
  unsure (1)..(509): unsure at all n locations
  Clone ID: PAT_TA_93410
ctcgtgccgaattcggcacgagctcgcacttcacctgttaccaccacatatattgacccctatttcggcatcttcggctctccctgctgccggagacgcaccgctatcagaagccgtgcagaagctcaacgctttaaacaccctcctatctcaggcatcgtatgctgctttctggtcgacattagatagtgatgatctctacgcggaccttattgtcgacgttgctggcttcgaggaattaattcgaatccgtatcgcactangctgtttcccagaccgttcgtgaaattgatagggcaagtcctcgagtcatgtctcggaattcaaggagattcatttgntgccttcataaatggcgtgtgtggatggcanataaaaggaaatcaagttcatgtncctctaaacaaaaaaaatgaggcaaaagggcacaactggtangagaaaatgtnaatattcaacaattttctanagttatacgaaggggcnacgataagcccagttnnatnctc

SEQ ID NO: 93411 - DNA, 507 bp, Triticum aestivum
  unsure (1)..(507): unsure at all n locations
  Clone ID: PAT_TA_93411
ngtgnctcctcctancaagctatatacctacatagtacaanccatggnccccaccgtgatggcctcgtcggtcaactccgtcgctcctttcnaggggctcaagtccaccgccggcctccccgtcagncgccgntccaacggggctagcctcggcagcgtcagcaacggtggaaggatcaggtgcatgcaggtgtggcccatcgagggcatcaagaagttcgagaccctgtcctacttgccaccgctcanacacggangccctccttaagcaggtcgactaactgatccgctccaagtgggtgncttgcctcgnagttcancaaggttgggttcatcttccgtgaggcacaacgcatcccctgggtactacgatggccggtactggacaangtggaagctgnctatgttcggatncanccgtcgccaacgcanggtgattaaannaggtggtggaggtcaangaaagggtanccctgacgcctatntcngcatcatcggattttnann

SEQ ID NO: 93412 - DNA, 543 bp, Triticum aestivum
  unsure (1)..(543): unsure at all n locations
  Clone ID: PAT_TA_93412
atggttccccgggctgcagccgtgccgaattcggacagcttcgtaccgcctctctccgcgcaaacgagccttccgcccaactcctccccatttcgccagcggngcacccancaancaaccccacccgccgccatgagggagtgcatctcgatccacatcggncaggccggcatccaggtcgggaacgcntgctgggagctctactgcctcgagcatggcattcagcctgatggccaagatgcccggtgacaagaccgttgggggaggtgatgatgctttcaacaccttcttcaacgagactggggctgggaagcacgtcccccgtgctgtcttcgtngatctcgagcccactgtgattgatgaggtgaggactggcgcttaccgccagctcttccaaccctgagcaacttatcagtggcaaagggaggatgcttgccaacaactttcgcccggtgggcattacaccatttggcaagggagaattgttgntcngttncctttancggtatcagganagcnttcaagacaactgcnactggtcct

SEQ ID NO: 93413 - DNA, 531 bp, Triticum aestivum
  unsure (1)..(531): unsure at all n locations
  Clone ID: PAT_TA_93413
ctcgtgccgaattcggnaacagctcgtgccnaattcggcacgagctcgattgcaacatgtgcagtgcgaaaataacacgcaactttaggctgctaaaaaanctggngaaaggcgagaaaggacttggtgttgaaacttgctcttatggccttgttgatggagacgagatgctcatgtcaaattggatgggcactataattggtcctccacgtagtgcacatgagaatcgaatatattccttgaaaatgtattgtggtgatnaatatcctgntaangccacctaccattcaattcgngagccgagttaatctaccttgtgttaaatcaanaggatggaaagggttgatccancaaaactanccctgtttatcaaaactgggnataacaagtangacccatgggagaactgtatttaanctngagctaaagacactncnatgggctcttcccggnaaacaatnaaaattacctcaanccaactcngnagggataagcctatcccgttagaaatttttcactccgtcagctaca

SEQ ID NO: 93414 - DNA, 364 bp, Triticum aestivum
  unsure (1)..(364): unsure at all n locations
  Clone ID: PAT_TA_93414
ctcgtgncgaattcggaacgagcgtctccgcgccaaggggcctcncgcgcatctcactcntctagggttccggcggnccgattcgggccgaatttggacggngccgcggcgggatcggggctcgggaggagccgcgggggagagatgaccgggaangaaagcgcaaggcngaggcggcgcgngctgggacgagacggaccgngtgccacgtacggcgcgttccggggcgcngccanactcgctctcngcaagctctacacgctcgccatggggcggacaagatagctctcctttccaggcncgggcgangcgccacgccatnggaaaaagnctgtattgaagtgggattctttaangaacaagc

SEQ ID NO: 93415 - DNA, 420 bp, Triticum aestivum
  unsure (1)..(420): unsure at all n locations
  Clone ID: PAT_TA_93415
ctcgtgccgaattcggcacgagtattcaaatcaagaaaactccatgttgaattcaaatcatccatcatatcacatcacataacacatctcctaggtttacataacacaacaaaaccatctatggaatacatttccttacacaagaatatagcagaaacggagggaatatacaataagacaattatggcacatctgctacaatcctaataagtacaatcgacttcattgctctctcttatgangacatgctccagctgtgacaactcgccatcctacaatgagaagtatataacaatgggccagactttataggnagtaaacaaggaagttacantgggacanctcgtaatccaattattaggaagtaaacangggaccaaacttcacattacaagttaccaatccacnagggcaaaaaca

SEQ ID NO: 93416 - DNA, 514 bp, Triticum aestivum
  unsure (1)..(514): unsure at all n locations
  Clone ID: PAT_TA_93416
gaaacatgtctttatctccggncatgtgatcggtacatccactatcaagaacccattcctttcctcctgacatatatccccgaagatttgccataagaccaaagtgtctcattgtatcatcaagattgaagtcactatcatcatcctcatcatagtatccatgttcaacatcgtaatgtggnggntcaaatcctaacagagggnaatttgttagagtgagtttgacaatgatcttgcttatgaatttttatagcttcgggaataatatcactaataattccaacatctcctttggcacgcataaggnttgtgagttcaaatagatgatcaccaaacataagatcgctagtattcatcttactcaaagcaatagacttatggggaanttcatctanatttttcaagggaataatttgggaatcggtccccaagnaaattccatataagtgtaggnacactcaaaagnaaggaaaggttataattaaagtttctagggaaggccccaagggntnag

SEQ ID NO: 93417 - DNA, 571 bp, Triticum aestivum
  unsure (1)..(571): unsure at all n locations
  Clone ID: PAT_TA_93417
gacagacagancttgnganagcgcgcgcgaagatggcaagcctccatgatcacctcgccgattgtggcgccgacgagcgtcncctccctctcccgccggggttcctccttcgccgtcgtctgcaagcggtggnaagaaagatcaaggtcgacaagccccttgggacttgggaggcggcttgacagtcgacatcgacgccaacggcaggaaaggtgggcaanaagggcgtgtaccaagttccgttgacaaantacggngccaacgttcnacggcntacaaggcccantctacaacgccagaggnaatggtctggaatctgggtgganccgcctacgccgggcggtaancngaaccggggctctctntatcttgggggcggtcaancctccgccggggctcntcgggnnggcggggngtccctccctcngtcctaanaaacaaccangccgtctctccgccngggnctaaggaagagcatccnacgtggtaaacaacaaggggcccgggggttctcttgcntttgcaatgnncgatctcctgttaatcctaacaataagctnncctccctggt

SEQ ID NO: 93418 - DNA, 503 bp, Triticum aestivum
  unsure (1)..(503): unsure at all n locations
  Clone ID: PAT_TA_93418
gagagaactaagctcaagctttcttcgacgtcactcgatcagtctcgttctctcgaacttttatttacttaattttaagataactaccgaccaagattttgaaggnacttcgatgcgctccccatttgagaacctctacatctaatccgatagtctgaccttgtcgaaagggggtttcttaatctctatattgaagctcacatctatgagcatttaccggaactccacaacgtcaaattagaacgcatcaaggnttcaacacttcatcgacaaaaccgacaaatacaattcgcattaacctcgctcgtcccggatcatcaataccactttatcttaaaatcaactgctgaaaagaagatgttagattcaatccaggaaatctgaatgctaagatgcgagttgtcgacaaatttaccgaanggaagtccgtcgccaaatgcgggttgataatggttgacctacattgnagacatngggatgacaacaatgaagagcntaccttn

SEQ ID NO: 93419 - DNA, 360 bp, Triticum aestivum
  unsure (1)..(360): unsure at all n locations
  Clone ID: PAT_TA_93419
aaactttggagcanccgctcnaacaaggngcacgagccgagttccccacgtctgtctcggtctgttcgctctcacgtcacgcgacaagnccgtgttttttccgtccctcgcgtctgntccccccacctcccctatcatcangcggggctaacgagtaacggngcggacaggggttgcgtgacactaccggnactgcagcaancacgggagccatggngcgggaggaggaaagacccccaatgatggncgccgcggagcgaacgcctccgngtggnctccgcgcacctctagccgcaaggcggggccaacnccgggnctcnccggtnaacccaccgccgggggagtacnncccaccntgca

SEQ ID NO: 93420 - DNA, 525 bp, Triticum aestivum
  unsure (1)..(525): unsure at all n locations
  Clone ID: PAT_TA_93420
aattctaccaacgcaacgcacgaagtgaagtgagagctttgcacgaaaagttcatcancgaccatgaagggnaacaagctcccggggatnctcatcctccaagccgtcctgntcatgggaagtcctctcacacgtgaacgccgactatttccccaagtgctgcaacaactgcaggtccttctccggggtcgacgtctgcgacgacgcccaccccaagtgccccaagggctgctcggcgtgcccgcgtggtgtcgacnaaccccgaaatgtggcgctgcgcngatatnaaatccaacgtcgacggnaactgcngtggggcctgcaagaagtactgatcggctcatgccancatgatatgttccccctaaaaaatgaaataaaaagntcaaaacgaaaatgangcaancgtnatccgtggcctatgcgtggtgtggtgtgggcaacaaatatttnttacaantatgcccgtgttctcntccctgtgttttctcctcnccnaaaaaaaanntggtggttgcttgtttg

SEQ ID NO: 93421 - DNA, 467 bp, Triticum aestivum
  unsure (1)..(467): unsure at all n locations
  Clone ID: PAT_TA_93421
ggtcctgagtctgggtgaancgctaanccgggcgggaacgaacgggcttcttaatctggggcgtcaacctcnccgggctcctcggggggggggtnctcctcgtctanaaaaacaacggctctccccggntaananaagatctacgtgttacanangggcgggtcccctgctttcatgcacgtctctggtaatcctgccgtaactacctcctgtgaatgtatgcaatcaacgatgcaaaagtaaattgattccgnacanatggggttatggtgtatgtacgtaacgcctgttaacnatataacttcctactttggggaaactggttaaaagggngggnttccttgggagncccgtnatgcaacgcaaccctcctacctaangtatgttnggaacggggccctgaactccctatcaacaaaanttgccgggggaaagggttaaagggccaatgggnttaagaacgcaaa

SEQ ID NO: 93422 - DNA, 515 bp, Triticum aestivum
  unsure (1)..(515): unsure at all n locations
  Clone ID: PAT_TA_93422
gntttttttctctntgaagaggaggagtaagagatctaaacagtcagatcaaccatcatacactgagatgaagagcttctcatatgctgatctaaccaaagcgacaaatggtttctctccacacaatttggttggctcaggggcttacggatccgtatacaagggtgtacttgagtctgaaacaaatggaatgattgctgtcaaagttttcaagcttgaccaacttggagcaccaaaaagctttgttgccgagtgtgaggccttcagaaacactcgtcatcataatcttgtaagggtgatttctgcatgctcaacatgggacaacaaagggaatgatttcaaggctcttattaatgaatttatggctaacggcaccctacagagctgggtttattcaaaaacaaaaaagaccgttgagtttgggctccagagtaaacaatagcaatgggncatagctgctgcantgggttatttacataacaagttgcgtncccccctatagtccactgtgaatt

SEQ ID NO: 93423 - DNA, 437 bp, Triticum aestivum
  unsure (1)..(437): unsure at all n locations
  Clone ID: PAT_TA_93423
ctcgtgccgaattcggnacgagcccaaatcgacatgccgcgccctcgcgcanatcgcccgaccggagctttatcgcctcctcgcaacaacctcctcgccttctcgcanatcgccctctctccctcccctgcctctcanttctttctttttttcctttgggcatgcagggagcaaccacagggatnctcgccgctgctgccaccacccggacatcgtcgcgccgccgcctcctccgagttcgccggncgctggngctcgtcctcccctgcaacctctgcctcgccatgcaggaggacaatgatgaanagcgcgcccgccatcgaancgttgccggggncgtccttctcgccncgcatggggtggggggggccgttcttctcgccctcnctcgngtgggccgaaactgcgcggcggggaaaancgggccctttcccggg

SEQ ID NO: 93424 - DNA, 469 bp, Triticum aestivum
  unsure (1)..(469): unsure at all n locations
  Clone ID: PAT_TA_93424
ctcgtgccgaattcggcacgagactaactctgtcatgattccaagaaatagtttgagacacgtacaaaagagctttagatcatattattttccaacgggaactaaacggcaattttcgaagtctttgggctggctgacacaatcttcacatcaaacttccaagtatgaaaaaaaaacacattttggctttgagactgtcaccgaggcagagaaagaagacagagtgggcggagtattcagcagcgttgcggcctcgtatgatacaatgaacgactttatgtcacttggcatccaccgcttatggaaagatcacttcgtccgttcaatcaacccanggtttttcatcaaaaacgcccgccactgccaaggtccatgttagacattgccggngggacgggtgatatcgccctcccgtctaccaagtcattgcggatagaatcaaccaatccttccgaatccntgcataact

SEQ ID NO: 93425 - DNA, 530 bp, Triticum aestivum
  unsure (1)..(530): unsure at all n locations
  Clone ID: PAT_TA_93425
gtcccccgctcctcctcccccttccccaantttttcccttcgncanggntcgntcgctcgttcgcancgccgcccgattgattgattgattgattgtggncgcaagaanatcctcgatntcttcctcgccatgcctccgttccangantgccgcgatggnggtctgcttgtcctggacccngnagcggntatgttcggcggcgtgcggcannggaagcgcgcgcgcgtcaanngacgtccccccctgcgtcttctccgccgcgggggaggagggngctcaaaggcggtgccgggcgggcaaagaggnaaangctgagggaggggncgaacctcnaacncggctcccggacggggtggctcttcnagatncttcgccgcgtgcaangggggcccgccgcgcggggggcctcctccctgcgtctcccgcccgctggggtcccgcttgcnccggggggaatccnncnccctccccagattaaaacgggnccaannccccnggccgngccgggncctcaaanaaagncctnctt

SEQ ID NO: 93426 - DNA, 535 bp, Triticum aestivum
  unsure (1)..(535): unsure at all n locations
  Clone ID: PAT_TA_93426
atttgagattgtttttgtttcnccaactggngaggnaattaaaaacaaaaggnagctgnacaactntctgaaggcaaaccctgggaggncccacttcatccgagtttgnctggtcnactggggagaccccnaggcgttctgctcngnttagcgagaaagtgaaggtatttgatanccctcacggtgaaaagataccaaagcgcantangaactcaagtggcaagaaggggaagcaaganaaaaagggngatcctgaaactgaagaaagacaaaagaaagctgnagcngggcaaaggagggccccnaactgaagatgctgnaaaagagcactgaatgtgggngattaccggntgctgaaggcgattgaatgcctgcaaaagancacttgaatgttggnggatnnaaancctgcccnnagggcngaaatgattgcctgccaaaaaaanccccaacattgtnggagnattgaaaatttcctncaaaaaggtgnaancctgctccctaattgnagatnccanggaanncctgcanancn

SEQ ID NO: 93427 - DNA, 516 bp, Triticum aestivum
  unsure (1)..(516): unsure at all n locations
  Clone ID: PAT_TA_93427
ctcgtgccgaattcggcacgagattgattgcattcctgaattctctgcattgcagaactgttgggtatacaatgtgtaaatataatacatggaggggataaatgtggcatgtcgatgcatgcttgtgttagttttgttgccttatacatcatttctaaagtcaggaaatatctgacaaaaacctatgtttcatttatatacacttgtcatgaatcagccatggtgtcgccttcagtcgccgggcgcagttctggnttctgttcttgttccggactcctggtcaagaaagtanaatccccacacacaaaaaaaggggcaaaggatcaagaaagttagataatggnacatagntggggttctgagagatctctcataagccatgagggttcccatttaaaccctgacatgaaggagntgaggaccttgttaaataatatactcctanctgctaagacagtgatntgagatgcagtnaaagaaagngtggttacatcccaaaaaccaatttgggctggg

SEQ ID NO: 93428 - DNA, 543 bp, Triticum aestivum
  unsure (1)..(543): unsure at all n locations
  Clone ID: PAT_TA_93428
ctcgtgccgaattcggcacgagataacaaagctcatcttcttctccttgaaatctttttgggtccacanatttggaggatgtcttgcaactgcggatcangctgcanctgcggctcaaactgcaagtgcgggaagatgtaccctgatctgacggagcanggcagcgccgccgccgaggtcgccgccgtggtcgtcctcggcgtggcgcctgagaacaaggcgggacagttcgaggtggccgccgggcantccggcgagggctgcagctgcggcgacaactgcaagtgcaacccctgcaactgttaagctgcatgcactcgtacgtantacgtgtgatggtgtgaagaagtatacgtgaataaccaacgtcctgatntgatggagtccaacaaatgtgcngtgtgtgtgtgggttanttgctcgctctcccgtctaatgctctggccccttgctgtccctgtgtgtaaggtgtaatgcaatggtgtccccggtaaattgcttcaatccaancccccaaccaatgggatgggggtggnggaatnt

SEQ ID NO: 93429 - DNA, 521 bp, Triticum aestivum
  unsure (1)..(521): unsure at all n locations
  Clone ID: PAT_TA_93429
tttcaagctgtcaacgtcccacaactacaagtgataaataacccagaatatcaacatgcatctgatgtacactctcgacgccagcggcaagcgtatctacacgctcaacaaaattgtctcaggcgaggtaagtaagagtgcgcatccagctcgcttctcgccggacgacaaatactcaaggcaccgtgttacgctcaagaaaagatatggattgttaataacacagccaaaggatatacgaatactaggccagtagtggaattttgaaaatagattacaaacaaagtttaagagaccttggtatcagcgcaaaaagaacacgaaaaattattcccacacgaacaattgaacaaactacggcggatacattggnattgctttcacaaagcaattttcttataaatgataccagtaccgttcactaaatgagtagtcatgggcagaatccttgggccaacgtgatgcctatcccgaagctgttgacccagaggaccatacttgggaaacatcntcattaattc

SEQ ID NO: 93430 - DNA, 489 bp, Triticum aestivum
  unsure (1)..(489): unsure at all n locations
  Clone ID: PAT_TA_93430
agacgagatgaagatctccatggcagcagccgctcccctcctcctggccctcgcagccacggncggcgcggtcacgttcgacgtgacgaacgaggcggcgagcacggccggcggtcagcgattcgaccgggagtacggcgccgcctacgccaagcaagtgctctccgatgcttcctcgttcacctggggcatcttcaaccagccggacccctccgaccgcaggcccgccgatggcgacaccgtgaccctcgccgtccgcgacacggacgggatcgcctccaccaagcggcaagcaccatccagctcancgcccgctccgttgggggtattaccggcgacaacctcaangagcaagtggacggggtgctgtttcacnaggtggcgcacgtatggcantgggggctgcaggagtacggcgcgcactcggggatttccagggtatcgcggactaacntgcgggtcaagggccggtacgtnncggcgaactgg

SEQ ID NO: 93431 - DNA, 542 bp, Triticum aestivum
  unsure (1)..(542): unsure at all n locations
  Clone ID: PAT_TA_93431
aaccgatcaacaacgngcctcttcctcctcccgctcaaccaaccatggggaaggntatgatgggtggaagcaacaactcctgctccccgcgccgagcgctcctcaagcccgcgggctcctccagctccgcgccgccgcccaaggcgcaagcctcggtccttcctcaagcagctcccggggctcgccgcgaaggnggntgcggngggcgtcgcctccgtgcctctcccggncctgggcgtggagatggagaaagnggngctgttcgacttcaaactgacgctcccggngatnangatngagttcctgctgctgatgggtggggctgggacaanctctacttctcccccgctgggcaaantcatggacgaacgggaacgccaaanattcgcgccggagctccgggcgggngtcaaaggacncctccnaaggaaggtgcggnaancttggganggaagcaaggccaaaggcaaatttcaaaaggngggngcgccgcgggaaatttccggcggnggctcaaacaaagattnaanaaaggggaccgg

SEQ ID NO: 93432 - DNA, 578 bp, Triticum aestivum
  unsure (1)..(578): unsure at all n locations
  Clone ID: PAT_TA_93432
gtccaanntcccccaacaagtctcccntcactgggagaaaaatcnaactttcaattcantattcntccgcnggaacactaacaacnaagggaaacaaaaagttatgtncgcccttaccaacatcaaagggggtgggaagaagatattccaaccttgtctgcaaaaaagccgacgtcngacttngacaaaganaagctgggagaagctcacatccgaaagaactttgagcggggtcgttnacaatttatncaaaaacccaaccaagtataaagatncccttcaagggttcttaaccgacaaacgagacattattgacggggaaagaactaacaagttcntgggctaacggtgtccgnactcaaaaactacgtgaagattttgggaacgncctaaaagaagattccgtgcccaatccgaaggtctgccgacaattactgggggaactcccngggttccgtgggtcaacaattccaangacccanacgaagggnggaggaagaactggttgggtgtntccaaaaaaaaanagggnggggtaaagtacaccggtttttggaanttatnggtttggggatacn

SEQ ID NO: 93433 - DNA, 466 bp, Triticum aestivum
  unsure (1)..(466): unsure at all n locations
  Clone ID: PAT_TA_93433
ttttacaaattgagctttgtgcgccctgagacttcanttgaatgcagctgttactaaaaacacaagtcaacnatggaagatgccgtggaccaccacttgttggtgttctctggtatagtttgagtagcctgagcaccaactccacttgggaaggagacacctaagatcaaatttcgcgtggggaaattttaatggatgatggaagcatgtctggataacttaaggatttttgagacgttcccctggggggggtattcaccgggatggggggtgacttggggccaaagaaaaaagctancacaacttagtaagtgggaacttgcaaatgaaatccggagggaatgagtgctcctccctttaacgtttgaatcancctaatcctggtacaattccnttggataattggnggtcaaaagcctaagaataagcctgcaataacgcaaatccaaaaatcctggaaggaaaa

SEQ ID NO: 93434 - DNA, 194 bp, Triticum aestivum
  unsure (1)..(194): unsure at all n locations
  Clone ID: PAT_TA_93434
ctcgtgccgaantcggcacgagctcgtnccgaattcggcacgagcggcacgacggngtgggcccncgtaaccaattgccggcatnntcaagtttttatatgangaaccacggggcgatnagttnacaantcgtcaaganatgtngaacaaantctgtangtntacccacctataaccaatcnttgntagccaca

SEQ ID NO: 93435 - DNA, 226 bp, Triticum aestivum
  unsure (1)..(226): unsure at all n locations
  Clone ID: PAT_TA_93435
ctcgtgccgaattcggnacgagtcccaactcgatatgccgcgccctcgtcgcanatcgnccgaccgggagntttattcgnctcctcgaaaaaccctcctcngccttctcgcacatcgtncctctctccctcccctgcctncncaggttctttctttttttccttttggggcatggaggggaagcacccacaagggaatcttcngncggctggntgccaccaanacg

SEQ ID NO: 93436 - DNA, 545 bp, Triticum aestivum
  unsure (1)..(545): unsure at all n locations
  Clone ID: PAT_TA_93436
nttttttttttttttatggaaagctgctctgtttgtcccaatcgcaagcggncatatgaggtattcaaactgttctacagattatgcaacacagggagcaagtgtgcgagaacaatataaaccctatcaactcaagagcactttcggtggnaattcaaggncggntgtgctcccttcaaagcatctcgacnactctagtcattgttggncgatttgcaagaacttaactgaaatgcaccacaacccaaacactatcaacttcctcacaacctccgtgatctctccgttaatcccagaaagcactggagacaatattcatncaagtgttcaaaaatccactgcgggaaagtaatggctgctagaatcantatttgggactgatgttcttgtcccctgccccaaccatctcaaagaaccatcattccatagctgtacacatcaaaacttgctgncntactgctccnaatttgcttcnaaataaacctccgggggaaataaanccctaatggtcctccctgcaccaaccaaaangggggaatgacacc

SEQ ID NO: 93437 - DNA, 514 bp, Triticum aestivum
  unsure (1)..(514): unsure at all n locations
  Clone ID: PAT_TA_93437
cgagnttttttttttttttttttctccccccgtcnccgtgaccaagcaaaaggtcttggagacatgccncaaagggtgggccctgcacgcgccccaagctgggatcagggaacgggttagcaatgnaagntacgcnccatcccgggcaangnccgccnccccccgccgttgtctcgccgtccccataaaaatcacgctctggtggnggcacggaggncgtctcgcttcntctgcaagtgcaagaactcggtctacnaagtgattgtgggctggcganaaaaaantgggataacatgngtgatcancgttgcgaaggccnccggtgctgttggacttctnggngccgttatgttgggacnntncccgatggattnccccctgtgttnngggcgaacnggggaaaagggcnacgtggggaagataaagtgctgnaaagtnaaanaaaggncngatggnccnaacanccnaaccnaccnncgggaanccggggcaatcccnacngtggctcaatgtt

SEQ ID NO: 93438 - DNA, 542 bp, Triticum aestivum
  unsure (1)..(542): unsure at all n locations
  Clone ID: PAT_TA_93438
cagctgctggggaggcctctgcagtcctccatctccaggtcgtcttcctcccggaagtcccccttcgtcgtcagggcatcgtccaacccccctgccaagcaaaatgacaacaggcaactgtggttcgcgtccaancagtccctcacctacctcnacggnacgctgcccggtgactttggtttcgaccccttggggctgtccgacccggagggcaacggcgggttcatcgaacccaagtggtggnctacggcgagatttcaacggccggacggcgaatgatgggggtggtgggcatgatcgcccccgggaggccctgggcaangtgggncctggtgccccccgggagaacggggaatcccgtggttccaaggcaaggcgccgattcccgccgggcgggcaacctaaccaantactgggggccgacccaataaaacgctcttccgtgtttcgaagaatgggggctcaatcgggtttcgccggancaancgggcgggctccaaaggactgggtacaaaccccgggctccaatggggaaaacaatt

SEQ ID NO: 93439 - DNA, 530 bp, Triticum aestivum
  unsure (1)..(530): unsure at all n locations
  Clone ID: PAT_TA_93439
gcctcctcctagcaagctatatacctacatagtacagccatggcccccaccgtgatggnctcgtcggncacctccgtcgctcctttccaggggctcaagtccaccgccggcctccccgtcaagccgccgctccaacggcgctaagcctcggcagcgtcagcaacggtggaaggatcaggtgcatgcaggtgtggcccatcgagggcatcaagaagttcgagaccctgtcttatctgccaacgctcagcacggaggccctcctcaagcaggtcgactacctgatccgctccaagtgggtgccttgcctcgagttcagcaaggttgggttcatcttccgtgaagcacaacgcatctcctgggtactacgatggncggtatttggacaatgtggaaagctgccctatgttccgggtncactgacgccnacacaaggtgatnaaacganggtggaggaggtcaagaaaggagtaaccttgacgccntatgtccgccatcatcngatttcgacaaaaatgcnttcaaggtgggag

SEQ ID NO: 93440 - DNA, 538 bp, Triticum aestivum
  unsure (1)..(538): unsure at all n locations
  Clone ID: PAT_TA_93440
ntccgtggcgaattcggcangagtnagagctcantgctacctacattactggnattaaagccagaagcgacaaaagaaataaaaaggaacaataaatgcctgagttacagtgccctgcgctgcatctctatcttccaagcacatcccctcccgagttggnaaccatctcagcgtgttcacctcacaccctgttcattcttcggcagactgtaacatctacctgtagttaagaattgggaaaacttctgccatcccttgtcctgaataatctccttgactccaggcgggggcaatttctcacagcttctncaacatancaaancaggtgggcactctgaaaaantcaaggccttttctcttgggcgcaaaatgcatttcaaatattcaagttccgtggnttgaaacgtncntggtagtccggggtaagtcctcnggggggcagttccttgcctcaattagacggnggatacgccaatctgggaagaagccagtttaanatggctngtttgcaagcgcantgaaagaagntctagatttt

SEQ ID NO: 93441 - DNA, 519 bp, Triticum aestivum
  unsure (1)..(519): unsure at all n locations
  Clone ID: PAT_TA_93441
ggacacatcacctaatttaaaggagctgcagcggcactttccataaagaccttttagagaccttgtagcacaccaaaatttttacacttacacatcccactaccacctatcaacattttatcaaacgaaccaaaggagggagtgggcgatggnacaaaccccacaacagcgcaaacgcaacgaaaagtttagcaaacttcagaatgccaaacgagggaaagcaaacatagaggtcaagccaaagcaagaattcaagagcccactcagtcctctatgggcaggtttgttatcctttgtggtgtttggtgggcttgttgtttgaattaatcaaccgtatatttatccattaagagctattttttccaaattcgaagccaagagtaaaggcatgtcttcgcaaaatgaaaccactgggagntgggggcttgaanccctatattggacactggccgtttgagaaagcaaagaacgccacggggcaaggcctggacacaatctcaaagccttgaaagaggttgg

SEQ ID NO: 93442 - DNA, 540 bp, Triticum aestivum
  unsure (1)..(540): unsure at all n locations
  Clone ID: PAT_TA_93442
ggctgcaggctcgtgccgcttccgaattgatgacaccaagtgaatcctcaatataagtatcccgcactgcttgagaacacccaagctattcagtaacgcaaaccaaaatctttttgtggtacctttaaagaaactacaggtctattcgtattggtggaaggcccgggtctcancgcgtagtcatagacgatcaaggcagccttgtgggtgttgtgatgaatgcaaaaaatggagctggtgtgaagcccacctatgaaaagtgtactcctttcctgaaatacgacaaattaagtcctgagctcaatgtggacaatagatataagatttctgggtttgcatgcggctcgaattttctgagcacagaaatccagaatgaaatgaaatgcaaatgtagtggactcaaaaatctatctccgactaacaaaaggggtttttcaagtttcttganccaaatggtaatacatgggcaaaaaataaattatggnataaaacacgtcacaaaaaaaggattataattctcaagcaaatataccaagcagn

SEQ ID NO: 93443 - DNA, 535 bp, Triticum aestivum
  unsure (1)..(535): unsure at all n locations
  Clone ID: PAT_TA_93443
agaggncatggagattccgtggattctttacctgctcttgagttaaagctatctaaaagacggntcgctcaagttccgggattactgttgcctcctttaaccggcggcgcaatcggatacgttggttacgactgcatcaggtattttgagccgaaaacaagcgaaaccgatgaaagacattttgaaagttcctgagtctctcntcatgttttttgacacgataagtggcgtttgaccgactgacggaacagatgaaggttataacctaccttcatgttcccgaagacctatcgatgttgccaagatgcatacaaatctgcccaaagaaataattgactctgtgggcaaaactttgattgctccccgggaaaggtactaccnggtacaagactccaaccgtnctttgggcatcaagtatacatccaacaatccggncaaggnaaggatatgagcaagcaagttcaaacntttaaaaaaaaacaaattgttcaggggagaatataantcaaagcaatttccatnctcaacngcaacg

SEQ ID NO: 93444 - DNA, 538 bp, Triticum aestivum
  unsure (1)..(538): unsure at all n locations
  Clone ID: PAT_TA_93444
ctcntgccgaattcggcacgaagctcctttccccaacccagaccangagcgccctctctcccccgccccctccccccaggaaaccanccatgaagggggccaaatccaanggcgccgccaaggccgacgccaagttggcggtgaagagcaagggggcggagaanccggccgccaaggggaaaaagggcaangccggcaaggaccccaacaagcccaagagggggccatccgccttcttcgtcttcatgggcgagttccgcgaggagttcaagcagaagaaccccaagaacaagtccgtcnccgccgtcngcaaaacgggcggtgaaangtggaaaagcttgngcnaatcccgaaaaaggcccctatgtggncaaggggcaacaaagctcaagggnggagtaaaacaaagggcattgntgctacaaaaaanggcgaaaagcgcttttgctnctgccccaaaaaaaggtgcggncanagaaggtanangaggaaaattaggagggaatctgncaaattcaaatccngggatttaatnaan

SEQ ID NO: 93445 - DNA, 532 bp, Triticum aestivum
  unsure (1)..(532): unsure at all n locations
  Clone ID: PAT_TA_93445
aaatccagcgcagcccgtacaacttgcgtttcaatgtcggtcgacgtcacaaaatctgtgcactctctagttctggactcaggaccaattattaagaatgaaacctccgcctctacacttttaagtcttgctgaaaccctctacactataccaagcagtgatagaagaaattcgtgacgcagttacccgagcccgggttgagagtttgctgcttccatttcttactattcgctctcctcgtcctgccagcataaagactattcatgaatttgcgcgaaaaaccggcgatctcgaggtacttaagtcgaacagatatacatctccgtagctctcgcatacgagctcgaatgcgagagaaatcatggcgattggcgtttacgaaagcatancaagggcaaaaaagantaaatggntctccaacagctagcctcaatgggagtcctcaacaacctatcactaagtacttcaaaaaataccttgtccggagaccggataagtcaaantaagnccccaagancgcaaactggtgacn

SEQ ID NO: 93446 - DNA, 303 bp, Triticum aestivum
  unsure (1)..(303): unsure at all n locations
  Clone ID: PAT_TA_93446
ccgaaacgtctctctgtatcaaattcatcactgcagctcaccttcttgtacgccgtaatttgtcgtggtccgagttctggaatgcacggaatgatatactttctccatctgctcttcctcttatttcctgactttctgataacaaataatcacataatcatcataacaacatttaatattcagagccggtttctgaaaaaatatcaccagcctcactacangttaagaagccgatttcttctganccaaaagaggagcttgtnncgcatctngcatgattcgcacgtggaaggagcatctttt

SEQ ID NO: 93447 - DNA, 367 bp, Triticum aestivum
  unsure (1)..(367): unsure at all n locations
  Clone ID: PAT_TA_93447
aagctatatacctacatagtacagccatggcccccaccgtgatggcctgtcggccacctccgtcgctcctttccaggggctcaagtccaccgccggcctccccgtcagccgccgctccaacggcgctagcctcggcagcgtcagcaacggtggaagganaggtgcatgcaggtgtggcccatcgagggcatcaagaagttcgagaccctgtcttacctgccancgtcanacgtgcccccaagagcacactatcgtcangtggtgcttgctcagtcacaagtggtnatctccgtganaaaccactcctgggtatacattgcggnttggcantnggagtgctatgttggtgactgacncacaatgtata

SEQ ID NO: 93448 - DNA, 387 bp, Triticum aestivum
  unsure (1)..(387): unsure at all n locations
  Clone ID: PAT_TA_93448
tttttttttaggacattcatgaacatgaatgtggtgtgttctatacattaatataagatattttataagcaaactcttatttgatgaaagtattccatagattcatcatgcggnaaaaaatcaaatcctctttggctgagattagattacagataagtcgccaatttttccttgtagccaggtaccgaccagcgcccttttgcgattatacggtggntttttcttcaagcagncngcgggtctcgcaactggaatctaaatggctgctcccaatatttgagggctctcaanccgganccgagatancgcggcctggancgtagcgtccttatggctgagttcaangctcatggatttaactgncgcgacaggcgtngtagangntaa

SEQ ID NO: 93449 - DNA, 293 bp, Triticum aestivum
  unsure (1)..(293): unsure at all n locations
  Clone ID: PAT_TA_93449
ctcgtgccgaattcggcacgagctcgtgccgaattcggcacgaggagagaactagtctcgantttttttttttttttttaaaagnaacatatcnagcactgtntagattacttgagaagaaatatattaaaaagatgggcaagagagntcntctccncccaagttagcanaacaagtntttctggntccgattacacnangggcacannaanatttcncgtgnttgncaaacttaaaccgtacccaatcatagccaacatgngngaaaacagtntaatnacgntaanccatta

SEQ ID NO: 93450 - DNA, 324 bp, Triticum aestivum
  unsure (1)..(324): unsure at all n locations
  Clone ID: PAT_TA_93450
ctcgtgccgaattcggcacgagctggtgccgaattcggcacgagaagaagctcaagccaatcaaagcctctccatctccgaagctccaaccgaaccgaggatgtcttgctgggaggaaactgcggctgcggcaccgcctgcaagtgcggcaacggctgcggcggtgcaacatgtacccggaggccgaggccgccggcgccaccctcctcgtctccccaccgccacccanatgagtnggggaggnatgggcgaaatgtgtgggtgaccagtgattgngacantgnggttgctctgtgantgtaatatgatatcatatgatgaccg

SEQ ID NO: 93451 - DNA, 378 bp, Triticum aestivum
  unsure (1)..(378): unsure at all n locations
  Clone ID: PAT_TA_93451
ctcgtgccgaattcggcacgagtcaataaccatttatctcgaatttcatcttgaggaacgacatagcattccaaaaacatatatctgtggtaaattcgtaacaacccgcaaacagaaagactaaagccaacctgagaaaaaccattcattatgagctccccatttagtatcacggtggtgcctgtgttgctatgtcggggaaagactgcgtcgctatagcgtgtgatctccgcctagctancttacattcaaattcccaatattaataggacggtctgggcaaggcacgatgngtacacgttctgtatttggnacaantacatgntcggtcggaggagggaattcgctcgacaatggtaatctgttctcgcacccacn

SEQ ID NO: 93452 - DNA, 296 bp, Triticum aestivum
  unsure (1)..(296): unsure at all n locations
  Clone ID: PAT_TA_93452
ttctcttcctagcagctcaggcggncatttccttcggaccagcgtcaaccactgagcaatccatccatcacacacacagcgacagagaaagaagacgggagaggacagaggagtgagaaaagctagcaatggtgagggctccttgctgcgagaagacaaggctcaagangggcccgtggacggtggaggaggacatgaccctggtgggtacatcgagcaacacgnaacantgggggtgcnacagcngcgtggctcgcaantgcgctcgnngtaatacttnccgcacatngggattt

SEQ ID NO: 93453 - DNA, 315 bp, Triticum aestivum
  unsure (1)..(315): unsure at all n locations
  Clone ID: PAT_TA_93453
agctgtgctgataaggtctaaccagatgctgcagagcaagtcagagttcctatctctgaggtcgggctggaaccgacatacattgctcatcgtccggcattgctcactacagcctggaagtccgactcagaccccggcactacgtcgtaaagtttctcaagaaagcggattgctggatcgcggccgggactattatagagcagtcatgatcagtgagaaagaattggggagnaagcccaangagtgacaaccttgctgaatatcacacttgaagggaatgctcanttcatatttnataacaaacgggtatagatg

SEQ ID NO: 93454 - DNA, 374 bp, Triticum aestivum
  unsure (1)..(374): unsure at all n locations
  Clone ID: PAT_TA_93454
gagaccgtgagggtaaagggagcttcgttgaatttgagacggccgcagtcttaagctagcagttgaaaagctcgacggacgtgaatttaaaggagtcgctgtaactgcgtcgccgacactcaacctgatataccccgtgatcgtgcccgatcgcgattccaaggatatcgtcgctcttatccagctgacgattacgaacgccgtgcactaatcgaggatacagcggcggagctatcggtaaaggtnccgcgggtacatnanatnacgaacgtaggcgtccctcacggtcgtgccantganatacctcacacgccgtggngtncnttgaaaacgtacgtctgatatctctgacctntntancggcggaatcaagg

SEQ ID NO: 93455 - DNA, 502 bp, Triticum aestivum
  unsure (1)..(502): unsure at all n locations
  Clone ID: PAT_TA_93455
cgcggnnggcggacggctcctaagaaactaagtgggattcccccgggggcttgcaaaggctccgtngcccgaaattcgggcaacgaagcaaaggangcgaaagacnggccccgcccgcccgggcgggaatccgaaacgcggggggggggccccctctaacgccctcctgagggcctgaagccaatcgggggcgtgccccaaacgaagctttcgccgcccccgcgccgcggaaagccgaccaantggaatcaactggatnaccttgataanaccaanaatnaagggggggggaaaaaggtaaaaaattttaagggggncctaaaataantccctgaatgngtaantaaaaggggctanctnntacgattncggatttnncgnaattgggtcattntcgggaacncattttctcncgatgtttaatgggattnaaaaatntttggncaatntggtgtntttgggaatcataacataaanntnctccccgggggtggggangggc

SEQ ID NO: 93456 - DNA, 219 bp, Triticum aestivum
  unsure (1)..(219): unsure at all n locations
  Clone ID: PAT_TA_93456
tgagcatcctggccgacggcgaggagcaggcgaggcggctcctcgcgagctgccgccggccgacgacgaggggcagctgctcgggcggggaccggcggccagtgctgccggggcgtggcggagcaactgctgtgcacgttcangaaggccatcccgtcgctaaggccatcgaggcggccggcggggactcnccgcggtcanccaccagggcgccggtgc

SEQ ID NO: 93457 - DNA, 237 bp, Triticum aestivum
  unsure (1)..(237): unsure at all n locations
  Clone ID: PAT_TA_93457
ctgagctccatccggcacgtgaacgtggtgaagctgctgtgagcgtgacgagcgaggacggcgcggcgagcctgctggtgtacgagcacctccccaacgcagcctctacgagcggctgcacggnccgaccgccaggaanctgggcgggctcgctggccggagcggtacgangtggccgtgggcgccgcccgggggctggatncctccaccacggttnggncggtcatcncacgtact

SEQ ID NO: 93458 - DNA, 322 bp, Triticum aestivum
  unsure (1)..(322): unsure at all n locations
  Clone ID: PAT_TA_93458
agtaaagagtaccaaatgtcttatattagaagaataagatgcttaagagtctaaacatcataaagtacaggattacagttaactaccatacatgaactagcagctgagctacactgctacggtctagaggactaaacctggatgtcgacgaattctggtcctgaacatctgaccatgcagcatgcccaggcctaaacctaattttacaacctactccaagcacatggtggtcttaagtcaaggagtgtccacnaagcaagccactttctcacagtacgtgtctaacgcttgcgagacatcacacagatgcatgcngcgacaa

SEQ ID NO: 93459 - DNA, 313 bp, Triticum aestivum
  unsure (1)..(313): unsure at all n locations
  Clone ID: PAT_TA_93459
ctcgtgccgaattcggcacgagccaacccattcctcctactacctcggcacaaccagcccaacagaactagcgagcagagccatggcgcccaacggagacaacaccgtggncaacgtcacaagcggcatcgacagcaccaacaagacgctgctcaagagcgacgccctctaccttacatcctcgacaccaccgtgttcccccgcgagcacgaagtgcatgcgcacctgcgcctcaanacgcagaccatgggtncatgatcncccggcagggactgngggtgtgtanatngngcgcaaaaacatnangtggggt

SEQ ID NO: 93460 - DNA, 378 bp, Triticum aestivum
  unsure (1)..(378): unsure at all n locations
  Clone ID: PAT_TA_93460
ctcgtgccgaattcggcacgagattccattccgggaggaaatggcgaagcgtcacttaaaancagcggagacttgggtaaaattatatttatggaatacgatttacgaaacacaaaacacttgaagaaagcgtgcgacactctgatgtagtatataatttggttgggagaagtaccccacaaaaaatttcgacctcnaagacgtgcacgttgaaggngtggacgaatagcagaanagtgaaaatgngcaagttatcatgcctctaatgaaattaccaaactgattctccttanaggcggggagggtgcntatntnttcggaactnantgtcggcagccctcnttngtttntgtgattctcacaaccncagggtnnaan

SEQ ID NO: 93461 - DNA, 329 bp, Triticum aestivum
  unsure (1)..(329): unsure at all n locations
  Clone ID: PAT_TA_93461
gggggtcctcccctggtcaacggggaagaaaaagcaagatgggctacataatgggncangccggnancacctgttnntccctgggncggggaacatcccngaccaagtgatncgcgccatgagccnggagaacnaagactancgctcgccggggattnccggcctcaccaaanaacctgctggnggacgtgaagaanattttcaangaacanaacgggacccccttnntttccaantggacnggctggaagggtnacaaanncttcncgggganggtntttctctcctgggattanctgtttggttacaacanangctctgtttatttt

SEQ ID NO: 93462 - DNA, 477 bp, Triticum aestivum
  unsure (1)..(477): unsure at all n locations
  Clone ID: PAT_TA_93462
ctcgtgccgaattcggcacgagcattaatgctggtaataccaaatattgtgtattgatcgataattagaagttaaattcgtagcgatgaataccatcaagtcattttgggttggatggggagctctatgtgtcgctggtggaggtgcatattactttgctaaaaagtcaatcaatgccgaaaaaatggaaagattcgaagcaagaacaaaagcgtaaacgtcttcaaaattcctttggcaactcaccgtcaaggactgctctattcgatggtaattccaagtcaaaaaccctcaatcgatcctgctctccaagggtcaagatacaaccactgggtcagaaagatgctgaggaaaccaagcaaaataagagcccaaacatcaagtttcgttcaataaaaaggngacaggttcaagtttgataaatgtttatttgcaagtattcaatatggtagcaaataaaaccgccattattcatcn

SEQ ID NO: 93463 - DNA, 512 bp, Triticum aestivum
  unsure (1)..(512): unsure at all n locations
  Clone ID: PAT_TA_93463
gcaaggaattcnggcaacaaaaagaaagggtcnacancgagcgaagcgancnagcgaaaaaaataaagaaaaaaggcgcccgcggggatntccgtgccttggtccngcggtaaantcntcngggcgggggcgatnganaacgggccngcgggcaacatgggggggncgctgagtgacgtgccngcgatgctcnacggngaacggtancaactggtccgcaanatccgggtccggnaacttcngtgtcgccccgcctcatcgcaaacgcgcctccggggagctcgtnnctgttaagtncatcnaccgcggggagaaagatttatgagaaacngcangaggagagattatnaaccaaaaggtccgcctgngggaatcccaaaaaattaatcccgctttaaaggaggggttatttctggacgcccgaaagcattctccgcccaatncgtcaatgggnggtaacgcccctcccggggggggggaagcttctttcnaagcggcaatcttgcaacntn

SEQ ID NO: 93464 - DNA, 351 bp, Triticum aestivum
  unsure (1)..(351): unsure at all n locations
  Clone ID: PAT_TA_93464
agaccggctttcctcggtgatgccgactcgtcgtgcagggagaagggtggttggtctgtggtcgattgtggcttgttggagagggatccggtcatctcttaggagggagttggcgtcgtccccggatctgaagcaggagcggctcggggagcatcctcacagggggatcgcctccgaccgatatacttatgggatttagatccaggtcttctgaactggtactgngggtcgcaccattgganggncctccaagctgtggagcgtgctccgngcatgtctcatgtgtaacggccntcntanactnatgatcctgatnncttgatacctttgntgggttattnttcgtnaang

SEQ ID NO: 93465 - DNA, 457 bp, Triticum aestivum
  unsure (1)..(457): unsure at all n locations
  Clone ID: PAT_TA_93465
ctcgtgccgaattcggcacgagctacaatctcatctaattcgcaactcccgcttattcgtgccttataatctatactcattactaccaacatcatgaagactatgcaaaccgctgtctggggtgctctagccgctctcgtcgtagctgttacagcccagacgggtgacaatcttcctgaatgcggtaggcgttgtatagacaatatgcataagaaagctacggaactcggatgtgccgatggcgacgccgtatgcctgtgcaagaacgcaaacttcgcatatggcatccgggattgttcgacagatgtatgtggcgctgaagcaacggtacctgtgattgcatatgctgttacctgtaattcggctggcgctggaggttccggatctggttcancaaccgggtcgggtactaactccaagcctggaatgtcccacacaggttcttcaaattctacan

SEQ ID NO: 93466 - DNA, 367 bp, Triticum aestivum
  unsure (1)..(367): unsure at all n locations
  Clone ID: PAT_TA_93466
acagtgcatttcaagccttctttgccggcagacttcagtgctgtcgttattggtccaagttcacactcattccagtccggacttttattttgcagctctcaatcttcaaacagattacgttcatcatctgagaaactttgttgatccgagtcaaaagattctttctacttggcaactttttcgaaatgaggcttctaccactagctccttcattgcattcatagcactgatcgggctgcggaaaaatttgcaccaacnaattacatgcaatcantattatggaaacatcctgtntaggataagaanggcagacttcacttctataacagctactatctcattttgaatagttatgnggggcaatnna

SEQ ID NO: 93467 - DNA, 339 bp, Triticum aestivum
  unsure (1)..(339): unsure at all n locations
  Clone ID: PAT_TA_93467
atcaagtcctttagaacgatatcccctataagacgatatttttcacagcccgattacatcgtcttaacagaggtttgacagtaatatctaatcctacccctaataggcacctgagcatcatcatcactagtccatcatgtctgtatgcagattgtacttcgctgttggactggatccagacntatacaagtataagtctgcgtacacatttattctttatggaccttaagcnactatanaaaatggtaatatctggaattgacntggtgnntactatgtnctgnaattttctggnggtgnanaagttatagantctgtntgatttactctggnatgnat

SEQ ID NO: 93468 - DNA, 334 bp, Triticum aestivum
  unsure (1)..(334): unsure at all n locations
  Clone ID: PAT_TA_93468
ccanctctcaaangctcgctcgaatcatcanctancancctcgaatcatcaccatggggtctgccggccgccgtcccacngtgntcaagcaaatngctctcttcttcgtcgtcgngggggncatcaagaanagatccntctgccttggagccgccgccggggacnccantgcaaggtctggtgctttcgancctaancgccctgctgtcccgtctacnggtggngctgggaaaacctacacngggcgtcggtgnctccctaaatancgctgcnanccaccggntggnggggcaaccctnagtaagaantaagatgnacccgcccgcgccgagaa

SEQ ID NO: 93469 - DNA, 475 bp, Triticum aestivum
  unsure (1)..(475): unsure at all n locations
  Clone ID: PAT_TA_93469
gctacacagtggggncgctccatctcacggtccgcaacaacgtaccggaggagagccccctcgctggcatcggatncaacctgtggaaggagcaggacgtgccccttcggtggntcgacggncggccgccacgctccgtggggtacgtaaattttggtagcatcacggtgatgtccaaggagcatttgttggagttcgcgtgggggntggccaatacaggctacgccttcctgtgnaacgtacgggctgacctcntcaagggtgacgacgaaaccgcacttccancggagttctctgnggggatagaggggngcaacatgctctcgacgtggtgcccgcaagagaaagtgntanagcacgaagctgtnngagtattcctcacgcactccggnatgggantcaatcactccgaagggaatcngncggaggngttcccgatggtgtgttgggccntccttccctggaggcaaanaaa

SEQ ID NO: 93470 - DNA, 682 bp, Triticum aestivum
  unsure (1)..(682): unsure at all n locations
  Clone ID: PAT_TA_93470
ggatctccacggcggnggggggncgctcctaanaactatgggttcccccngcttgcaaaggctcctggccgaatttcggcaacgaagggcaaaagccaagcttagccaacgggccttacaacaattacgcaagctnagcttttagttgcaaggcaacaataacaattaggtagaaaaccaatttnagaacaagcgaagccaaggggaagttaatgggaagaacgccccaaagctggggccggtttttgctccgcccctaanccaattggggggggnccggcccaatgggttaaaccctttttcccaaagccccaagaaactccgccctcaanggaacttaccttctccggccctcaacaaacgcccggccccgcgcccgcccgttcgggcggtggggccgcgggtgaagcttgggagcaacgaaagcttgcaagggggtttcgccccaagaagcttacgnccaaacccaagaaggatnnaacgaactggcaaagctccaagcaactccgggggcggggnccctacgggggaagaaacaatctttctggggcgggtcgggcccgggcggcgggactggaaaaggcgggcgggaccgcggttgaaagcctgttgggtggggncgaanaaagaaaggactaacgaacttacgggggtccaaacaaccntggggcgggggcggggg

SEQ ID NO: 93471 - DNA, 464 bp, Triticum aestivum
  unsure (1)..(464): unsure at all n locations
  Clone ID: PAT_TA_93471
gaaagaacttggagatgaaggngaggtcaaagcaaagggtaaagtcttaaccaaggggaaggattacgtcgtcgaggacggngatatactactaattaaggntggcgctgcgaaaggataatattaagcaactccaaaagagaaataaaaaattattgccttctccagagatattctaacgtaatccacaacaacaaagtatttatcggtactactctcgccacttgaaaacataaataccttgctcacggtattaaatagctagtagatgagtcactaccaggaagccgacgctttcaaacccgcgaaagccgtcgattaactcctcctttgaagctttgggaattttatccgataaaagagaacgcanccgggncttttttcaatatgaaacttgatgaaacactgtatgtccccccgaggttttattattccnntcaacccccagaaatanggacaacaaa

SEQ ID NO: 93472 - DNA, 476 bp, Triticum aestivum
  unsure (1)..(476): unsure at all n locations
  Clone ID: PAT_TA_93472
ctcgtgccgaattcggcacgaggcatctccgtcgagcaccatggccgcccttctcctcccagtcccctcccgcctccccaagaccacgagcacgcccgtcgcctccgccggcgccgctccccgcttcctctccttccccctcacaacatgccgccgccgccgccgccgcgagggatgcatcctcgcctcctcctctccgacgccgccctccccggccgcggcccancctttccgctccctgcccccctccgagaccaccgtcctcgtcaccggcgccacgggctacatcggccgcttcgtcgtccgcgagctgctccgccgcggccaccgagtcgtcgccgtcgcccgcccgcgcagcggcgtccgcgggcaagaactcccccgacgaaggtcgtctccgacctctccccngcccggcgtcgtcttctccngancgttaaacgaacccnggncgccctcctnggcgggacctctcc

SEQ ID NO: 93473 - DNA, 369 bp, Triticum aestivum
  Clone ID: PAT_TA_93473
gagagagaactagtggtggatactttgaattagtaggctttgatccaagaggttcaacaagaaatatacaagtttgtttccattggattatgtgctccagttgtggctcaatgtctggtggaattaatggtgaacccaccacgagaaggttcacctagctacgaattgtatcggcaagaatacgatggaatatttaacaagtcttaagacgcgagcctttgccctttatgaagctttcaaggaaatggagggtgtcgagtgtgatgaacctcagggctccatgtatctctttcccacaataaagttatcaagtaaagccgtcgaagctgcaaagaaagaaggtcgttctcccgatgaatactatgcttt

SEQ ID NO: 93474 - DNA, 478 bp, Triticum aestivum
  unsure (1)..(478): unsure at all n locations
  Clone ID: PAT_TA_93474
gtgccgaattcgggcacgaggatatttgnacaatgtctgnagttggnatcacaaagaaacaactacaaagcatcgaacctaacatatctccaagatgatttaaatattagtcttgaagttctttaccaaaaactacaggatctcgagctaattgagcaaaaagtattcggttgcgtggataattcacatggncgtacgttcttacagaaccttgngacacaaaatgatgataccgatggncaaaaagcctctcaaactaaantcttccgataccttgcttcacaaanctggggcgtgagaagattagatttctaaaaaatatgatcgacaatatagacaccttgcgtggnatggattcncgacaaagactaagattatcggccagatcgcatatttagacaactaaatattcctggatcntcccggaggaggctactttattcnaaatctgcggaaagaaggtacaanggggnggaga

SEQ ID NO: 93475 - DNA, 284 bp, Triticum aestivum
  unsure (1)..(284): unsure at all n locations
  Clone ID: PAT_TA_93475
agacgactcgtcccggattgtgattcgcggaggngtttcccggcgcccanatgagctcanggatgggcggatnggtcctcctccgccgcgccggggccggggccaagacgcctcttcgccancancccgtctccggggggcanggccgtcctcngtggaggtgagggcgcgtgggtgcggctgatgtccacctccgcgggctcncangtcaaggacgaggcggncaangcggtcaangcggaggcggccaangcggtcaangcggaggcggccaangggggaag

SEQ ID NO: 93476 - DNA, 297 bp, Triticum aestivum
  unsure (1)..(297): unsure at all n locations
  Clone ID: PAT_TA_93476
ctcgtgccgaattcggcacgaggggtttttttttttttttttttttttttttttttttttttttttttttttttttttttttttttttttttttttttttttttttttcccccccaaaaancttgaaagggttnggggnaaaccttnccccancttatttattttaattttanaagccaagcnccaaacccncaaaanaannagaaanttntttttcancggccacnaaagnaanccacggntttacttcgatnccgnngaaaantttgaagcccccnatcttanccccctttgngc

SEQ ID NO: 93477 - DNA, 488 bp, Triticum aestivum
  unsure (1)..(488): unsure at all n locations
  Clone ID: PAT_TA_93477
aattgccttctaactnacaaaaaagctctcttcttgctcttcgctatcctgnccgttgtcctctccctcttggnttgatncggncttcnccggncangaattgcgccggggncgcccatgggttaactgcangngagccggatggcggggtcntccggctgccanataagangagctgcctgttgtgtaacttanctataaatggggcgattgatttgctggcttcttngggggggggaggaaaaaaaaaataacccagggttttgtggcagctctcaaaggacagaganaanncgggggggngttaattttcggggggcgcacaacaanggggttcccaanacaatttntnaggggctcaaatcngggaancatgggcctganggntccccccgcgccaaanngcccaaaaaaangggntgtcaaccgcggagnattcgggggtccccnagggtttccccgggttaaatttanctcccggnggccnc

SEQ ID NO: 93478 - DNA, 237 bp, Triticum aestivum
  unsure (1)..(237): unsure at all n locations
  Clone ID: PAT_TA_93478
gcgggctcatcgggtccgggaanctcnccttctgggccaccancancaaacaagggcgaccgctacaaaaaagtcagcctccccnccgncgncgacgncaacgccaagccctacnggaacgccaacgggctntatngtgncaagcccaacaaagccaccaacaaagggttcgggntcaaaaaaatggntgccggcggngggggntantgnaacttnaacnggggnaaccacggggtg

SEQ ID NO: 93479 - DNA, 454 bp, Triticum aestivum
  unsure (1)..(454): unsure at all n locations
  Clone ID: PAT_TA_93479
cgaaaacatttcaaaatgtccaaatcaaagccttcaagaaaagatgaatctacagatccaaatatggactctcgattcaaggctctggaaacggatccccggtttcgcctcccttcaaagaaacaaactcgaactaagcttgataagcgcttctctcgcatgctcacagattctgacttccacaactctactacagcagatagatatggaagacgcttgaaaaaaggggggaaaaaaaaggcattggngcgcctctatcttcctgaggatgctaatgaagacgaaacacagacagaaagcaagggncgtagcaataatcttgacactaagaacgatgaaatcaagtagcgctagaaaatcaattgaagggtccgagaacgaatcaaatgatatcaaaggaaggagttacaaagttttcaccggntggtgatactgacactacagatgcggttca

SEQ ID NO: 93480 - DNA, 466 bp, Triticum aestivum
  unsure (1)..(466): unsure at all n locations
  Clone ID: PAT_TA_93480
ctcgtgccgaattcggcacgagctcctagcaagctatatacctacatagtacagccatggnccccaccgtgatgggctcgtcgggcacctccgtcgctcctttccaggggctcaagtccaccgccgggctccccgtcagccgccgctccaacggggctagcctcggcagcgtcagcaacggtggaaggatcaggtgcatgcaggtgtggcccancnagggcatcaanaagttcgagaccctgtcctacttgncancgctcancacggnggncctccttaagcaggtcgactacctgatccgctccaagtgggtgccttgcctcgagttcancaagggtgggttcancttccgtgagnanaacgcancccctgggtactannaagggcggnnctggacaatgnggnanctgcctatgtttggntgcaacgacnccacgcnngtggtnaaccanggggggggagggnn

SEQ ID NO: 93481 - DNA, 451 bp, Triticum aestivum
  unsure (1)..(451): unsure at all n locations
  Clone ID: PAT_TA_93481
ctcggggattgggtttcttgatcatatgttacatgcgctggcgaagcatgctggttggagtttagctcttcactgcaagggagatcttcacatcgatgatcatcatacagcaagaagatgtctgtctagcattaggagaagcattcaatgtggcactaggaaccaagatgggcatcgcacgatttggaagtgcttatgcgccacttgatgaagctctctcacgcgccgtcgtggatatttccaatagaccctactgcgtttccgaattgaagcttcaacgtgaaaagattggngacttgagtactgaaatgattccacattgtatgcanagttttgcgcaaaacgctnggnttacattacacgtacattgtctccatggngacaacgatcatcaanaagcaaaatntgcgtttaagggcctagcaaatagctttacggggcaannaaacaa

SEQ ID NO: 93482 - DNA, 241 bp, Triticum aestivum
  unsure (1)..(241): unsure at all n locations
  Clone ID: PAT_TA_93482
agagnatagggatgntcatttnaatncaaagatttagacagggtngcaagcacaaagcctgaacattnaacacgagggggacatcacaagaacacacactcnggcaggnacacatcgggggaaacacacctcngnttatttcncgacnaacgagcgccanaaactaanatnatgggttcatcaancgcancgancttctggncgggncgggctcnccnacanggcagtccaccanggcttc

SEQ ID NO: 93483 - DNA, 454 bp, Triticum aestivum
  unsure (1)..(454): unsure at all n locations
  Clone ID: PAT_TA_93483
ngtggtgccgagcatgaggccgccgccgtgcgtggacgcgcggggcgcgcaggggcacgagtgcgtgccggcgagcggcgggcagctggcgctgctgtacgtggcgctgtacctcatcgcggncggcgcggggggcctcaaggcgaacgtgtcggggttcgggtcggaccaagttcgacggccggaacccgcgggaggagcgcgccatggtcttcttcttcaaccgcttctacttctgcatcagcctcgggtccctgttcgcggtcaccgtgctggtgtacgtgcaggacaacgtcggacggggctggggctacnggcgtgtcggcccgccgccatggccctcggcgtcctcgtgctccgtggcggggacgtccaantaccggtaccgggcggccggcggggagccccgctcaagggtcatcgggtaaggggngcctgtggaccgncttggaaa

SEQ ID NO: 93484 - DNA, 640 bp, Triticum aestivum
  unsure (1)..(640): unsure at all n locations
  Clone ID: PAT_TA_93484
aaaatctgcagctccacggcggtgggccggccctcctaaantaaggggattcccccggctngcaaggtgggngccgaattnnggaacanggccggggaaacaattatntnaacaacnggnaacaataactggtcccccccccggangggggactcntggcgggnaataacaaanaaaggtgggggtgggggtggactccacgggcaacggggtgggcccgcgtccctctggcgaaaaaagggggaacggggngtggttnaancaatctgggaagctaacaaancccgcccggggnaaaataacagtgngggggnaanaagccccaataantaaaggataatngcaatgcaatntccntgcaatgtttcggtttacaaaaaaacgntataaanttttcnattnaaagaaataaaaaagcccgggggatttacanntccgtggataaaagaatgntgggaaacttttntgcaaaggaggatatttcanagggggattgttgttagtttaccccntcaaaagnnaaggtttgggaccnaancanaattgttgagggncccctgncgtaattgcanaaggggtttattnaaattgngggaaatanaaaggttttntttattcaaanggggngagaaggntttga

SEQ ID NO: 93485 - DNA, 469 bp, Triticum aestivum
  unsure (1)..(469): unsure at all n locations
  Clone ID: PAT_TA_93485
ctcgtgccgaattcggcacgaagcagctcaaagcctcgtatacaagagctagttaaaagcgatcgtattattaattgagcttactagcaagtagcactagcacagcactaagcttgatggagcangtgacgaagctagcggggcaacgggcggtggtgatcttcggcatgagctcctgctgcatgtgccacacggtgacgaagcctcctccgcgatctcggggtgaacccgatggtggtcgaactggacgaggaccctagggggaangagatggggaaggngctggtgcggctcctcggccggaaacctgctgtgccngcggtgttcaannnggggcggntcgtcgggatgcaccgacaangncaagtcccttcaactcgggggggaaacttgtcccactggnttcgnaatgctggtgcnggtatggggtgtaangcgtgggaagggttttgttgtanaaattcccgcc

SEQ ID NO: 93486 - DNA, 455 bp, Triticum aestivum
  unsure (1)..(455): unsure at all n locations
  Clone ID: PAT_TA_93486
ctcgtgccgaattcggcacgagcagcaatctcattgtcagataagattttttcaatgcctgttacacacatgccacttcaaactgctgcaccagataattatgacgataaatgacctttactacctgcaaggatgataatgaatttgatatctttcaaatttttacttgccctgatcatcttgatatttcanatcttttacatcgaaaactgatacagtgtcacagaatgtataaagagaatatcaagatctggatgggtcgggatcaataactgtgttgtgccacaaggagagtaaatctaaccatgtacatggaagtctctaagtcccaagtttgctaagccattccnaggacttaatccccgtggncacacanagtgagattgataaatttctccaagaaaaacccgaattaaaaactgaggcantaaaagctatattatcacctccnaccc

SEQ ID NO: 93487 - DNA, 544 bp, Triticum aestivum
  unsure (1)..(544): unsure at all n locations
  Clone ID: PAT_TA_93487
tcccccggctgcangnattccgcacgagcaaacanattccttctcctgccccgggctcctgcannatctgaagctcnccttccccgcgcgtctgcagggnactacatgaagtgacctaaaacacatggaaggggatacgttccaagaagaggtcaaatgcctcntggaggngaagcacaaaaacgtcgcacantttctacgatattgtgccgncacacaaagganagtggntgactttnnnggaagatttgtnntggnagatgcacnacgtcanttcctctgttttaagtatcgacgcaaagatacatacantggagttgnatggggagagcactatgaaataatcaangaaattgcnagggtttatggnaccttcaccntaatcatattgttcacntggncctaaaanctgataanatattgttggntgataatatgggancgaaaataactgactttggtctctcaaagtaccttcgtgtccgggttatcatttcaaaataatgatgaacatccngtttttngnaacanaaatctaccgngg

SEQ ID NO: 93488 - DNA, 587 bp, Triticum aestivum
  unsure (1)..(587): unsure at all n locations
  Clone ID: PAT_TA_93488
cccaaattccgnaccaacttcaattgctggtaanaactgaaaaagggggccgccggtacaagncntggcaacccancaacanccttgggggggcgntcaaatgacangnaaccccnancnaagattcaattggntccaacantgntggnaacttacttggnaaggggtgcgaattttcccnaccaaangaacangnaatgctttaattggnaggggcaattggatgatcaatgataatncaacgaagttccttgaatttctgaaaacctgattccgggttgnngattcccctttaatgantgcaaaaatgaagggggattgggccaaagggttcctttaaaatcaaaagcaagaaatttgatttcaatgggagtantccctgggngcaaaattatccntgaaaagggactgggacgtgggagtaatggggctaaacaattcccgggagggnctcntttgagtaaaggatgaatgccggaggctacnaaangggttaatgggctgaantaatggtgaangggtgtgggtgggatgccnctggggaanaanaaagtgggatcggctgggagtcaagaanaatacaaaaa

SEQ ID NO: 93489 - DNA, 527 bp, Triticum aestivum
  unsure (1)..(527): unsure at all n locations
  Clone ID: PAT_TA_93489
aactaatccgtttcantgatggnttaaactacaaaaacattgctggnctggataatctgaactttgnccacttcaatgaagaagtatgcaagaatatccatgcttcaaccgtcagtgctctagctgatatggnccaagctcntgtgagtatgtatgttgatttacangctaagggtcttgtatcacgccaaggngtttacaagcattatgttcttggcatgttggcatctttaaaaggncgcaatgaagcacgatcaaacagcacagattgtgaaaagttactaacagttctttgtgaaattgagttgaactaagataagttgcaagggagtatatccaaactcctcctggcacanatatttcaaacatcattggggaggnattacacactatgtttcccttgcaacttagcaaagaaagccaaccacaagaancttcatgggnagggaactctctgtatgctgaataacgccttgggattaaaacntgttgaccgacataacaaggnaagccaactggatgctnnc

SEQ ID NO: 93490 - DNA, 546 bp, Triticum aestivum
  unsure (1)..(546): unsure at all n locations
  Clone ID: PAT_TA_93490
cggnaagaagctcctaacaaagctntataacctncatagtacaaccatgggccccaacgtgatgggctccgtcgggcanctccgtcgctcctttccanggggtcaagtccancgccgggctccccgtcaagccgccgctccaacggggctaagctccgcancgtcaacaacggtggnaggatcaggtgcaatgcangtgtggnccattgagggcatcaaaaagttcgagaccctgtcctacttnccaccgctcaacacggggggcctcctcaaacaagtcgactacctgattcgctccaagtggggtgccttgcctccgagttcancaagggtgggttcatcctccgtgagcaaaacgcaaccccctgggtaatatgattggccggtactgggacaaatgtggnaactgcctaatgttcggggtggaaccgaccgccacaacaaatgatnaaccaaggtgggagggaggtcaanaaaggagtaaccctgacgccgtatttcccaatcaaccnggnttcgacaacaatgcgccaaggtgcantnggg

SEQ ID NO: 93491 - DNA, 543 bp, Triticum aestivum
  unsure (1)..(543): unsure at all n locations
  Clone ID: PAT_TA_93491
aacccgcgttccaagccaacgaccaaaatgggaaggtntctncaanccccgggcaacctgatgccggncaanattggggggcgggcctcctccgcgcgancgtcgtcgcangtccgcccgggggttcggggtcnaagctggggccangattancttgctccctggcaagtccgacatcaaagggaggtccgcaaagcaaagttgcgcccgacgccngccaaaaaatgggcggggttttgnccctcgccaacctctgggncctccctcgtctcccgggngncgaaacgcgggaaggggggcgccccaaanaaggnttgaacctttcnaccgagaattcaaaaagcaaaagaacctaaaatttgggagggtgaaagggtaaccggggaaaccgccnaaaaccaaatgggcccgaaccaatcgaaccggggggggggttcgaaactnccctttccccctttnnaaangggcccggnaaaggttacccnaaaaaatnaaaagaaagtttcttggccttgggagggcccaaccttccttttaaacngg

SEQ ID NO: 93492 - DNA, 499 bp, Triticum aestivum
  unsure (1)..(499): unsure at all n locations
  Clone ID: PAT_TA_93492
acggatngngaaccccgggtnaacngggcccgtggcgtttagggaattnccaagtgaaaatccacgggaactnncggggganggcgattncgccgcaacccaacgtnaanatttnatgncnccccaancccaactnacccatgttcgtncgcaacnggaaaggggtgntggggccgggcaaccccnaggganaatnacaacaattgnttaaaggaattaagttgggcaacaacaacaaaggganaaggaggggttacccncccttnnccaattggtgaaanaaggcaaccggggaaaggcaatcaaagcaactccctccggccaatcccaaccttgttgcgtctggtgccgttanaaaccaaaaactaactggaacaattcgttgcttttggacggganancaanggaacgttgggnaacngggttnaaggtgngtngcgcattggtggaanaaaaatctaacttcaactttcaacgncctcaaacggggaanaantan

SEQ ID NO: 93493 - DNA, 519 bp, Triticum aestivum
  unsure (1)..(519): unsure at all n locations
  Clone ID: PAT_TA_93493
gacgagccgattccactccttcagcaacatcaatcgtgcgccggagctgagagatgaagcggcgggccaccatggacccccaccangagcagcaggcggnaagctacaanatccatgtgaagatgctgaaaacagttgccattgatgtgagctgcaccgatacagttgatcatattaaatctaaagttagtgccattgaggggattgacaaatgctcgcaagagctattcttttctgggattcacttgaagaangatgacaaagcttgctgattacaacatcatggcaaactcttctgtcgaccttttcgtcacagacgggatgcaaattactgtcaagattccctcggttgggaaagaccatcaatctcaatgtcaggaaatccaacaaggggggtgatgtcaaagcacacattgaacaaaaagtgggaantctaatgaacaaccaaatcctgatgtttgcaagtccacagcttgangacaatcaactgttaagtcantgtgaccttgangaatgagc

SEQ ID NO: 93494 - DNA, 207 bp, Triticum aestivum
  unsure (1)..(207): unsure at all n locations
  Clone ID: PAT_TA_93494
tgggaaggtaggcgtgctccctcccaactcttctcttctcntgncntctcntccctcccccaaggaggtcaaagacacagcgcatctgcatccggnctcctccgcgcgcgcgaattctggatggaaaaaggnccttncnggggcangttcnttaangatttnaatntcgcaacaacaagggacgantggantctcncatngccgcaa

SEQ ID NO: 93495 - DNA, 497 bp, Triticum aestivum
  unsure (1)..(497): unsure at all n locations
  Clone ID: PAT_TA_93495
ttttgatggggcaaaccatngggtccatgaccgggctgtnncaaggngtncgtntcccaagcccggccggcangcncgccaacaagttnancgtgagggcgtcntcngcggaggccgangncgccggccgccgcgcggtccttgggctcatgggcaacggagtcgtcnggagcgcgttcgctcangtggtgcangccggnaacgtcncggncatcaangttgggcccccgccgccgctctccggtggattccccggaacggacaactcggacnaggnaagggaattcgacctgcccctgaannacggttttacctgcaagcgctgccaacgtgcggaagcggnggtgccnggccaaangagtcggcccangaaatcctcaanctcanagccgctcaacnnacaaaaagcaatgggcgttantcatgaaaagacctccgcctcaagggcctcctaacttgcgctacgaanctcaagaaccgtcatttcctccaaagaa

SEQ ID NO: 93496 - DNA, 652 bp, Triticum aestivum
  unsure (1)..(652): unsure at all n locations
  Clone ID: PAT_TA_93496
aaaattcctcccnaaaaaaaccaaagggngtcaacaaaaanctgggtaatcgnccgccccncccgtcggggngggnggtggaaacctnancccanctttnatataatggaagaaaaacccgnnggtggtctggaaagaccttcctaaaaaggggggccatccgaagaatggcctggtaacgttcaactggagcaacgcaaaaaaagggaaaactngtcaacaatnctcctcngatggttgtttaatggcanttggaaaaaagaacaaagggnccgcacaactaataattgggtttccnggaggggctaaaaactcccaancttaacaaccaacctggttaaatccaatnacnaactggattcacganaaaatacttccaanagagggatggccaaagttantttttcaaggcgtcaacggggaacaanaaccggattncccgtccntcccaagtcataaaattttacaaacaaaaatggctcctccggggttacaaaaggctggcggttaaantcaatttttcccttgttaaacgttccgctangatatcacatatttggnggngggaagganctancctaaacgatttagacaagttttatcctggaaacaacnanacaagcaaagagggnttaataanaacntttatggg

SEQ ID NO: 93497 - DNA, 535 bp, Triticum aestivum
  unsure (1)..(535): unsure at all n locations
  Clone ID: PAT_TA_93497
agtgatttctccntctattcatattcatctcaccgctaccagtctggnaccaatatccagttgcaaaccccaaatataatcaacagttctcatcttcaaaatactcaacatgaaaagctcagctctcgttttctttgcagctctgctaagccattcgatgcctatccttgctttaacacattataactgtngagaaacctatattactgtggnatcagtaaagagaagagttaaagaaagatataataatttgntagaacgaggtttcgtgcctaagtcaacacgaagaagggactgagtttggtcgaacggnctacaagttatccttctatgtcagggcaaaatgatagactccgaagtcacgatatcatttgataaaaatcaaagggtcctttccgtcgacggggttgaatccgggccaaagaattaaattgtcccgggaggtccaaattgacaantgatnttgactcaaaaatnaataacgggtatttttcaaaaactaacaaaacaaaagttggggncctttggggccgnn

SEQ ID NO: 93498 - DNA, 523 bp, Triticum aestivum
  unsure (1)..(523): unsure at all n locations
  Clone ID: PAT_TA_93498
ccgtgatcctgctggcgaaggnggngagcatgaacaacnggcaacgctacggccgggggtggatggacggcgactgctacgtcnccangaacggcgtgttcggcggcgccgccgccctggtcgtcgtcacggggctcctcatcctcggnctcaccttcgtcaccaaaaccgcggcggccggctcgagcacgacggggtgcgccagacgaaacgccgcctgcacaactaccatccgtgtcgacgcggcaacangcgcgagcccgggacaaccgggcgggcgatncaagcaatgatcggtgctggcatcggcaaatcgatcggacacgaagggcgggccgggcaaccggtggagaagtccatgacacncttcgctgttcgtcccgcaaaaggcaagccgagtgggaacatcttcctctcttttggtccccgggtggggcatcttggtaaggcttggaaaactgaanaaaaggcgattctccgggaagtactgctggtgggnttggatgggaagggacacaataca

SEQ ID NO: 93499 - DNA, 552 bp, Triticum aestivum
  unsure (1)..(552): unsure at all n locations
  Clone ID: PAT_TA_93499
gttacttgcttttaaaantcctaattccaaggaaagggcantcctatgctcctacaatggtcaatcaagtnaccctttgtgcattgagctcntcaaaacgtaatatcactaaatccctaancccattgtncagtaatctcntcaaaactgtgcactaagctcttcacaacttatttcgggtagatgtcatgtggggccaacacttctggtgcaggaacanggagggtcccaaatctgcttaaganataggctttatctttagtttgcttgcatatcaaagttaagttaattatttccaaaaaataaagattgtgttagttggaaagttaagttgaagtttgtgtcaaccggccctatatataaagggacctangcctantttgtggacaccanagaatcaataaaagaaagaaaagaggaggcgtggctccgattcccaaaacctaaaccccctgcgnccacgggggcacaaggatctgcatggctacactccccaaaagcccggggncggtgacaaaaactaaagtttattttatcctgggacaaaacaat

SEQ ID NO: 93500 - DNA, 212 bp, Triticum aestivum
  unsure (1)..(212): unsure at all n locations
  Clone ID: PAT_TA_93500
ttgttgttgtctcaccccagcaaggggggaacaccatccngggngggaaaaaatggggatggggtcctccaacgggggtgaggaggtgcanacaccgtgggggtggcgancctgctggngncttnttccaanaccggncgctccggggtgccgttntgcgnctannacaacancnccgggngcgncaacangttcgccgagtggttcccccg

SEQ ID NO: 93501 - DNA, 523 bp, Triticum aestivum
  unsure (1)..(523): unsure at all n locations
  Clone ID: PAT_TA_93501
acgggtgaataagatncagtggnaacttaacaatggnatangntacgatctgttgtacgtgttgcctaagagaataaggnaagaaacanaaaagacgcacttaatgcgcgtcnccaaaacctgtgtgctcnccttctgtgtctcncgtgcgttcgtgttcttcntgtccaccaaatcgcgtgcgtttgagtgatncaagggctgaattccctgacaggntcnccgtcatcgctcgtggngaanctcctcaacgccggnacgatnaccttgttgtntaggagcanccaagtcatgacgcanatnacctccaaggagggcancgacccgcgggcaacggcaacgacaaggatggtcaattccatggngctgncctgctgcacgaacgtggtgttcaacctgcnaaaaaaggcggatgacatgattnacgctngtgattcaacaccgggcaacaagccggggggagggttcttgagctcctcccanctgagtcaacnggtgcacaaacttccaccaaggncncntg

SEQ ID NO: 93502 - DNA, 588 bp, Triticum aestivum
  unsure (1)..(588): unsure at all n locations
  Clone ID: PAT_TA_93502
nggntctctccccttctccctcgaggtcgaggaatttaatccgggtctccgtcccggcctggttcattggaggggaagcccgaacaggggaaggngggctgcacaaacaaggaagtctcaggtgatcatctctaatcaattatcatggntgaacacatgggacgacgggacggtcggcggnctcctcttcaacaaaggggggatncatccttctcttcagggaaggacaagctccccgccgcaaaggncgggcgcttgctggctcnncncaatgggctgcaaacgggcaccccgngcattcggcaagaacaaaagngncngggccaatgcacaagccacaaggggaaacaagcttcaancaagcanccaagggaaagcancaacaaaccccccgggaggtcacaacctgtcaaggaaaaacctccacaanggggaaaacaagcaatccaagcaanggggcctgtttgccgaaaaccgacaaccgggaaccgggaaaaaggcgggcgggctccccggtngccggggcggtgacctgctgggcgccccctcaanggacaanggttgaacgccgtccaaaggaaaccggtn

SEQ ID NO: 93503 - DNA, 648 bp, Triticum aestivum
  unsure (1)..(648): unsure at all n locations
  Clone ID: PAT_TA_93503
ggaacaactggtcttcnaaaanaaaaaggaaggnttcctggttgnaganggtggtaccaattnanaaaatttcaagccggncaccccgttaccgggtnaaaacaagcaatggtcaatatcaataaaactnacaagatggagtngacaaagcccccaagangaaacagnttccaacaagcaaaacangcaanaaaacaagtggcgaaaaaaanttcaatccgcccccctgggtccgaagncctaacaaagcttggttggtggacaacaatntccaaggtggcgcaagcaacgcctccaacaaatggcctttcgccttccttgggnaagaagaaaattggtgggggcgattctcaagcaacaagtaatgtccctggttggtggcatcaataaagcaagctccaagcctccggggggaacaattggtggggccaaacaaaaacntcccttggaaccnttgttccgggnaanggtaaatggccttgggtccttccttggtcaagnaaaccaataagcccaaaatggttggggcaatcaaaaggtacaatcccccnttggaaccttttctccctggacaacngggnaatcaaataacccctttgggcctggccgccaaagctgggtccntggangggcggatggttaccnggg

SEQ ID NO: 93504 - DNA, 515 bp, Triticum aestivum
  unsure (1)..(515): unsure at all n locations
  Clone ID: PAT_TA_93504
ctccttcagatggtctgcttttggggtcatatattttgttgtctggtgttgcttgtatcccaatagtggcactccatttccctcatgcccagtcagcaaagagagtcctggtgcttgttgtggccacagggcttcttttcgttattatgcagcctcctgttaaactgtcatgggtataccggtcggagctgatcagagcagcacatttatctgatgatgacacgtcaatatatggttttgtagcatccaagcccacatggccatcatggctgctcatagcaacagtggtacttacattagcagctgctacatctatcatcccaagtgaagtatattgttgagttgagggctttgtatgctgtgggagttggattacactaagcatctacatatctgtccagtacttcttccaagcagttgttcgtatcctcctcctgttgcgacaattgtctgtgctgcaagtccttaaantattcacgcatccctccatctgagtccaacaacaangggttttg

SEQ ID NO: 93505 - DNA, 562 bp, Triticum aestivum
  unsure (1)..(562): unsure at all n locations
  Clone ID: PAT_TA_93505
aaaactaatggattccccgggctgcaagctcgtgccgaattcggcacgagcgagttttttttttttttttttggncagactctgaatcttatttaaaataanccaagctaataagtgtgttacagcaaagcagggcttacaatccgttgagcgacagcggcacancgccccatggacgatctcacgattgccaagctgatacaccancacgctgctgctaatcccgctgttattgcaaccaactgccgttgtggagaaacaagagctggtgcgggcgccggtggcccnaatgcacacnaaccggaggggggcgagccgtgtggtggtgctggtggcggacgtacaacagcgttggcctggacgacngggtggacggcgaaaagcggcggcgtcttggcccttgggaacaagaacgcccttatcttgagcggctgggagccggtccctgctggnggngtcgtactcctccaaaaagtgggcgangtcctcnctggtcntgacggagaacaacgcgtccaaaatcctccntccggcagctgggaaccgcaagntcaaccgccnc

SEQ ID NO: 93506 - DNA, 502 bp, Triticum aestivum
  unsure (1)..(502): unsure at all n locations
  Clone ID: PAT_TA_93506
agcttgagaaancgcgcgcgagatggnaacctccatgatcacctcnccgattgtggngccgacgagcgtcccctccctctcccgccggggttcctccttcgccgtcgtctgcagcggtgggaagaanatnaaggtcgacaagccccttggacttggaggnggcttgncagtcgacatcgacgccaacggcaggaaggtgggcaaaaagggcgtgtaccaattcgttgacaagtacggngccaacgtcgacggntacagcccaatctacacgccagaggaatggtctgaatctggtgaccgctacgccgggggaacgaacgggcttcttatctggggcgtcaacctcgccgggctcctcggngggggggtcctcctcgtctanaanaacaacgctctcgccggntaaaagagcatctacgtgttacacaagggcgggtctctgcttgcatgcacgtctctgttatctacataactacctcctgtgaatgtatgcaatcaacan

SEQ ID NO: 93507 - DNA, 488 bp, Triticum aestivum
  unsure (1)..(488): unsure at all n locations
  Clone ID: PAT_TA_93507
tttaacctcctcctcaactcctttntcccttttttctttaanttttaatcctcctccgcctccttgggtccggtcctctccccgcccangcctcctcccaaatcctcctcgcctccgccgnttccgttnggggtccaaccggngatacgcggngaancaaatcgcggngcancgcgtctgntggggtccccggggngggcaagactccgtctccgggcccttcgggctgtcccccgacctcgcccgctgntccttcgancaaacgctccgccgagaggnttttcaagacaacaaattattgaggncattggntagcaagcgtggacaagaaaancattccnaagaaattataacgggagctatcgngagctgcatgaacaaacaagcaaaaaatctggggnantcactgggtgtcaacaatgggaaggtgtcncacntggngttatactgctatnaancttgaaaaggccaantgggaantgcgaaac

SEQ ID NO: 93508 - DNA, 530 bp, Triticum aestivum
  unsure (1)..(530): unsure at all n locations
  Clone ID: PAT_TA_93508
tttaagaccaagttgaatcncanaaaagagtttaacccgcaacagcaagaagtaccaacaagacacgctcagttcaaaaaaaaaaaaacagacacgacaagctactgcactgaagtatatcacaaattttgtgccagtgacataagcaagcttctttcaggacacagaactatgccagtgatttgggaaagcgattttctggatgcattccggtgagacagctctgcatacggcttcagctgcgaaaaaatgtgacactggctttccctttaaacagaatctcggcacaggtcgaagctcttctgtaacttagtatcttgttcattgcatcctcattcgacattgagcaattctcaccatgagtaataaataatgtgcaaaaaagccttgctttagagagaataagctctataaaagtcatctcatttggnagccaatgaataccagttatctgcacgaactgaagggtggnacacaagccancggtccactgggaattttgaaactcctcatgtgcctcaaatttctgg

SEQ ID NO: 93509 - DNA, 535 bp, Triticum aestivum
  unsure (1)..(535): unsure at all n locations
  Clone ID: PAT_TA_93509
ggcaagcttggcaagttggcgagtntggncggggatgtcgatgtgagtcnacgtnaagggaaagttnttaccatctttgntgtgaagcttacaatagagtactcaggnaaaacaaaagatgacgaggaagtgagtggtacaattacagtgncagaagtagcccatgacaccgaggnacacgagtacgtctttgntataaatatcaattccaactctgcatcaaaagcccctgtcagggatctngtgaanagcaagatnatacctcctttacgaaaaagagtttgtnaaacttgggccaacactcatagctgagcacggntaagatatacaagcaatcaaccggntnaagtttatccaatcctagtggtccaattctaaaacaacatgaagctaaccctggcttcatctaaggacgtcctcaaagaactgaaaacacctccgactggtcaatacaactancgtgacaagataatggaagagnttcgaggccctgntacaagaggctctatccgtacctttatcgancccccaacgg

SEQ ID NO: 93510 - DNA, 543 bp, Triticum aestivum
  unsure (1)..(543): unsure at all n locations
  Clone ID: PAT_TA_93510
caanggaaacggtcacactctcactgaaagcaagggtcantttntggtgatgcgcggggaacagcgnngacatgggggcgccatgtcntgtgnccgtcgtccaancgccgcgtgagcatcannttngtgagggtgagggcatcnactccggtggnnctnaaaaccgctcccgtcgcccancaagggcangacnctctgggnagnctccccccnactgngggaacgggcgggatgtaataaaccaccccatngnancaaacggggcaaatcatttggntattggcccgcccccgcaaagncattgntccccccccgntttngggaattggccgnttcgccncggggncctgttnaattaattgtctcccnctccccggcgnaggggcnaatnggngattnggggncccnnccagcaaacattcaaacaanaaaaggttggggcgccgggaggggaacccggncnttgtttccttcccgttngaccggggttgggccccanganggttcaaaanaaaanaaactnccccccncgccatncaaaaa

SEQ ID NO: 93511 - DNA, 438 bp, Triticum aestivum
  unsure (1)..(438): unsure at all n locations
  Clone ID: PAT_TA_93511
ctcgtgccgaattccgcacgaggtggaggntaaagatctcgggggggnagcggnaacccactgctgcgcaccaccaacgggcacntcngncggcaggtatgggagttcnatcctgccgcggntgancccnacnaggtcgccgccgttgatgccgcccgccgcgacttnaccaaancgccggnaccaaatgaagaacaactccnacctcctcatgcgcatgnagntctctaagtcaaacaatcncaagatgaaccntcctcccaacaagctggnacaacatgggtntcacacacaagaagacgatgtcttgatatctttnngggagggnaatcaaccgatgttccactcnccaagcacaanatggncaattgncgggggantannccgggantttanttttcntgnccagatttttttttgactncatgtgtctggggg

SEQ ID NO: 93512 - DNA, 549 bp, Triticum aestivum
  unsure (1)..(549): unsure at all n locations
  Clone ID: PAT_TA_93512
ctcgtgccgaattcggcacgagaattgataagcttcantaagtctaacaatcatgcgcttctcttgcttancantcgtccttcaaagcgccagtatcttcntgacgactcntggggnncacacgacgaaacanattgattnntaaatctaagggattccattgtggtgnacangnattgaagcaagaaaattatgcagggnnagaaaaatcggnaataacgccaatggngattccccncncctggaacttgagggaaggattcaaaaaancgatgggggntacnattgangagagaancctttttgtttgggtggnaagcgagcaanaaaaagttgaaattttcaaaattggatggaattatcganaagactaccanggangattaattatntttgtttanaagannatactaactccattccncgattaaaagtaatccgtggtgaggtgggnggtaattanngaagggannatattganntttacctccggnttcgnttttggnaggnaacccaaccacngnagaaaaanntctnggttgnnggatg

SEQ ID NO: 93513 - DNA, 432 bp, Triticum aestivum
  unsure (1)..(432): unsure at all n locations
  Clone ID: PAT_TA_93513
anggcaatgaaggtgctttccgtgaccgaaacgctggtagcgctcanaatanagcaaagccgattgatgaggttgaacgacaaagaaatcgtggctcangcgagggtcgtggacgtggtggacgaagtgagccacgcaattttgntcgccacagtangggngtngggggtggactctgaaaagcaagccnaaccatggatggggagctaatgaaggcaaagccgagcttgccnatgagcaagctggagaagcgctagctaacgcagaaacaaaagatgccatggnttcanggggtgaagcaaaagccgcatccggccccgcaaatgatgctgagccccgaggnaaacantatatcttatgcccgngtatcntatccaacaacaagaaaaanaaaattgggtctttnctncaggananaactcaactccgnaa

SEQ ID NO: 93514 - DNA, 310 bp, Triticum aestivum
  unsure (1)..(310): unsure at all n locations
  Clone ID: PAT_TA_93514
aaggcctctccaagtccaaacaacatgttcaccannggacgtgcccctactgaaaactacatcacctacccgtccaacctatgttccaccancaaggtggctcagcatccgccttctgacgattgtgatgcatactaaagatgtgcctgggaccgaaaaaattctgacncccgggaantaaangtttgtgacaccagcataangcacctgcacaagtccggnaagaggcnatcttctacnggngcaancagctaaagcttacaaantcaattncacaaccccccnnctgatagggtntcaaggccaggca

SEQ ID NO: 93515 - DNA, 234 bp, Triticum aestivum
  unsure (1)..(234): unsure at all n locations
  Clone ID: PAT_TA_93515
ggtttttttttttttttttttttntttttttttttttttttttttttttcttttcttttttggngaaattgnccaaaaaaacncaaaggggncccaaanagtttcangggnaaatgngaanatccaactgttttcaatgaaaaaccccaccaaatnatntccagatcatntacaacccaagnccaatcnaatngtttgtcaggttctgacggntgntgaatcaannacnaaatg

SEQ ID NO: 93516 - DNA, 531 bp, Triticum aestivum
  unsure (1)..(531): unsure at all n locations
  Clone ID: PAT_TA_93516
ctcgtgccgaattcggcacgagatttcatcgagcctaactgatcagttatcatgcgcttttctagcatagccataatttttcaaagcgctagcatctttacaacaactctagctgctcgcaggaccaagtcacttagatgacctatttaaggtatttgattgtaacggntactttatcaggtaccctcaattttcatcttcacaacgttcggaaacatttcattcgggccaaggtagaatgtcccgttcttggtccgcacaattagactacttgctgcagagacctggggatgagagagttgtattgtttggaaatggngccagccatgctctaaagtattacaagcctcgacactttggcgactggaaattttgtcgacagttggnttaataatatggaattcatcattgctatcgacaatcctgatcgtgcttgcggtaataaacatgaaanttacatctcgccaattgctcaagtgaaatttcgtgtccaccacaaagaaaatttttccgttgggctccaatacaaaa

SEQ ID NO: 93517 - DNA, 519 bp, Triticum aestivum
  unsure (1)..(519): unsure at all n locations
  Clone ID: PAT_TA_93517
agaactagtctcgtctttggtaaccaggacgtttttatccacgtgcaaaatgaagttcatccatttcactaaagccnacanaaattctgagcttaatttacatcattatgtgcgactcaggccgtgaatgatggatatgcaatgtttaattgtcatggggtaatattttactcagagagtgtttttgcatcagctgcaaaagcacacagcctgacgctcggacaagtaaatcactacccaatcgaaattatcagtagcacatttagtggccaatctccgcatagattgtttcctatggtacttgataccgaggtttaccaaggtggacctttatcttantttttcgtagttgtggacaaaaatggcagggagcaaggccttgtatttaatactcaaaatggctatcaaccatgtcaattaattcnatangagcatatctgggtttacaactgaaaaacaacnccatgggatgaccggggatttagcttaagttnaccctttaaagcccggactaccatt

SEQ ID NO: 93518 - DNA, 546 bp, Triticum aestivum
  unsure (1)..(546): unsure at all n locations
  Clone ID: PAT_TA_93518
aatcactatgccgcgtgaaaccgaaccctctctcaacgagcgacaattcttcactcangncctgcgccagcaactanggntanatgctcnaccttttgatnaattncgcccaattactctcgcttttgctgagcgctanggggtagtcgacctcantcttgggggnactcggattcatgcccatgtctctgctgaagtgacacagccctatcccgacaggncatacnaaggnctctttaccattgtcacggagctctctccaatgaccacgctcatctgtgggcagggcgggaatcaacccntgaaaatgggcgtctccccgtttactttgaaaaaaanaaatcngttcgctcggggggctccttgntncccgaatncctctgttctcctaanntggggnaaaactgctgggcaaatccggggtcgaagtccanntnatcctcctggtnggggggaaacctnaataaatgntggntagcaatccccgttaattggcggncctcncctcaacttnaagnagaacctggaaacaaaaaaccggtngng

SEQ ID NO: 93519 - DNA, 538 bp, Triticum aestivum
  unsure (1)..(538): unsure at all n locations
  Clone ID: PAT_TA_93519
ccagcacacgctaagccaagcaagacccgagcaagccacactctccancaccagcaggccggcggnaancagcgcaagcacaacaaccaaatggccaccatcagcgccgccgcggcgaccaccgtcgtcgcccgtgccgccatcgccaggccgcaggccctaggtctgccccagctgaggaccaggagcgagagggtgaggtgcagctactccaaggacgccaangaggcgacccctgccgccgccgtccgcggggctggcgcgtccctactcgccgcggngtggcgcggtgaccgcgtccgcggggccggcgcntggcgcctggtccanctaacgggatttctncngnggggcaccgggcttgagccttgggggctnaaacaacaacctgctgggggtggatnctccctggggcggtctttcgggcctcatcctggtccgctcctaaaacgttctanancctcccgggcctctaacaaggatcnagganntccgggcgggcctcnccgctctaatntacanaataagtttcctcgtt

SEQ ID NO: 93520 - DNA, 384 bp, Triticum aestivum
  unsure (1)..(384): unsure at all n locations
  Clone ID: PAT_TA_93520
ggctgcagggctcgtgccnaattcggcacgagctgccccacacacacgcacacatcaagcgcagcgcagctcgatcgatccgggagctaggtaactatggccgggaggaaggtgatgagcaacgccggcgtcgcggccgcgctggtggngctgctggncgtggcggcggngtcgggctggccgggattcatgtctgcaacgtggacaccgtggagcatggtgaacaactgcaggtcctactgcacggtgggnagcaacnaggccagtcccagcggcgcgtgctgcggcgcggtgcgcggcgccaanttcangtgcctctgcaantacaagggcctgctgtctaangacatcganngccaaaacgagtcatgcacattcccagtc

SEQ ID NO: 93521 - DNA, 364 bp, Triticum aestivum
  unsure (1)..(364): unsure at all n locations
  Clone ID: PAT_TA_93521
gcacgagagatancgcanaaacanaaanccgatttctcantctctcncgtgtngcaaccaaaggancaaatggcgccggtgaangtgttcgggccggcgatntccaanaacgtggcccnggtgctggtgtgcctngaggaggtcggcgcccaataccaagtggncgacatcnatttcaangncatnggggcanaaaaagccccnagcatctcntcagaaaccccttcggnnaaatccctggcttccaannatgggggatntggngtctcttcctagttcaccgcgcaanttgcaaaagtacgttgctcccccaagttacaanaaaaaacnaaagtgnganctgcngttcgggaangnnaacctg

SEQ ID NO: 93522 - DNA, 159 bp, Triticum aestivum
  unsure (1)..(159): unsure at all n locations
  Clone ID: PAT_TA_93522
naaaaaatggggcccacccaaggnaagnaaagttctcaagatttgctcnaggntcaagttgacctttgggaccaatcantgggatttgtnaagtccanggnactcaaatgtgcaatgggactgnaaatccctaacaccanccaacaacanggggggggg

SEQ ID NO: 93523 - DNA, 534 bp, Triticum aestivum
  unsure (1)..(534): unsure at all n locations
  Clone ID: PAT_TA_93523
gacgaaactacgccatgatttccaatcggatagctctccgtacaattagagcgaccttacccatcgccaatgtttccttcacagccccagctgtgcctctggcccggaactttgcaaacctagccgccatttccgacccaaggcctcccattgcccttttttggactttccgggcacgtangctanagcattgtatactgctgccgttaggagtcaaactcttgagagcactgccagggctatcaatgcgctcaaagacctgtatattaaggacaaaaagctagcgacaataatgcaaactccaacgctgtcaagcccaagataaatccgcaaatcgtctttgagttacagaagcttatccggggaaagctgacaaanggaaaaacctttcaaaacttcttngaanactggccgcagaggtacaaatccgaattgggcctcaatgaaaggatgtctgcgagaaaaatttggggggaactaattgggtggctgcaaagggggggangggtnaaacttttccttcaacaaatgcnn

SEQ ID NO: 93524 - DNA, 545 bp, Triticum aestivum
  unsure (1)..(545): unsure at all n locations
  Clone ID: PAT_TA_93524
ctcgtgccgaattcggcacgaggctacggccaccccggcgcgctccgcatcccctgccccgtcgccgacttccgccgcctcctcgtccgcctctccgacgacccctacgccgacgagtgctaggctccggnccctgnctccgcaccttcttcgcctgccgctgggngnaaatcngngcttcattcgtccccattctgacagatttacccccgggcgctgggcggacttgcaatgtacatacagtggcaggccgaagaggagtcggtcgccggagcgagggttaggatagggatctcctagcttccgtagtaacttttttttattactgctgagcgtgagctgaatgggaagaactgtgggtgttcctttttcaacccctctgggtctaggaatttcantgntgtntgcgtngcgtgagtgaaggggagaaaaggtagnaaacantttngagtttgtgctaaaggaattttanggggggttcnggngnttaaccaaaacnnaatnctgganggctattcaatattgncnanaaatttttacngntg

SEQ ID NO: 93525 - DNA, 483 bp, Triticum aestivum
  unsure (1)..(483): unsure at all n locations
  Clone ID: PAT_TA_93525
ttccctcgcgcttcgactcccactccgatntccgggcatggccgcngtgcgccccggatcccctgnccccagacggntgcccccctccatgctcctcctcctgngccgncgtcntcctcgcnggctctccgccggagngcgcccttcggttcgncctcgantncgggcacaccaaagtgcatctccgacgaagatcaaggtcganctctatggtcgtcngnaantacaagcgtngtcngnccccgacccccagntacnccggncgcaacaggctcccccggagtccgcaaccgcggttntcccttcaggggtggacgntcgccngtaanggggaaacaagcaatgcnactactccggngaanantgcangtcngggggtaattttcgccctctcaactggcngggtggggagggtccgngcggaaataacatggccctggcttctggggngccngcctgganccancaanccaacccgttcca

SEQ ID NO: 93526 - DNA, 326 bp, Triticum aestivum
  unsure (1)..(326): unsure at all n locations
  Clone ID: PAT_TA_93526
gggcctccgcgcgtctctcaaaggttggggggcaaccaaggccgcgaagacaaactccaatgggnccatttggtccaagagctccgcggctttggatgctcatgccgatgcccgcccattctctgagcaagagtgggcacaccgcttacgacctgtagggacaggaggaggcgcttcttcggtgtgaaagaagagtattgcgggaggangaaggggggnccacntngtccnctnaaanggtnatgcnaacactaaaatatttccacgcccacncnnaatgggtctnccgccngcaaggngtgctatccntccgaactnccactctg

SEQ ID NO: 93527 - DNA, 295 bp, Triticum aestivum
  unsure (1)..(295): unsure at all n locations
  Clone ID: PAT_TA_93527
gtcaacctcacccaggagaagaagagagagaagcgagaagatgtcngggcgcggcaagggaggcaangggctcggcaagggcggngccaagcgccaccggaaggtcctccgcgacaacatccanggnatcancaagccggcgatncngaggctggngcgtccgggcggngtgaaacncatctcggggntcanctacgangagaaccgcggngtgntcaanatcttcctcnagaangtcatccgcgacgccgtctnactanancgagcangcccgccgcaagancgtcaccgccat

SEQ ID NO: 93528 - DNA, 518 bp, Triticum aestivum
  unsure (1)..(518): unsure at all n locations
  Clone ID: PAT_TA_93528
cgctacttctaaataaagtggtgtagatttgtctatttcacgtgaaacgaaccatggcctccaaatctcagagcctaaatggttcaagaaagtgagtttgagtttatcgaaactccaaaagccccttcaccaacttttgagaaatttgaagattgtggtgtaagaactacgtcgtacccatctatcaagaatggtccgcttccagtagacggaccaggctcagacagtttctctaacgttgtattattctcatttctcgctggagttccaacatatttttcttggaagatcggcggcggctggaaaacctcgatattcttcagtctctttacaacacctccaattttgntatgtttttggtacataagcatcttcttacagcccacgaaaaaaatgacaaagcgaaagttcctgggtaatccaagtccgaacactatctcacttttaagtccccaacggatcgtgctaagtattcctggtanaaataagaatcctatgggaacttttcaaaacatgta

SEQ ID NO: 93529 - DNA, 330 bp, Triticum aestivum
  unsure (1)..(330): unsure at all n locations
  Clone ID: PAT_TA_93529
ttttttttcanaaantaattactacttcactgttccaaaggtgnacacggtgcacagnttatttggnananatatacannaccaatcggcaantcacgacanttaacacgtcnacataaggaccatacttacacacaaccacacttggctcaggnatccatccttggctcnactcagaaactcctggncgttccccgtccggttgccgtcaaaaccgccggatnctgaaatgccgggcnctccaaggccggcctccgcgggcgtcccccgnncgccgccgtncaagnnggcaatctccngccangggatccttccccaaccgnccggggg

SEQ ID NO: 93530 - DNA, 554 bp, Triticum aestivum
  unsure (1)..(554): unsure at all n locations
  Clone ID: PAT_TA_93530
agaaaaaatggcaacgaatgggcagtcattttatgagctctatcgccgtagcagcatcggcatggcactcacagatacgctggacgacctgatcagcgatcgtcnaatcgagcctcaattagccatgaaaattctggcaaattttgntcgtngcatcactgaagttttnnctgacaaagtcaaggctcggctgacattcaaggggcaccttgacacctancggttctgtgatgaaatctggnccntccttgataaaaagatgttacnttcaatnatgggaaattccatccaagaccgttacaagcttgatnaaagttaagatcgttagnttgcaataacaagaaggcctgggnnaagacataaaagaacccaacccaantgaaagggnggctacnaaagaaccggattccttcaatttgttggctggnggggnaaccttnccaaatngaatgaaggtaagacctgggattttgattgaaatttgctnccccaaccccccaccnggggtggaaggcctttaatcccggcgnttgattgggataanntgggngtcc

SEQ ID NO: 93531 - DNA, 501 bp, Triticum aestivum
  unsure (1)..(501): unsure at all n locations
  Clone ID: PAT_TA_93531
ggtcgatgcaggtgtcgctgtcttgctgacacaagacaaaagacttattgaatttccctccatactcctaccccccaacatctcctcaggcagcattgtcgatattacagtttcgcgcaactttatcaccgaacaaaagtcagaggctgcatttcttgccctccaagattcgatctacgagtccttcgggaaggatgaacctgtcgctccggttctccgctgtcgaaatgccacccaaacgtccgttgtcctcgaatgggacccaatcatgctcgcgacggcagatattatctcgctctccttatttcgcaacggccaaaaagcaggaaatattccgaaacctgaagttatgacaaagtacaaaaaattagtgggttgggaataaacacggggtacaactttcaactanngcttcgaactacagnaggaaccctatancanntgataaggggtggtgttaagaaaccataaaatgacnggttttaacgggattactgggac

SEQ ID NO: 93532 - DNA, 534 bp, Triticum aestivum
  unsure (1)..(534): unsure at all n locations
  Clone ID: PAT_TA_93532
tctgggaagtcnatggccattgggtcgttcaaggagcanttgatgtggacattggagccaatccctctgctgagggtggtggtgacgatgagggtgtcgatgaccaagccgtgaaggtggttgacattgttgacaccttccgtcttcangagcaacctgcttttgncaagaagcagtttatctctcacatgaagcgctacatcaagaacctcactgccaagcttgaaggggatgacctagatgttttcaagaanaatgttgagtctgccacgaagtatcttcttatcaagctcaaggaccttcagttccttttgttggcgagagcaatgcatgatgatggcgggntggtgttccccgtactacaaaggaggggagctgctggattcaactttccctgtactttncacaatngggctgaaaaaangtcaaantggctnaanggcacaantntgcctaaaaatcctttggggggcccccaagtaanttttgcctccncctccnaagttatgggggtgtcaagtcccacctccnccc

SEQ ID NO: 93533 - DNA, 209 bp, Triticum aestivum
  unsure (1)..(209): unsure at all n locations
  Clone ID: PAT_TA_93533
ccgccgcaggctttgaccccatcgcccctccgtcctcttcgtctccggtaggncaggtagttaacagctccagcagccatgggaaaggagaagatccacatcagcattgtggtcattggncatgtcnactctggcaagtcaaccacgactgggcacctcatctacaagcttggnggnattgacaaacgtgtgattnaaangtttgagaa

SEQ ID NO: 93534 - DNA, 252 bp, Triticum aestivum
  unsure (1)..(252): unsure at all n locations
  Clone ID: PAT_TA_93534
ccgccgctagggtgttngtccacacactcccgccgccgccatccccgcgaaccggagagcgaggccgacaccgccgccgcgatgagggccaagtggaagaagaagaggatgaggaggctcaanaggaagcgccgaaagatgaggcagcgatccaagtatgtgccttggggggaggggaaaaatcatcttncatccacgcagcgngnactctttgggangatggcatttncgantgactccngaattgttttt

SEQ ID NO: 93535 - DNA, 501 bp, Triticum aestivum
  unsure (1)..(501): unsure at all n locations
  Clone ID: PAT_TA_93535
gagtttttttttttttttttttttttttttttttttttttttttgaccagtaactgcttgattgtatcaaatagaatctttaaatagcttatttacatttgaacctctacacgtccttctgtacctaagctaccgctagatcccaagcttggcaatagatacgtaatatcatcccaaggatgtcggtatanaccagttcgaagtctcttctggtcaagataatgggcgatcagacctatactccgacctaggacaaacagtccgtttaatactcccattcgcaagtagtcttctgcctcctcggnactgaatgcaccgcagttccgcattaagtcaacaaagcaaacaagctactgcaccgtcgacatttaaaattaagttatntttcttcgaagtagtgacaagtttcnacgggnaagaagcaaaaaccaaaattcntgcngggacggggaaanngcttttggcgaaatncttttaaanccccaaaacnaanatttgggt

SEQ ID NO: 93536 - DNA, 503 bp, Triticum aestivum
  unsure (1)..(503): unsure at all n locations
  Clone ID: PAT_TA_93536
gttccattgaccaagatttattcgacttcggaatagcgcttcgtatcaacaaagtctaggtcgccgcccgttgaaacctcgtgactcggctgctcggctaaagcgggaatttgaggaagaatatggccccaacaggctccctttctacgaaggcggctatgcccaggctctcgatctcgcaaaggccgaactgaaatttctcgtaattgtcttattctccccagaacatgatgaaaccacaaagtttgtgagggataccctgctagacgcacatgttcaggcatatttgagcgatgagagttccaatattatcctttggggaggcgatgtgagggatacggaagcataccaaagtctcggctgcggttaagtgttccgagttcccctatacagccgtggtgggacataccccanttatttcctccacctccaagtcggtcataaaaancctccccgggtcctangangcgccngtcaattaatctttctaaaactaanggncn

SEQ ID NO: 93537 - DNA, 221 bp, Triticum aestivum
  unsure (1)..(221): unsure at all n locations
  Clone ID: PAT_TA_93537
ctcgtgccgaattcggcacgaggagagaactagtctcgagtttttttttttttttttcggcaattcaagctcangcgtgtgctggagacctgaaacaaagtgtcgtttgtttgcaccancccggcgtgggtgntgattcctgnaccttttgnancggtgggttcttgtcgaactanctgggtcntttctcgnatgtagaaggnancttantttgntgggac

SEQ ID NO: 93538 - DNA, 269 bp, Triticum aestivum
  Clone ID: PAT_TA_93538
acaagtcaaagtttggatcttttaccctaaaatgagtatgtagttctttgataggaagttgtactttgttgtcatcgagaaattcttgatgattatatctcacaagtggcgatatggtttaatcagttaataaaaccagtccttaaagagaataaagcgacaataccgaggtttaacatcagctctcctggttttgatgcgtagtggttcatgcctttttgttgctatattattctcaataatacttatatatctggttatatcaatat

SEQ ID NO: 93539 - DNA, 435 bp, Triticum aestivum
  unsure (1)..(435): unsure at all n locations
  Clone ID: PAT_TA_93539
tctcgccggaaaatctcctccgacagatngaagcgaaggncatctcgtcctcctcctcaagatgcagatctttgtgaagaccctcactggcaagaccatcacccttgaggttgagtcctcggacactatcgacaacgtcaaggntaagatccaggacaaggagggcatccctccagaccagcagcgtctcatcttcgctggcaagcagctcgaggatggccgcaccctggctgactacaacattcanaaggagtccaccctccaccttgtgctaaggnttcggggtggnatgcaaatcttcgtgaagancctcaccggcaagaacatcaaccttgaggtcgagtcatctgacaacattgataacgtcaaggngnagattcaaggaaagggaggggatccccccgggggcaagaagagcctcaaccttccngggaa

SEQ ID NO: 93540 - DNA, 471 bp, Triticum aestivum
  unsure (1)..(471): unsure at all n locations
  Clone ID: PAT_TA_93540
ctcgtgccgaattcggcacgaggatttctacagctccgtcacaaaatttagatcaaaatttctatttctgcaggtgcattctgatcatgtttacaggacatttgagtcacgaagattttttcgcccagttatctttgctctttgagtctccgcgccagaaaaatcatgggagcgtctacttgactcagaagcccatgacatataacaccaccagtccagctcaaagcaaagattctctagctcaagaaaatcatccaaccactcctcttccgataatcgtacgtgcctcaaatggnaaatctaaggaaaagaaagataaaaagatcaaactttctacaatagtagaggcggnttcgttagaagcattcttcaccaaatacgcaaaagtctgcnaggggaggnatgagcggggatgaaaaaaagagaacgtncaaggnaaaggnaaagctgaagggcaaaaaaaagcgcaca

SEQ ID NO: 93541 - DNA, 468 bp, Triticum aestivum
  unsure (1)..(468): unsure at all n locations
  Clone ID: PAT_TA_93541
caaagattttggtaagaatgccagaggcaactcttacagatggcgaaatgattggggtagcgggtttgggcaataaaggaaaggtagggcgagcaaagtggaatgaattcaaggtgcttgtacttggtggaattccggtgacgtaccgcgctaaaatatggtcagagtgttcaggagctgctgcgttgagaatcccaggatactacgagagtctcataagtcggccaattactgatgatgatccggccatacttgcacaaattcaaatggatataaatcgcacacttaccgataacatatattttagaaaaggaacaggtgttaacaagctcaatgaagttctcttggnctactccccgacgtaatgctgatgttgggtattgtcaaggnatgaatccttattanaagnaangccccctgccaaattatcccgcctgctgaaagacgcaattttggnttctttgtcnn

SEQ ID NO: 93542 - DNA, 462 bp, Triticum aestivum
  unsure (1)..(462): unsure at all n locations
  Clone ID: PAT_TA_93542
tgatgatgccatctagtgttagatacagttctctatattatcgcgcgtcacgtgctagatagatcttaaattaccattttcctatcacattccctctcgtgtacgctaactttaaatttcaatatttttgttatatcccgacatcatagatcttaacatgttgaattgaaccaatctggtgcgtgtatcaaactggcgatataacttggatcaatattcaccgcttgcggcggngctttatcacctatatctctttcagccctttcaagaacttcttcgatatggctgacgctgctctcatcaccctctacctcaccancgaggcgtggaaagagtttggnaaaatcccaatttttcggncgcgcagctactccgccagttacccacccaaggncgtattcacaggnttcccctttatcacaagatcttttgttggccaaaaccaacangaacgcgggtttt

SEQ ID NO: 93543 - DNA, 180 bp, Triticum aestivum
  unsure (1)..(180): unsure at all n locations
  Clone ID: PAT_TA_93543
ctcgtgccgaattcggnacgagctcgtgccgaattcggnacgancatctgcgcatggccgtcnagctgcgatttgagnacagcntggctgcctgagctgcaatggtgggagtaacgctgcgcacngtgaccgcggggagtgggccgacanggacattgnaactccngcaatgntgctttg

SEQ ID NO: 93544 - DNA, 532 bp, Triticum aestivum
  unsure (1)..(532): unsure at all n locations
  Clone ID: PAT_TA_93544
ctcgtgccgaattcggcacgagtggccgtcctcctgggcgcgcaaggacaacaacccagtgcggcacgcgctgctccggtgcttctggccgctgttcctgctgaacgcggggctggcgctgctgcggctgacggtgatgtacgtggggccgacgctgatccagagcttcgtgagcttcacgtcggcggcggagcggcggccgctgtgggagggggcgcggctggtgctggcgctgctggcggcgaaggcgatggaggcgctgtgcagccaccaagtacaacttccactgccagaagctggggatgcacatccggggcgcgctcatcaccgccgctctancgcaagggcctccgcctgtcgtgctccgccaggcanaangcacgggcctcggcatgatcgtcaactacaatggccgttcgaacgncgcaagcaactctcccgnacantgaatgctccaatatccactaacctctggntcanggcccgctccaaagtgggccgntggngccctgnncctgtttgtncatnctac

SEQ ID NO: 93545 - DNA, 522 bp, Triticum aestivum
  unsure (1)..(522): unsure at all n locations
  Clone ID: PAT_TA_93545
agtaagaatctaagactatatttgaatgagcattacagcaatgcatcttgtggggtttatcctaccaacgaagactctgagattgcgatattgattgttgccaatcaatatagtccgagaaatttttggaatggtcaatggaagtccctttacatttattcaccagccacatcttgcttgagcggacaaatcaatgttgatgttcattattacgaagatggaaatgtccgccttctcacatcaaaacctgtatcattatcaagtttctcatgattcaactgaaacggtcttgaaagagattaaaggcttgggtgaaaaaatatcaagaggaactaactaacggctttcaaaacctgagtgagggagccttcaaaggggtgagaaggnaantaccggtaacaaaggcaagaaanggttgagtgggacaaagattgcaaggctatccgttagggtcaaggatattgggggggggggcagtatcaangaaaataaaaccttagtngcgagcctttggaacctngg

SEQ ID NO: 93546 - DNA, 405 bp, Triticum aestivum
  unsure (1)..(405): unsure at all n locations
  Clone ID: PAT_TA_93546
ctctaagatttgntcccccctcctccctcgcgtcgccccgcaagggggantcgggggngatncaaatnccgttcgtcgccancccccttnctccgcttctccccttgccgccgccggaggganccgtcggnaaacanntgcgaangccgatnaaggtggnggggaaggtcttccgtcncgtttcctccctgggaaanganctaaggntccaaacggcggncttgntggggtggggggggcccttcccanaggggggcgggggacgccnganttggggncgcctcccctcccnctgcgttggnggngaagcggcggtggantggggngtcctgcgttnggggccccccgtcccctcttcaaaaaatntttaaaanagggtnnccctctcctntaaaaaaacccccc

SEQ ID NO: 93547 - DNA, 495 bp, Triticum aestivum
  unsure (1)..(495): unsure at all n locations
  Clone ID: PAT_TA_93547
gcataatgatcgagtatccgtatgttgagtgtacatcatcagtaattcagggtctggtgttatttaaagaaatgtaccccaaacacattcgcttggaagagatagacagttgtatccaaaaggctgcagactacattgagagcatccaatggagtgatggatcatggtatggttgttgggctatctgtttcacatatggtacttggtttggggtgagaggattggttgctgcaaggaggacgtntgtnaatancctaacaatcanaaaagcgtgtgaatttcttttgtccaagggggcttctcccatctggaggggggggagaaagttacctttccantcaagacaaaggttacaccaatcttnaangnaacaaggntcaagcaattnaaaccaattgggcccagttgggcccaaatnatgccnggcaaggnccnaaanattctgcaagtctcaaanagnaancaanattcnggtgaacntcccaacacaagggg

SEQ ID NO: 93548 - DNA, 531 bp, Triticum aestivum
  unsure (1)..(531): unsure at all n locations
  Clone ID: PAT_TA_93548
ctcgtgccgaattccgcacganggtaatgcaatgggcgccatcctctcttccgccgcgccaaagaagccgactcccccgcgcgcccggaggnctcnacaggngcccangaatangcgcctcccccttggaggncccgcggggggcctcttcaccangctcggactaaatggcgggagggccgctctcgccgctcctctctcctaanangagatgctgcgggtctcatccgacaccgccggtggtgggggtgacgggttctccctcccaaaactcgggctcggcgggttggtggncttnttcgcgcaaaaancgctcgtcgtcnccgcggggctccccgtggtcnccgtgccgttggtcctttnccaangtgcttgggggtggctccaangcgtnncaaaacgtntccgtttaaagggcgcgtaacgganngnttcttgagggggctganncccaanctccntccaaaataaggccgctcaaaagaancccccgggaaggtccgggtncccccgaanaanttccngtgnggg

SEQ ID NO: 93549 - DNA, 163 bp, Triticum aestivum
  unsure (1)..(163): unsure at all n locations
  Clone ID: PAT_TA_93549
atngccacganctcctancctttctcgtcaggggggagcgagggcacaatgcggattcctctcatgggntggnctcaccaanattntcctcccaaatcctcctcctcctctccgtngccgcggggcaaattcgccgtcttctgncgcggagggtgtatcccgg

SEQ ID NO: 93550 - DNA, 482 bp, Triticum aestivum
  unsure (1)..(482): unsure at all n locations
  Clone ID: PAT_TA_93550
cgacatgcgaagaaactacccaaaattatcatttatcacgcaaaatgacgctgttggcttgttaactctcggcagccgaaacgacccaaaaagcgaattgatcggagaatccgggatcaaggcactcgtggatgtgaaaaaagagggtgagcttggattagctgcatactttcagaaagaaggtaaaataggaacactagcagctctagggaaagacggcttgcctccttttccatgtagtgtaaacctaaagaaacaaggggccgacaaataccagctcactgcagaaaattcttatccagaaagttatccgtgtagatcattcaagtaaattgagccgaatccttatcatgggggagctatgattttgggactgaaatatcttttattacctacttcaacctcttttcttactttcaaagcaaggnaaagcggctctcgaactggatttaataaatggngtgtcanctaaatctttagtg

SEQ ID NO: 93551 - DNA, 468 bp, Triticum aestivum
  unsure (1)..(468): unsure at all n locations
  Clone ID: PAT_TA_93551
ctcggcaatcagctattggtagaaacattcagaatttttatttattgaaacttttacatcatcatatcaccaaagttaagctgcttcatacttaggagttatcaaaaattcgaaactcgaaatcaatactcaaaaaagaataaagattcaaagtacacctaatatatttcatccagccagctatacaatgaagattctcaatccggcaaccttccttcttatctccagcaatttgatgctatcaggcgttgaggccgtatatttttgtagaaacggattcatatcaagataccctcataaatgaactaaaaagtttagtttcaagattcatgggcaacattacccgtggaaaattatagaaattggcttgggtcaatctttttggcgtcttcatactcatgtcaatttagggggggatnaagtacaatcgccctttcttcgccggctttaacaatggntaagaaattt

SEQ ID NO: 93552 - DNA, 513 bp, Triticum aestivum
  unsure (1)..(513): unsure at all n locations
  Clone ID: PAT_TA_93552
ctaaatgcaattttgaaaatcgcgtatttttcctaaattcaaataaaatagcgataaanctccgaaataaaatcttatttgattttaacattaaatcctcaatatttctttattttgggaaagtcattttattccctctctcatatttttataatagaaataattgaagataaaataattaaaatcgaatgatcctattttcaaattttgagaaaactcaaatatgaaaataacgaaatcccanctctctccgttggtccttgagttgcgtagaatttctaggatctaaatcaaaatgcaataaaatatgatatgcaatgatgatctaatgtataacattccnaaattaaaaaatttggggaatgtnacaaaaccntacccccccttaaagatgaaatctccgccctccgaggggggggggcccgggttacccaaantccgcccctaatagtgaagtcgttantacgncggcgctnactgggnccggtcggttttacnancggncggngaccg

SEQ ID NO: 93553 - DNA, 498 bp, Triticum aestivum
  unsure (1)..(498): unsure at all n locations
  Clone ID: PAT_TA_93553
ctcgtgccgaattcggcacgaggcggggcggactgcgacgagcggaggcagccgccgccgggcgcggccgccgttcctagcacaggtcactgctgaaccggccgcaacccatcatcatccggccacaggagctcgccgggagccgagttgattgggggtaccagctgccgcatacatggaggaggagacgtccgcagatccaacagccgcctcgtcctccttcgtctgctcctcctctggctgcaagctctgctgattcctcntaacgcgcccgtgggaantctctgctgattgcgcacaangtggctgcctggggcttgggtatggtggggcgcccggcgaagggggggtcgcgcttggcggcaancggcggccggggtaanccggnnggggtaanccgtttncgttggnccgggagcaaanggtgnagggattccttcctccttctagcaagggaaaccccccgacangntcaacggggnatgttgctttcnccnt

SEQ ID NO: 93554 - DNA, 297 bp, Triticum aestivum
  unsure (1)..(297): unsure at all n locations
  Clone ID: PAT_TA_93554
aattccggggaacccctcccaccggcgacgactaagacgaggnaccgccggcaatcatgtgcggaggggcgatcctcaagggcctcaaggtccccgcnccggcgcggnangtganggcggntgngctgtggcccgagaagaacaagcccaagcgggccgacagcggcgcccggcgcctcgcggggntcggncggcgtggggggcncgggctggacgacntgngaggtgggncttcgaggcacgacttcnacagagttcnaggggcgantcccggggaactccgnacaagagancatc

SEQ ID NO: 93555 - DNA, 489 bp, Triticum aestivum
  unsure (1)..(489): unsure at all n locations
  Clone ID: PAT_TA_93555
ctcgtgncgaattcggcacgaggcacacaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcgganaacggcggctgcggctgcacccagtgcaagtgcggcaccagctgcggctgctcctgctgcagctgctagatngatcatcgaccatatgcatgcaccgtgccgtgcgtgcatcatcgatcatatcgatctactactaccataccatgtaancgcaaccctgantcgagggcctttaatctatgcacctggaccctgcnttanncaagtcaggggccaanccatgcatttgtanaacn

SEQ ID NO: 93556 - DNA, 486 bp, Triticum aestivum
  unsure (1)..(486): unsure at all n locations
  Clone ID: PAT_TA_93556
ttctaccaccgcaccgcacgagtgaagtgagagctttgcacgaaaacttcatcaagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggnccctgcaagaagtactgatcggttcatgccggcatgatatgttccgcctaaaataaaataaaagctcaagcgagatgagcancgtcatcgtgccctatgcgtgtgtgtgtgggcaaacaatgcttaaaccaantaagtccgtctcttccntcgctgtggntttttctcccnnn

SEQ ID NO: 93557 - DNA, 478 bp, Triticum aestivum
  unsure (1)..(478): unsure at all n locations
  Clone ID: PAT_TA_93557
aggtcacaatcaaaaataaattcccaattccggtgattgaggatttattggatgaactgcatggagctaaagtattctctaaattggatctaaggtctggttaccaccaaatcagaatgaattctgaagacgtacacaaaactgcttttcgaacattcttgggtcactatgaatatttggtcatgccttttggcttatccaacgcacctggcacttttcaagctctcatgaattttctctttgcacactacaatagaaagtttgtgttagtgttctttgatgacatactcatttttagtaaaacattagaggagcatgtggatcatttagcacaagtgctcanaattctcaagagaaaatgaactatacgctaagttgtccaantgtgtggtttgctgttgataaaagtgcaagtntttggggacaatgtggggttcctggcgaaggnggtggctacaagaaccctggaaaaagatca

SEQ ID NO: 93558 - DNA, 182 bp, Triticum aestivum
  unsure (1)..(182): unsure at all n locations
  Clone ID: PAT_TA_93558
agctcgtgccgaattcggnacgaagctcgggcgctaactcgcgctcgccanngcctccgtcggctccctcaangggatgttcttcctgacgctgacggggggcgcgggncagcctgcacccggcggactgcggcgtgggggaggtctgcgaaaaaggcaactcctancanntcgccgtcctc

SEQ ID NO: 93559 - DNA, 474 bp, Triticum aestivum
  unsure (1)..(474): unsure at all n locations
  Clone ID: PAT_TA_93559
tctcantctcctgccgcggtgcgccgtacgtgctctctanccaagatgtcgtcggtcagtgcccgcgctcccgtgggcgctctccggccggnggggtcagcgtcgagcccccggttcctgggcgactccggccgcgtcggnctcgccaagtccangcnccgcgacgtcgccgtccangcnaaggggtcgtgggtccccggnctcccctcccctgcctacctcgacggnagcttggtgggtgacaatgggttcgacccgctggcgctggcggaggacccggaggacctgcggtggttcgtgcaagcggagctggtgaacnggcggtgggcgatgctgggggtggnggggatnctnatcccggaggtgntgaccaaagggggggtgctgaacgcccccnagtggnacgacnccggcaaagagaaactaatttnctcctcctccaaanntcttcgtcaatcgaaggtcaacctcctt

SEQ ID NO: 93560 - DNA, 490 bp, Triticum aestivum
  unsure (1)..(490): unsure at all n locations
  Clone ID: PAT_TA_93560
ctcgtgccgaattcggcacgagagcgtctcatctttgctggcaagcagctcgaggatgggcgcacgctcgctgactacaacatccagaaggagtccaccctccacctggttctcangcttcgtggtggcatgcagatcttcgtcaagaccctcactggcaagaccatcaccctggaggttgngtcctcagacaccattgacaatgtgaaggccaagatccaaggacaaggagggcattcccccggaccagcaangnctcatctttgntggcaagcagcttgaggatggncgcacccttgcgggttacaacatccaaaangagnncaccctccaccttgtnntccgccttcgtnggggggatgcaaatctttgtcnngaancctcactgggaagaactatcaccttggttggtggggtcaagntgacaccaacnacaacgtngaanggcanggattcatgcacaanggangggnatccccccngnnccaac

SEQ ID NO: 93561 - DNA, 208 bp, Triticum aestivum
  unsure (1)..(208): unsure at all n locations
  Clone ID: PAT_TA_93561
tacacctttccttagcttcgaaanggcttanctagcgatggagtattcgnngangatatcaatttgtactgctcgtatntctcgcgtcngccattggcgggcgtnacngnccacganctcgccgaaggacttcgtgggttccccacaacgcaagggcagcgccngcntcttgtgttgggcccgagtgacctgggatctatcancggtg

SEQ ID NO: 93562 - DNA, 166 bp, Triticum aestivum
  unsure (1)..(166): unsure at all n locations
  Clone ID: PAT_TA_93562
gtgtataaaaagtcaagaagcttcccctctcgacgcttgttactccgattcnaaccaccgncngacctcaccgcccggaaantcnattggcctaaacctcctccctcnacttctcnaagnacctcttcntccccaagcccaaccgggccaggcnttcntcntcaag

SEQ ID NO: 93563 - DNA, 471 bp, Triticum aestivum
  Clone ID: PAT_TA_93563
tgaagccactggccactgcacctcctgaagacattgtgcagtctgaagatatttcacgcatctccaagaagacggagaagaaaaagaaaatcatcaagagtactgatcagactttgactcctgctgctattctgcgtgaagagcacattgatctgtccagcgatgaggatcttgcagatgatgctcttgagcaactgatcaagagcaaggaagaagcagagatcttcaataatttgcctctctttgacgtggcaatcatccataacttcattgatgagtggtttgacacaccaaatatcaactttgatgacttgcaacttccaattggcctcagcgttgccttcaatggtgccattgcttctgagctagctattgctcagcgcatcgtcgaactgaagcacaaagattgactatgaaaaggctcagttcaagaatcatgtggccacgctcaacgtgcaagatgtcaaagaa

SEQ ID NO: 93564 - DNA, 482 bp, Triticum aestivum
  unsure (1)..(482): unsure at all n locations
  Clone ID: PAT_TA_93564
ctcgtgccgaattcggtacgagcgacaacgtcaaggccaatatccaggacaaggagggcattcccccggaccaagcagcgccttatcttcgccggcaagcagctggaggacggccgcacccttgccgactacaacatccagaaggagtccactctccacctggtgctgcgcctgcgtggcggcatgcagatcttcgtgaagaccctcacaggcaaggaccatcactctggaggttgagagctctgacaccatcgacancgtcaaggccaangatccaggacaagggagggcatccccccgggnccangcacgcgccttatcttcgctggncaaggcagctggnaggatgggtcgcacccttgccgaantacaacatccaganagggagtccacccctccaacctgggtgctccgccctgcgtggtggcnatgcatcaatctttcgntgaaagaacctcaaccgggcaaagnccnattnactc

SEQ ID NO: 93565 - DNA, 454 bp, Triticum aestivum
  Clone ID: PAT_TA_93565
ctcgtgccgaattcggcacgagggccaaatcattaccatctcgtgcccagttagtaggctacaaccacgccgttgccgggcatgatggcatcctttgtgatgctgacggcgaactattaattaaaccgtgcacttcaactgaaatcgacttttacgaaacctcaatcgcattctatcctgaattcgtggatttgatgccaagatttgtcggcactctatctttgaatgaccaaatccctaatccagccatcaaggaagacgtcacaaatttacctccacagccaaatcagacgagtatagaagaatcaatcgaatctttacaacctggtgggtcgacgaataaagatttcaactttatccctgaacttacagaaggtccatccctccaatgcatggctaacagcacatctggccatcggatagcaacagataaggctgtggtacttgaaaatgt

SEQ ID NO: 93566 - DNA, 353 bp, Triticum aestivum
  unsure (1)..(353): unsure at all n locations
  Clone ID: PAT_TA_93566
ngctcgtgtcgaattcggnacgagatttcacncagcacctacgcatgcaagagacaagcaaacttgnccctccggtcgagcanccactgccagccatnancgcgccgcacctccacctcgccgccgagcacccangcatcacnnatgccgcccggccattggaggtggtagngctgttccccgnttgngtgttcaccaaaggggcgtgcgcgncgtcactgggccgcccgcccgcaagtatccangtctctgncagngacngggtctaagggccgtggcgggcannccagggtcccaatgggcaacgncattccgccctccgtntcgtggttcctggtngacgncctttcggc

SEQ ID NO: 93567 - DNA, 475 bp, Triticum aestivum
  unsure (1)..(475): unsure at all n locations
  Clone ID: PAT_TA_93567
ctcgtgccgnattcggcacgagatttctgattgcaagtantcagtgcgcnatttctctcgtcacncaccagccancgaattcaattacggntttaaggctaattagcagtcacgangctaactacaagactctgaaagtgtgattaacaacanataattgcaaattaagtcaactgccatgccanatcgttccgacgtgacatattttggggctggaccggcactgccttcccanaggaaattttanaaaatgctgcaaantgcgttggtcaattttnaaaatacaggacttggtcctgctgaacactctcatcgctcagttcttgcccacgngaaatttttanactcangggccaaaagcaagaccttggcaaatttcctccaaggtcccctgaataacctacgnacaatccttattcaatncacggcccgggtggtacngggcgcaaatttccccggcggagcaatcctaacg

SEQ ID NO: 93568 - DNA, 480 bp, Triticum aestivum
  unsure (1)..(480): unsure at all n locations
  Clone ID: PAT_TA_93568
cgtcaataacactggngaagctatggattcaatacctattaaatcccgtacaaggggcccgcatcttccgaatatatattccgngaatctactcatacattaaagttatcttacagcagcgatattcacatcttcctccacgccaattgcacttccttcaagttccaagttaaaaccggtatgacatcaacagcaattagcacaatggacagtaaaggagaaaaattcttgggacttccacatagtcgagatacacgaaagttttctgagtgaaacttttggtaatggacaagcgtatcaangaggttcaagagtggccttatgcgttcaaaanatacagtacangaactcncatcctgttgaaaatttcaatgtcccgggggtccnaacacangcgcaangnatacagcccgntagaagtcgggtacttcctaattccgagaaaaaagggagntcctacgaagcggcacccccacgcgt

SEQ ID NO: 93569 - DNA, 396 bp, Triticum aestivum
  unsure (1)..(396): unsure at all n locations
  Clone ID: PAT_TA_93569
cacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcngccgtgaactaccatggcaagagctccaaggccaacaggttcacagtcatggcaagcgggaaacatcgacgagaagaggaacacagacaagtggaagggtcttgcctacgatatctccgacgaccagcaggacatcaccangagggaagggcatcgtgggactccctcttccangcgcccaagggcgacggnaaccaccnagggncgtccctcagctcctacgaggtacgtcaagcaaggggactcaaagaagttc

SEQ ID NO: 93570 - DNA, 480 bp, Triticum aestivum
  unsure (1)..(480): unsure at all n locations
  Clone ID: PAT_TA_93570
ctcgtgccgaattcggcacgagccaccgcaccgcacgagtgaagtgagagctttgcacnaaaacttcatcagaanccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgatcnacgagccccgaaatgtggcgctgcgcggaatatgaaatccaccggtcgacggcacctgcggtgngtaccctgcaagaaagtactgatcgggttcatgccggggaatgattatgttccgccntaaaaanaaantaaaaaggctcatgnngagaatgaagcaagcggtcatcggtgccttattgtcggtgctgntgtgtgggccaaacannggct

SEQ ID NO: 93571 - DNA, 473 bp, Triticum aestivum
  unsure (1)..(473): unsure at all n locations
  Clone ID: PAT_TA_93571
tccacacccccgcctcccacttcttcctcccttgctcggccggctccggcgactcctatccgcatgcccggagcccccatgcgctccttctcccccaacactgaccccctcgagtctcgactgaagcaaaccctagccccccgtgcgcctcgtgcaaatggatgcggggggtcctagcccgaagcggnggagatcgccctcgcccggtgtggaggaagacggaggatgcgccgactacatcagcgccctccccgacgccgtgctcggngacatcatctccctcctccccaccaaggaatggcgcccgcacccgaatccctcgcggtcncggtggcngctgacctctgggctctccgcccctcttaaatctcggactgcncgntgaagcttcaaccggcctggcaagggaatgaaaagttccgccntctggacgnttcgatcctcgncggcaatccatttcctccncaaacngg

SEQ ID NO: 93572 - DNA, 513 bp, Triticum aestivum
  unsure (1)..(513): unsure at all n locations
  Clone ID: PAT_TA_93572
atgcgtcagacgtctttaatttcaatcctactaatcttgacccgcttacagagacttatgacctgaacttttacttctcttatctcgctcgatggcngcatctctttaccgtcgcttctgggncggntgaaaagattaatgcttacattatgggcaagctagagtcatccccagcttttgtcattcattctccgcactagcttccattccatgcccacatcacggccttgacgggtagcgccacacgcacgtcgtctanggacctcgcacgnaagcgctctcaatcantctctagaaagtcgagcncggnagaatagcctattgaagtgccctgggttcggtcggaatctccttcggtacgnaaagggggcaaaatgtccggtcggcgncagggcccttataattcggtgggcnctttgggnatacaagccggctaattcccggttannaggttaaaaaaggnacntatttaacaagnttgnactcganttggtggnttgngggtcnacgggg

SEQ ID NO: 93573 - DNA, 506 bp, Triticum aestivum
  unsure (1)..(506): unsure at all n locations
  Clone ID: PAT_TA_93573
tttttttttttgtttaaatgaatgtgttgatatttgatacataagctgctattagttattccaagcctctaaaaacaagtatacacggcgcacatcattcgttattagtaacttatgaagtcttgggaggcttgccgaccaatttcacttgctcttcaaggctctcttcatcagaccatcgatcaacatcgtccccaacagcaaaaatggtctctccttccatactttctcgcacgatatcttttacaggctttcttgttcgagaagctggggaggctgggatcgtatctcgggaccttcctgtctagtttgatgctgggacccctttatgaattgantganatcatcgganaaatcatcgccggtcggtcatcggggcgtcccaaanatcaaggctaattttcaanagnccctttcaatccgtcctttggaggccaaaattcaatcggcctcaatgggccgaaaacccctcctttggtttggtttctcctggntcggggcctcnc

SEQ ID NO: 93574 - DNA, 479 bp, Triticum aestivum
  unsure (1)..(479): unsure at all n locations
  Clone ID: PAT_TA_93574
tggccatggacagcctcaagaatcactcgctttagacaagttctcaaattcattggttttcgaggagagcaccaagtcacgcctcgttcaacgaagaagactattattgccgtccaggtccagatcccccagtatcctttgactcgcaagatcttggggctgcactgaagggcttcattgcgacgatatcaaaagccaaagccatatagaggatggaggacattgtcctatgttataggatggatattctacaccaaggaggatgggccgctcagaagaggaagaaacccaggaaatgatgattttcatttgcctgtgggttgattagttaaaaaaattgtgaagatatagatgtgggagggggaaaggcaaagcangttacaaaatgaggtgggtgggttacccttttgggagtcttttaatttttggtcgcatgtttttgcctggtgttccccaagccggttttatctggcngccgg

SEQ ID NO: 93575 - DNA, 485 bp, Triticum aestivum
  unsure (1)..(485): unsure at all n locations
  Clone ID: PAT_TA_93575
ctcgtgccgaattcggnacgagacagctttanagctgctacaataaattcttcctatgtttgtaattacaagatgaattttaagccatgcccaactccaaggaaagacataagttatgcgtaaaaattgacagtatccttcttctttgcctgcacttctgctatggcatcgacatagtgctcatgactaattttgtttttccccatcctcaaagcaagtcattcctgcttcgacagaaactgctttggagttgagcaccaccgaattcatctgtacttcgtgctaattctggccagtttacaggcngtcgtcaaactggtcatttttcctacctggttgggattttgagggatctgagcccggagcctcttcgttttgggcangaaggaaaactcaaatttttacgggtcctaagaacggccaagaaccggtaacttaccnccggngaatcaaanaaacggtncaaatttcgggggtgggggggg

SEQ ID NO: 93576 - DNA, 448 bp, Triticum aestivum
  unsure (1)..(448): unsure at all n locations
  Clone ID: PAT_TA_93576
ctcgtgccgaattcggcacnaggncaaaatatcgctcggagcgccgtgatggataggcccgctgcttaccgaaatgcccnangggtcattcgtgctcttcaatctggaggagttttggnaaaggccttctgnactgnaactcctccatttaaccagggttccangcttacagcctttcgacnttagttcatganaaaatacctgnnacgcngatagncatactctgccgcagctgcacgtatgaataattngacaagttcaanctgtaattgtgggctgctgatcgtatanctgcaaatggtgacacctgccaacacnattggcacatacaacctctcaatttctgnaaangnatcatcgngcgtgcaagtttttacntngccccgcaccangtaactttcgnattgntnctctccccntcccgtcnggggaaagnaagatcggtcac

SEQ ID NO: 93577 - DNA, 444 bp, Triticum aestivum
  unsure (1)..(444): unsure at all n locations
  Clone ID: PAT_TA_93577
ataccatcattcgcactgaaggcggtaattgaaattgaaagacttaaaactcgcgaaatctacgacaatataatggctgatgtggagcgtcaatatgcgctttcattattcaagactaaattgttagagtcaagagaatgggaggccaagcttaagaatctacgattagagatcaaaggattgcagaaggaattcgacaatacagaagaagatgtcaaggctttacagagcgtaggacagattattggagaggttctcaagcaacttgatgaagagagatttattgttaaggcttcatcgggccctcgatacgtagtcggttgtaggtctaaagtcgaaaaagaatctttgnaacaaggaacccgcgtatcgctcgacatgaccactttaacaattatgcgaatgttgccgccagaagttgacccactccgtctacaatatgtc

SEQ ID NO: 93578 - DNA, 242 bp, Triticum aestivum
  unsure (1)..(242): unsure at all n locations
  Clone ID: PAT_TA_93578
ccagtctataaatctttccgcggtgcggtggggtgcgtacatncccgagtggaaaatccccaacggnacacnggganaaaganagaangaaccacaaatggggattngcngggtttgnngtngggggcggggaaggaaccgccaagggcaangggaagaaccttctggtaanggccgcgnggggtttnatcggaacnanaacggttgcctgnaacttgnttggaaaaaaggggtactccgtt

SEQ ID NO: 93579 - DNA, 525 bp, Triticum aestivum
  unsure (1)..(525): unsure at all n locations
  Clone ID: PAT_TA_93579
tttttttttttttggagtcaaatttatttcatattctatagagtcttgacgtttcactgtcagcttccagctctaaggaaattctgttttgtgtagttctataagttcctcttttttcgtgatcgagctgactcgacctaatttaaagatttaaaagttcttacactgactcctgtgaggtatccatcttcacgcaagtctttgaccaagcaagactcaatatttcaacgaccttaagccctctctgttagtgttcaaaaaaagtgttattacattcttcataggctcttccagcaccaaatcccaattccgacaaaggcaggccatgctctctttttgaacaagcanaaaccaggaagacgacgccaaagnccgangaccaaaggggaagaggtggctaagcaaangaaaganaggcaagcgatcccacttnctcaattcaaatangggcccccgctggacctgggccnggcttngatcggacnaaccgantncccgggncctaagnaagnctggccccccgnn

SEQ ID NO: 93580 - DNA, 586 bp, Triticum aestivum
  unsure (1)..(586): unsure at all n locations
  Clone ID: PAT_TA_93580
gggcggcgaagagaaacgggggtgagaaggggctcctctggaggctgccggaggtcacctcaagggaagctcngcaagatnggnccccccctccgggctccgggaataaaggctggnggcgcccggcgcccgggatccgggttccttccggngggtggcaanggattaanggttnatgggatttcccttggaacnaacttaaaggctttcgggagtttgggaggttgggcttgcgggtnataaggatttgggttttgggttatggctttggggcaaaaanggnaattgctccgtggattgaaaaaggaaaaagacaattcaaaacgtttggtaaaaatattccaaggaaaactcccaaaatctgcctaaagtaagtactgtatggggcaatgaaaataatttaaaagggaatttgtgcaaacaagaacaattcctataangtggctaatgcccnttgnttgccctaaacccttgnnaataanctaattaacccttttgaaagntttttactcctaagnttacaagtttgggcaaatgttaaaaaaaaaaaaaaaaaaaaaaccnncgagggggggggcccgggtan

SEQ ID NO: 93581 - DNA, 542 bp, Triticum aestivum
  unsure (1)..(542): unsure at all n locations
  Clone ID: PAT_TA_93581
cgctcccggcctctctctgtttgctctcgcgtccgccgcgcccatcctcgtccgcgcctgcgcccgggccgtgctcgctcgctcgccgcctccctcgcctcgattcancgcgccggcggnatggcggatnaagctcancgacnaccanatngccgagttcaaggagggcttcancctcttcgacaaggacgggagatggntgcatcancancaaggagctgggaananttatgcgttcgctggggganaacccaacggaggntgagctccangacatgattaatgaagtccatgctgattggaacgggcaacaattgactttccanagtttctcaaaccttgaatgggcccgcaaagattaaaggacaacttgaactcaanagggaaggaagctcaaagggagggcccttcaaaggtggnttcgacnaangggaccaaaaacngnttttaatctcctgctggcttgagcctccgccaatgttcaannacaaaacctccggtgnanaaagctcaaccnacnaanggaaggtnggnnccaaaac

SEQ ID NO: 93582 - DNA, 490 bp, Triticum aestivum
  unsure (1)..(490): unsure at all n locations
  Clone ID: PAT_TA_93582
atcatactgaccatgttatcctttcctggatgtcccgacagttggctatcgtgaatacgctgcattatggccgtcttcaggggctcgtaattaggcacccaaattctattttccctccctcgaagaactccatctgctgctacactgcactctgctatgttggcagacaacttgtacgctaaatctggcggaaatccgcgttcccctgcttgcactgcatcacgggcacgtctccaatctgcatcaatttcaacaccaatcttccacaatgtctgtacctcatcatcgtcaaataaccaaggctgaagatgcccgatcagcaaattcttgcagattatcttcaaccccctcgggtcctaaaacaagctggaagtacgtccanactaggtttggcttggatctcctctagacaaagcaaccgggtcgctcaaaattttggtcctggggncgccaattaaattttatactggaaactggttggaaaaacatc

SEQ ID NO: 93583 - DNA, 213 bp, Triticum aestivum
  unsure (1)..(213): unsure at all n locations
  Clone ID: PAT_TA_93583
ctcgtgccgaattcngcacnagccggntgctcctgttctcgccgcanncancccttcagcttccgcttccgnanggctggtncatttcccatccccgaggancgnagccggaacccccgggncttttctactcntctcccataacccanncntctggacctctccccgcatcacancgnctcgcangatcgcatcaacgcananggcaagccc

SEQ ID NO: 93584 - DNA, 466 bp, Triticum aestivum
  unsure (1)..(466): unsure at all n locations
  Clone ID: PAT_TA_93584
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaanaagttcgagaccctgtcctacctgccaccgctcaagcacggaggncctcctcaagcaggtcgactacctgattcgctccaagtgggtgcccttgcctcnagttcaagnaaggntgggtttatcttcccgtgaagcaaaaacgcaacccctgggtactaccaatngncggtactggacaaatgtggaaanctggctangttcggggtggaacgacgccaccgcaaggtgatnaacgaggtggnggnggtcaaaaaag

SEQ ID NO: 93585 - DNA, 571 bp, Triticum aestivum
  unsure (1)..(571): unsure at all n locations
  Clone ID: PAT_TA_93585
gctttctagctccacaagtgggaatgttgcgcggtgcaacaacgggtggnggngtaatccancaatcnatgcgaagggggtaagaacaagtangaaattttcctatgaatgtcngggtccccaaattctcccgcgaagtgtgggactttgggtgccaaccaaaaaatgggcccgttttggnttccgggacccggggcnaatgaatttttgttttaacaaacaatccagagaaaaaagttccggggggggcacaaagtttgggaanccggagcaaatgtgggggccntttggnaaaagggntcctaattcctttttctcanaaccaaattaatnggtggcccnccgggtttttgcaaacccaaattgaaaaggggggccctttttccgtngggggaaaaaaaggncaanaacccccaangggaaattnggcngtttgtcnaagtggtttggggcnanctgnacccctnagggcngggttcnttttccnaaaccctaaccccggggcccaaanattcccccgaaagtcccaancngggcaaaattcctngaaatggangggttgggtcaacaa

SEQ ID NO: 93586 - DNA, 531 bp, Triticum aestivum
  unsure (1)..(531): unsure at all n locations
  Clone ID: PAT_TA_93586
aaatactccttccccagctagggttttgctgcctccgccgccgcctcccgccaagcgtcgtccccccatggngctgccgaaccaaaacaccgtcgattaccccaagcttcaagctcgtcatcgtcggcgatggcgggactgggcaaaaccacttttgtgaagaggcatctcactggagagtttgagaagaaatatgagcccactattggtgttgaagttcacccattggntttcaacactaactgtggnaagattcgtttctactgctgggacactgctgggcaaagagaaatttggggggccttaagggatggatactatatccaatgggcaagtgtgcgataaatcaaggtttggatgtcacntcaaagggctgacatncaaagnaatgntccctaacgttggnacaagggacnttgtgcaangggtggtgttgagaaacaatccccaattgtccctgtggcggggaaacaaaggggtggattgtgaaagaacaaggcaaggttaanggccaaancaaggtgaanattc

SEQ ID NO: 93587 - DNA, 527 bp, Triticum aestivum
  unsure (1)..(527): unsure at all n locations
  Clone ID: PAT_TA_93587
ctcgtgccgaattcggcacgaggagaaacacagagcaagaagagaagagagaagcaaagcttgagatggcgcaaaccatggcgtccatgaccggcctgtcccanggcgtgcgtctcccangcccggncggcangcgcgccagcaggttcatcgtgagggcgtcgtcggcggaggcggaggccgccggccgccgcgcggtccttggnctcaaggncaagcggagtcntcggcaagcgcgttcgctcaagtggtgcacgccggcaacgtcgcgggcatcaaaggttgggccgccggccggccgctctccggtggactccccgggaaacggacaactcccgaccaaggcaaagggaatttcgaccttgcccttgaaaaaaccggttttaacctgcaagccgcttgccaaccgggnggaaggcgggcggtcccgggccaaaggaagtccggccaaagaacaattcttcaaaccttcaaggccgcttaatcgaacaangaaagcaaattgggccgttacgttcaatgaaacg

SEQ ID NO: 93588 - DNA, 515 bp, Triticum aestivum
  unsure (1)..(515): unsure at all n locations
  Clone ID: PAT_TA_93588
ctcgtgccgaattcggcacgagcctacggggagaacatcttctgggggccggccggcgcggactggaangggggggacgcggtgaagctgtgggtggncgagaagaaggactacaactncgggtccaacacctgcgcgtcggggaangtgtgcgggcactacacncangtggtgtggcgcgcgtccancaacatcgggtgngctcccgtcntctgnaacaaaaaccgnggggtcttcaacanctgnaaataanaacccgccnggaatgttgttggncaaaaaccaanccaactggcantggttcncaatacaataaagnncaatngtcccctcnttccctggatgggaagnaccaatgccanggtttaatgcacggttcctanctactggtanctannttagangggntnattaataaaanggaatgccgttacaaacaattttnttgtccaatcaatgggccaannaataaattaatnntgaatttttacggnacctngaaanaatattttaan

SEQ ID NO: 93589 - DNA, 500 bp, Triticum aestivum
  unsure (1)..(500): unsure at all n locations
  Clone ID: PAT_TA_93589
agcagctagctagctacgagtatctgcatagctagctggctagcaagctagatactggtgctatctagctccttctagattataacctcaccaagctatagctgcatctgccctgcctgcatgcgagctggctaactgagcgctgctgcctgcatacagtacagaccgaccctcagctagctagcaatagcacatggaggatgacaagaaggagggcaagtaccgcggcgtgcggaagcggccgtggggcaagttcgcggccgaaatccgggacccggagcgcggngggtcccgcgtctggctcggnaccttcgacaccgccnaggagggccgcgcgcgcctacgaccgtgccgcattcgcgcaaaagggggccaacgccatcctcaacttccccggcgagggtgggaangaagaatggggggtcttcttcntcngtcgggncgccgcccaaagagggccgcgaanaaaggggcgtcccctaaaaaggngaaanggtggg

SEQ ID NO: 93590 - DNA, 495 bp, Triticum aestivum
  unsure (1)..(495): unsure at all n locations
  Clone ID: PAT_TA_93590
ctcgtgccgaattcggcacgagaaattactaagactttaaagataatcggtgacagtggatctgatctttgcaaatacttgcttcagagtatgaagaggtgttcaatacacagggttaatcattaagcggntaggcgattaacgaaacgttcgatctcaatcggatttaatttctcgaagttcgtttttattaataatttgaatgcgtctggattaactccccaccggtgaggcagactcaaccgtacgttcaaacgccacccaaaccattccgaatcccatacacatgtagtaaaatcaagcctagtaacttttgcaactttcaggaaaacttccagcgattgccacaaactgtgcattcacaaaaagtcgtcataggttcatcggcagatcgggtctgagcttgactgtaactgacttttttctgggcacatttgccacacttcaatgcatcactgatactcttttctgccattgaaactcnagggggggccc

SEQ ID NO: 93591 - DNA, 418 bp, Triticum aestivum
  unsure (1)..(418): unsure at all n locations
  Clone ID: PAT_TA_93591
ttgcaatccaagtagaaatacagcaagggaggaagcacagagtcgaacgatcgaggatggcgaagaagaactcctctgcgacctcggttcggctgatgctgatcctcctgggttttactggttttcgttggaggcatcctcgcacgaggtgggccgaccacctgcagcaaccctgctgctcagcgaaactgcccgccgatccgtaatggcggctcataagcacaacatggagcacgaagggtttaagtaggctctcgcattcgccggcgtcgattttgttctgaaccgaataatattgtatgttcttgatgcgtccattgttgtgtgtgtgttgatgttccccgtatttttgnttgtattgnggcctgggnttaaaaataaatangtactacaatgagtcgggaagttctcttgccaa

SEQ ID NO: 93592 - DNA, 355 bp, Triticum aestivum
  unsure (1)..(355): unsure at all n locations
  Clone ID: PAT_TA_93592
cgatcacctcncnggactccggcttgntcttgnaagacgctgagcgtgatgttgcccgtggaggaggacgcgttcttcacgttctccttggacaactcctcactcgactcctctgcctccggngggtagcgacacggtgttgtcgtatccaatnnagncacaacggtcctttgggtcnaggaaagacgancccctgtanctgggcatcactgaagggncgcctgaaagctctcgggncttgccggtggngaanagctgccatgncggtgaanaggaangggnaacgctctcgcctcngnnggaagctgtnanggtggncnggccgcgtaagcccngatnnacgttccttnccccc

SEQ ID NO: 93593 - DNA, 574 bp, Triticum aestivum
  unsure (1)..(574): unsure at all n locations
  Clone ID: PAT_TA_93593
gttcccccgaactcttcgctcccgttccgcgctgtccgtcacacacaggaaggngtccgccatggagctctccctcctcaaacccgcaatggaacaacaacgggaatcggcgggcaaagacgggctcccccctcccggttctccccgcgcggccggggnngccgtccggcttncgcgtggagggncgccgcccgcggggcccgcccggaacccgccgggaaagccgggctcgccaaagaaagcngggggaaagaacggagggtcaaacgaagtccgctggctcaaagccggnggctttctaaaaacaanggggactttcgaacgaagaatgggaggaaagcttatttcaaacgcccgangatttaaacaaagcaagctccaaaccaaaggaacgaatttcgaaccgcggcttggntgcaaggagttttaaagaacggggnctannaaaccaagaacccaattttaatncggcaaacccccgaagtttaaaagggaaaggnttgcccgaaaaaaaattggnaangggcccgggctcccggccaanattnttcgnccaaagnttccnccaaagggg

SEQ ID NO: 93594 - DNA, 495 bp, Triticum aestivum
  unsure (1)..(495): unsure at all n locations
  Clone ID: PAT_TA_93594
gcaaacttaacttcagtaatatacccaccacttcaaaagtctattcgtacacatcagagacatgcgatagcacctcgaccctaccgcttccagactattcttaccgcaaaagttgtgccactaatattcttcaaatttccaccaaatgcccttaagctttaggaagatcaagtcgtccattttccccgaacgtttaccagtatttgctgccgctaaaactcatcatgtgacggacgaggtagcccgtcaagctccttatcgggcccttaactcgtccaaaactttttcagataaggatgtacccactgatcactctgggatcgtcagcatcgcacgaggtagcatccttcagaacaccaaatgtatttgntaanaatcaccaaacttgccggatcaaggataacttttttatcaaatccttatcatggatactgntatggcngggngcttgggncctgtcctttgggcatgggngaataacntggcnaaatcgtg

SEQ ID NO: 93595 - DNA, 538 bp, Triticum aestivum
  unsure (1)..(538): unsure at all n locations
  Clone ID: PAT_TA_93595
ctcgtgccgaattcggcacgagctccggcggcttcgctccattgcacaccgcgcactcgggccctctccaccttctggatggcttctcctangctcagtgtgttcgcccgcgttgggctgcacggcggcgaccccaactggagcggctgtgcatcctgtggcgacctcctttgcagcatttgggaccactggaggccctcccttgcccagcagaagtgatggattttgtactattgtatttctggaaatgcgtattcacagaattgcaatctgaaggagcgatgggagtgaagattgcatgttttttttctttaagataccctaaatagatgaatttgcaagttagtccgtggtacctagaagattaaaagggttttcaagcaaggattaacttggggtncaaattaanctnccgtggaaangtggntggtgtaagtggttaagagaattaaaatcaacccaagtnggtngctttttcaaacagggngggcacaagnttacccccnattttttttttaaatggnntaaaaacaaccct

SEQ ID NO: 93596 - DNA, 458 bp, Triticum aestivum
  unsure (1)..(458): unsure at all n locations
  Clone ID: PAT_TA_93596
ggcgggcgagactactacagctacggcggcggcggtggcggtggcggctaccccgcgcagtaccaagcagcagggttactactacccgcagcagtcggcggcgaacatgcacacggtggtgcaccacgggtactcggatgaccccaacagctgctccatcatgtagcggcagcaatgaccagtggacgtctgagcgtttagcgggtcggtttgagaatcgatggatggtgtgtgcgccaagttactttccgattccatgtaattagtgtacaagagtgtgcgtttcttcttcttttttcctttcttttttcccgatgaagctgtgttcgtttcatggttgtgttgtgtgaatatgtatgtagctccaaggcattacatctacgcacggtgtgggaatgtaagcctaaagttctactcctccntattaaaaacaaggggaaaagcaaaatccgacaagt

SEQ ID NO: 93597 - DNA, 486 bp, Triticum aestivum
  unsure (1)..(486): unsure at all n locations
  Clone ID: PAT_TA_93597
ctcatcccaaagtcactcgatcgttccgttagggaagccagccaatcattgtttcctgacacatggctggcagctccagataacacagctgttccaacgcctacctcgcccatggttatctttccaccttctgggaagtacggtagctttagcaccaattacgaacgattttcggcatcggaaattaccaaacgctcggacatagaatctttcggaagaacgggatttattctacagctgatcgccgcaggatggcatcataaatcccctgaacagctaaaagagattggcgacaaggttggnagagaacggattatggtgatgcatggaactgccgataggatgatcagtgtccaccaaggcagaaaattgatagagtttcttcancctgggacaggnattattaaggaaggnactggtcacgtgttcaagggcgaggaatgtggataccaaaataagataatttgngggaatgtttcaaaagag

SEQ ID NO: 93598 - DNA, 482 bp, Triticum aestivum
  unsure (1)..(482): unsure at all n locations
  Clone ID: PAT_TA_93598
ccgttgtcgaacagagattttattttgctgacgtgtgaggctgttcctgaaagtcgatagattccctcaacttcgagtccgaacagatcaaccgcttgaatgcactgataaactaccatgggtactgcagaaccatctctttcagaaagccggttcaagctaagtccaaatacggggtttaggggaggtagatttgtatttctcgaatggccaacaaagttactgatagacgaagactgaagcggagatgataaaggcggcgttttcgaggggtgaagagaaagagaagagatttgaggtggttcggtggaggtaaaagggccagaatgattactatattgtgtcgtagatgtttgttgtacttccctcantggttccacgtcaagttgcgaaattgtaccaagacttgtaactctcncaagttgtttccttgaaaggaacgtttcttgaggataattgctgtgcactgggtgaanttttan

SEQ ID NO: 93599 - DNA, 196 bp, Triticum aestivum
  unsure (1)..(196): unsure at all n locations
  Clone ID: PAT_TA_93599
gtcgtgccganttcngnacgagctcntgccgaatcggcacgaggnccaaaacttccctgggatntcaattccaaattttancaacngcgacatnattaccctggnataggggatcaaagatnntnacacactcgaaatcatttcacatcntgtagggggncatttccgtaaanctanactaacaaatatcnacatg

SEQ ID NO: 93600 - DNA, 176 bp, Triticum aestivum
  Clone ID: PAT_TA_93600
gcgctctagctcccttccttacttcgcccaacaaattaaccggctcatgtccatttctcttgcccgtcgccggtgccatcgctctgggctgggattcgccatgagtagatccagccggacctcaggcggccctttttcagttccaagcaggtccgcgtgctaggtgcaactggtga

SEQ ID NO: 93601 - DNA, 486 bp, Triticum aestivum
  unsure (1)..(486): unsure at all n locations
  Clone ID: PAT_TA_93601
cttccctctaccaataagtccacgaactaagtagtgggttatacatttcaatacctttatcaattacttccattaaccatcacctgacttatctctatactccataatcttaacagtaacgccattatcggtatttgaggcgaggtggtgtagtaagattgaggtggaggactcgcgtgagaatgatagatccaacattgaggagaagtcgttgattttagatgtgcttgtgaggtctttcgactctaatctggatgcgaatcttcttggctttctcagatatgcagagtatactgagcgataacaccggcaccactggaaggtgaagatttcatctttgccggcaagaaacggatcatatctgggncttgtaaaattttctattcaattatggnattcancacattgttaaggctctggcaaaatctgactctaccccaataaccaagcgttgggagtgggaganaaatgngacaatcccnttnc

SEQ ID NO: 93602 - DNA, 290 bp, Triticum aestivum
  unsure (1)..(290): unsure at all n locations
  Clone ID: PAT_TA_93602
actcctgccnaattccgnaccanangatntgttctataagctcctaccgctgcatcctttaacaataaggnggnaagcacttcantctggntgatgcattctgacctcngggccaaaacgtgattaacngncangatttccctgatggggnaatccaatggctgtngangatngttcctgccttgctcangcctgtgnanggtggnccaaaagttgtntgacaaactancaaatcttttntttnaaaaaaaaaaaaaaaaaaaaaaaaaaaaaaaanaaaaaaaaaaaaa

SEQ ID NO: 93603 - DNA, 335 bp, Triticum aestivum
  unsure (1)..(335): unsure at all n locations
  Clone ID: PAT_TA_93603
ccacctccttccttgtngataaacctctgncgccgccggnctaacgggacaaaccacgatgggcactcatanagcaaccacggcggcgtggnccaacnaggaggacaangngttcttnaacacggtggnatccggtgnaccnccgccgctggncggcgtgccggaggaggactggttctcngcgctccccgcgagcgtgccggcgcggtcnacngaggaggtgcggcgccactacnaagncctgntggaggacgtcggcgcgattnntgccggncgcgtccccctcccncgctannccggggaggagtccacccctgccgccgcagcngggccta

SEQ ID NO: 93604 - DNA, 516 bp, Triticum aestivum
  unsure (1)..(516): unsure at all n locations
  Clone ID: PAT_TA_93604
gcacgagccgattcnaaatactccttccccanctagggttttgctgcctccgccgccgcctcccgccanngtcgtccccccatggggctgccgaaccaaaacaccgtcgattaccccagcttcaagctcgtcatcgtcggcgatggngggactggcaaaaccacttttgtgaagaggcatctcactggagagtttgngaagaaatatgagcccactattggtgttgaagttcacccattggatttcaccactaactgtggaaagatncgtttctactgctgggacactgctgggcaagaaaagtttggtggccttanggatggatactatatccaaggtcagtgtgcgaaaaacaagtttgatgtcacttcaaggntggacatacaaaaaagttcctaacgtgggaacaagggacntgtgcanggggtgtgagaacaaccccattggtcctggtgcgggaaacaaaggntgatgttaaaaacaagcaagtttagggcaaagcnangtggacaattc

SEQ ID NO: 93605 - DNA, 569 bp, Triticum aestivum
  unsure (1)..(569): unsure at all n locations
  Clone ID: PAT_TA_93605
ggcccaatccggaacaagganccttggggttcctttccaaatcaacnttggccaacccanaaacancagaaacccggttaaagtaaccantatcaaaagnnagaaggaaacttttcaaccctggcctccaacaatggaagcaatcaacccttttggaagccaagnagattcccgccacaaaaaatccccggtgntggggnaanctttcctggccagngntntacaacaaagtancnaaacaaaggctggggccggtggnaatcaaancncnaaggggggnttcccttggcnggcggcccaattgtcccccaaaccnncaaaaaagggccaaccaagacaaaatnccgnctccnccctcaaaacgaaaatttgnaaaagtgggaggntaaaatttggtggattaattccaaancgaanaaaaggggggtataaaagttaacnaaaattgnggggnggaagaatgggaacccttgcaagggggnggggggcacctggantnccgaangggaagggtttcaanaaaattggtcaccaaagtnantggatggnggaanttttagccccaacnc

SEQ ID NO: 93606 - DNA, 471 bp, Triticum aestivum
  unsure (1)..(471): unsure at all n locations
  Clone ID: PAT_TA_93606
tcccccgccccgccgatncgcgccgccgattccgcgcanaaagcgccgncggcgccgattgattcgcgctccgcggtggnctaaccaagttcccccanangtcgtggagccccccgctcccgggngtcgtnacgctcaactgnacngacagcgcgtncnantgcctcccgctctgccccggngccgantgncccgactaagccgcgcccccgccgccgccgntcccgctcgccccggtcgccgtcgaccgccggctgcccgtaagcctcctcctcaaacgtnttcctcctctncgncttnttcttcctctngctcggggtngccaagctcctcctctancgncggcgccgngccctgggccgccggcgccggggtgccancgcccaactgcctcaaaacgaaggggtttgcgaacgcgggancaagaaggaagcggaggccgangaaggggtgtgnaacaaatctggtana

SEQ ID NO: 93607 - DNA, 425 bp, Triticum aestivum
  unsure (1)..(425): unsure at all n locations
  Clone ID: PAT_TA_93607
gcncccanaaataatggntcccccgggcggaaggttttttttttttttttttggagttaataaaagaaatgatanattcatgntaaacctcnacaagggtattccccagattacgaatcaacgaggcccttttcaaaaanaaaatccttggncttggttgncgggnaaancccccgcggngaaaaaannccggccccgagtggtgggncagccttaagntttaaaaaacanctccttcaaaantggactgggggttccaagccccgcctgcagnaattaaaagggatancaaaaagcctttttacttggttcaataagttccaagatnaaagccgctattgggaacaacccttaacctaancagttaaagtaaaaattcaacggggccccaantggctcaantggcttggggcaagttccaacaa

SEQ ID NO: 93608 - DNA, 631 bp, Triticum aestivum
  unsure (1)..(631): unsure at all n locations
  Clone ID: PAT_TA_93608
ggggggggggcgctccaaaactanngggtttccccggggtgganggaaatccgcaaacanggtgcnaaaaaaaaaaatgtcctggcaanggntggcaaaggnaaatcacaatatgatntttattaaagacgggggggntggntgnccaangaanggangggggttantaaatgatcctcnntgggggcaacaacaaaaacttcctccntctcaatcaantgncgcnaagtcntcangttctccggggtcccaagggaggaccaaangtgngctntgctcaaaancaatgcngggntcttaancgcnggtggacnaacgccttgacttgtagggtanntcttcaaagntgtcaatgcccttcctcccctanccgatggcggctcaancctgtntccncccgaanggggatttcccncntcccaaaaatgtccaaancaatttaaccaaaaaangccccgggcctgaagggnnaagcngtcaaaggnggttgggccgttgtccaaagtttnttggtgaaaaaaaactggggggcaaatccngtactgggggtttggtttccncccnccttgatcaaccccngttgngggncaattgaaccttnaaaaattggctggaanaaggcccaaaattt

SEQ ID NO: 93609 - DNA, 170 bp, Triticum aestivum
  unsure (1)..(170): unsure at all n locations
  Clone ID: PAT_TA_93609
gggcgggcaaaaaattcaaagnggggaattccnggggttccnccgaacccgggccngggggngccgggggcccacntccgcgtnctggtgttccggcccgcggggntgcaagncaaacgtgggcaagggagnggangncgcaaaaacttccncggcggggggggnccgtg

SEQ ID NO: 93610 - DNA, 301 bp, Triticum aestivum
  unsure (1)..(301): unsure at all n locations
  Clone ID: PAT_TA_93610
ctcgtgccgaattcggcacgagnnttttttttttttttnttttttttttttttntttttctttttttnttttncaaanacctaaaactgnaattcanaagaaactatatgnagtccaacataaggggacataccgcataaccaaactcaaatgcaggangaanctcactccnagcaacctatttncagnacccggnaaaaaaggggggnnggganaaagtatttanaacnccattgtncaccaaaaaaatcanancatgggtnaaatnggccagtgngcacaactgagtacatggggaagg

SEQ ID NO: 93611 - DNA, 569 bp, Triticum aestivum
  unsure (1)..(569): unsure at all n locations
  Clone ID: PAT_TA_93611
gaaatgatgggggtgggaacgtaagggtcnttttaccccntatcccntaagccttctgatccgagtcaacctaactttcctacgggggtaangggactagggtttccccttctttccancaaggatnacgtngtactaaacctgtagtcctaaaaggaatgatggntcnaaagcttgcgttcaagtcctactatcttccgtaagttcaananntgatctcaagaancctgatactangatgatcgagtgggtaatgccaccaaatttgttgcatgtctcaaatcttttgagcatttaaaaagccgttatgttgcccnagtcatcccaaggttctaaaaaaatctgatggaattgcaaaatcctttccccctgggttcgatgttcctcctagtccaagttaaacaacaactaattggggagttcaagggattctaattaacctccgacaaaatatggttgggnggntatttttatgaaccctaaggtggccntaaggggaatatctaagntaaggctaanccaatgaatttggtggttcccaantggtgnggaantccngggcggtcaac

SEQ ID NO: 93612 - DNA, 515 bp, Triticum aestivum
  unsure (1)..(515): unsure at all n locations
  Clone ID: PAT_TA_93612
aaaactgctggaaaaaaaaacaatactttaggttactggtacntgccaacttcaattacaaagncgatnctggatcgtgtttcaaagggttaggnantagtanctgncaaattcaccantgncantcaacacgcacttttataccttgagcanctaagctcangggttacangncaaaaaaatgctgagtactggnttgnatctcaagggcaatcnttacgggtttgncggntcantcncaatgtcttatccaaccagaatttcttcaacaaagagtaacctgcaaacccaacagnaacaccaacaaccaatccaagaggnantaaatcaagggggatcctttttaaattaccggnggccntgggaaatantgngagcaagactgntcctcctttgggaaggcccncaatccaatttggaggcctggacaattttcacaagccgtggggtggggtgcaattgnaattgtccctgncaaataanccttgaccacnaaaggatgtaagncctgatng

SEQ ID NO: 93613 - DNA, 586 bp, Triticum aestivum
  unsure (1)..(586): unsure at all n locations
  Clone ID: PAT_TA_93613
aacaaggaaacaacaaggcaaggagagaanaganaagcaaagcttngagaatggggnaaacaatgggttcaataacgggctngcccaaggggttgcgtctcccaaggccnaacgggaaggcgcgccaagaagtttaaccttanggcgtcctccggcgggaggcganggccgncngnccgccgccngtccttngtctcaatggcaagcggagtcctcnggaagcgcgtttcgcttaagtgggggaaccccgggaacgttcgcgggcaattaaaggttggccaaccggccggcgctnttcgggtggnctcccccggcacgganaacttccgaacgaaggnaaanggaattncgaccttgccccttgaagaaaccggtttttacctngcangccgctggccaaccgggcgggaaggcgggcgggtcccggggccaaangnagtccggcccaaaggaaaatccttcaaaacctcaaagncngctcaatccgaaaaaaaaaagcaattggccgttacgtnnatgaaacgaanctcccgccttcaaaggggcctncctaaactaacgcttatnaaccttcaaanaaacgttg

SEQ ID NO: 93614 - DNA, 314 bp, Triticum aestivum
  unsure (1)..(314): unsure at all n locations
  Clone ID: PAT_TA_93614
ttccccggggntggaaggaatncggaangaggtttcttngccaacggcgggtttccctggagctcccaaccgcccgacgttnctnaacgccgggcaaagttngggttcatggnggngaaaaaaggttgttgtgaaactgggacgtgcaccacgacagggcanaaacanaanggngatgcangtcgtctccaccctccaagggatcgaccatatncccgttggncatnaaggaccaaaagattacgggtcatcggggaacgtccgaccccgtcgtcctcgtnnaaaagggntgngcaacaaagttncccaatggg

SEQ ID NO: 93615 - DNA, 495 bp, Triticum aestivum
  unsure (1)..(495): unsure at all n locations
  Clone ID: PAT_TA_93615
tttttacaaggnggggcaaaacaaggggctgttnggagataaggnccacgggaaaaggggatccttccttgncantcncatagccnccgatccttttcccctggntgggcttcntcnncgcctttccgggaaccccanccaaaaatttttcncaangaagcaaanctgggtagcacnaaaacgagtacnactttatactaaancnntggcaattaaaaagggtcctgagtaataaantccaaggntcctggcnccttatgagggtangcaactggtcccacantaantaagattttcaaacctaaaaatgnaaatagggnnaacatnggnaccaatttaattgggtggagccanaccggnaanancgggggtccaacaagnaatnataatccccaaggtccncattaatgngatgntttgaataatttaacaaaaacctacaatacngggctggaaatgggggggacaatacnnaaatgggncaaaatacgntca

SEQ ID NO: 93616 - DNA, 569 bp, Triticum aestivum
  unsure (1)..(569): unsure at all n locations
  Clone ID: PAT_TA_93616
tggaaggaatccggacaaanaanaaaaggttgacnaaggcccnacaccaacaacaatacattcaccaatgggtttaaggccgtccaaggggcntnatcnatcaaccgacaacccncaagctccttttaaatttnggaagaagcaattttcaatccattctaaacctggcganccactccaaacttgtncaatcaaccanctanaaaacgccctaatgaggnaagtcaagatgggaaccggacgtnttaaagagaggnaagaaagggaaaaatcaacnaggggatnncaaaaatnctcaatggcnaaaataanctaaaaataccatatttnaggtggaaaggtnagagtaaacnatgagatttggggactaaaatttatgtttccggggccatgganaatgtccaagggctccggccccttggtgggccnaaggttgaagggggaaattnttgctttcggngggtcaaaaaaanaaaatcccctgggaccgggtggggccttggcatnaatccaacaacaatgggttgaagttctgaangggggggcccgggccncctaaaattgggaac

SEQ ID NO: 93617 - DNA, 528 bp, Triticum aestivum
  unsure (1)..(528): unsure at all n locations
  Clone ID: PAT_TA_93617
caatttgggggatcaaaagaaaggttnttactgggancaaagatcaactggaaccggggataatccgggccttcaatccgcaatncccaataagggaacaacaatnaaagggcccactgggngttggggtgggggttaaaaaagtgcaagctatgggaataagtgtggaaagaaggggtaagaaancaatggncctancggcaaaaggcanaaactggacccaaccccctttggacaaaattggtcccctggcgggaaaaaagggcngtgggcgntggggangcaattanncaaatnttgcaaaaaggggtccaaccggtagngnacaataacgaattcaanactggatgggtaatagcttaaggaatcaattgntnnaagagtttggccgantttttccaaactcccctccgggaacgcaagccctggatttgtaatccttaacctnagnanacaantatcnaatcaactggcanaatggttttattggggttaaaaaaaaaaaaaaaaaaaaaaancncanggggg

SEQ ID NO: 93618 - DNA, 587 bp, Triticum aestivum
  unsure (1)..(587): unsure at all n locations
  Clone ID: PAT_TA_93618
ggggcagctccaaaaacttatgggntcccccggctngaaggtcctggccaaatccggancaaggggcggnaattgggcaatgggggaanctngctaatgttcnggnggactggacncaaacanggtggttaacganggtgggggnggncaagaanggggtaaccctgncccctatgtncgcaacaaccggattcnacaacaatgctcaanggggaagtgngtnaagttcaaccccttcaanncaacnggctggganggagtccggnnanggctaaacaagctcaatcaacgaacagggcaatatattaaagtggncaattgcaattttgtcaactcctgacaattggcttgggntttccctccccaattaaccttcctaattggtcccaaaaaataatgtntatgtccaaaggttcaatgtnacaaacaatggctccgaagaaaagcaatggctcntaatgttgaatngcnatccgggggggtaatgtttaatgcaacngggcgcaataatnattaatacaataatgtcaactatntnactttttaatgggtaaccaaangggaaaatatctccaacccgnccgtgc

SEQ ID NO: 93619 - DNA, 163 bp, Triticum aestivum
  unsure (1)..(163): unsure at all n locations
  Clone ID: PAT_TA_93619
ccccgtgntgnctcatctctccatctcccagagnactangcacacctccanccaagcgccctnatccctccatctcccctaagnaaacaaacgcngccggggcaaatccgnccgcccnttccggngnccccgtccggggnccgcccatnnccgaagcaagnaa

SEQ ID NO: 93620 - DNA, 560 bp, Triticum aestivum
  unsure (1)..(560): unsure at all n locations
  Clone ID: PAT_TA_93620
aaaaacgctggggaaaactgataagttacaaacaaaanggttaatccccttcaaatgaccctaaaaaaacaatttggggnaaagtccgtcaaagcaaaagaaaaagatatccagntgcagntactaaaatcaaggntgggggggaaattttaaccatccggccaactttggctcaaaattttccctaaccaagactaaaagctggctttggggggtacactcaacaagctccaaggcttttctatcctaaccaaacaatgttcctcgggtaagcccccccccttaatggggtaatggggtggtnaataagtgggagtcaattggcttccaagtgacaatttaanaagctccgtccgtggggcgggacaanggtcctggaagccacaagcaatccgagtttcctggtggcaagctccctggttataagaantgggttataatatataataatanataaaangcaaaaaactnccaantaagcntcccaaaccctcaaatggcaaaaaaaaaaaaaaaaaaaaaaaaccncnangggggggggcccgggacccaaantccnc

SEQ ID NO: 93621 - DNA, 190 bp, Triticum aestivum
  unsure (1)..(190): unsure at all n locations
  Clone ID: PAT_TA_93621
caatggcaacggcaagctccctcctcggctcctcccctncganaaacccaatcctccaaaacgncggcttnctncctggnaacanctncctctccgncaacgggtccgggccccgcaactggggcaacctccccggccccgaagaagggccgntccggtngaaacccaaggcggaggaagnggtaaaaga

SEQ ID NO: 93622 - DNA, 580 bp, Triticum aestivum
  unsure (1)..(580): unsure at all n locations
  Clone ID: PAT_TA_93622
cnaaaacaanggntccccnggccgcangattcngcacganggccctgcaacccgacattgaagttagaatggnacttnancatcaaattggggaagacantaaggngaagcttnttccncncgccgttgattggntcaccggtgaaagcactacagtttgnggagataaatgangatattgaggaaggngacnttgaagatgangatgatgaccaagatcgtgattttaacgacgatgacgatgaggagtcagatgaaaatgaccatactggnaaaccnaaaactganacggntggatgcaagcaaaactagttttaaaaccantttctgttcttggnggtcaagaattctattccatatcngnatcccaagaaccaacgcctggactcccacgttacntattggngcaaattgataggaatgggactgctccgtctgtgtttaagcaccaanggaatcaaagcacctanattaagccnaacttgcatgtaacctcaagccccctaatacntccaacgttcacaaatcaatgtttaagaaaagncgagttaggggcnaataatcaaaatngncaaacgag

SEQ ID NO: 93623 - DNA, 528 bp, Triticum aestivum
  unsure (1)..(528): unsure at all n locations
  Clone ID: PAT_TA_93623
gccgtttttttttacgcngggtgnatcnaatcnatatgggaacgcncaaaaagtacagggttaaggncctccactggtttacatgaagacttttttcntgaacttttacanaaataattgntatgagcaatcncactangacgncagtgaagtaaaatgnacgcnttcaatantcaaancgcacanaccntgngcaaaactaacagtgctggacaaaaagggtgggccaaggagggacaatgcaaaaacaaaggggctatgtgataatgcctcaagggggtcctcaattaattaactaagcctgcctttagtagcaagggnacattatatacgaatccaattctgncaaatgttaaaaattaaccaancccccatgcactacaaagatcntcaaagcnccaaccccngganaaaaaanggaattaattgcccngggggtttggttcaaanggacggggngncccaaacccccaaanaangggggaataccngggggggannaacaaccgcctatgaaaaggaanaacc

SEQ ID NO: 93624 - DNA, 479 bp, Triticum aestivum
  unsure (1)..(479): unsure at all n locations
  Clone ID: PAT_TA_93624
ctcgtgccgaattcggcacgaagagaaggtgcccatcatgcagcatttcctcttcggctcacttatcaaatgggaggattgaagctgataacctctccgcggtggaggccagtctccaggacagacactacaccacaccatgctctgcgagtaacgaagtacctaccctcctctgcgatgcaacaaagactgatgcacagcgatgctgctccatgtcagtacaagacggacctacggatgtttcactttccatctagggcaatgggcttctggctaggagatgtatgctttctgcatgctaagtgcagtgcagtgtantgtagtgtgtagtgcgttggttcatcacgccgttgctgtgttgctcgaattctgggacctgtccctattcaccttgcatttcacganggacaagctagttgtaccacctttgatgaataacgccctgtgttgagggcttttgatgtnaattactggngggg

SEQ ID NO: 93625 - DNA, 237 bp, Triticum aestivum
  unsure (1)..(237): unsure at all n locations
  Clone ID: PAT_TA_93625
ctcgtgccgaattcngcacgaggatacgtcntgcgtntgangcagtcccnctaaacctcncanaancccccgtgggcgaccaacccancccatccgcccccctcaccaaccctcggagtcggaagcagagccgcgatggacggcaccgtgcccaaactcgncgccccgaggcnggnggncgcngggccgntcccctcgcagtncctccgctccnncgcgctcgcctatcgccccctc

SEQ ID NO: 93626 - DNA, 543 bp, Triticum aestivum
  unsure (1)..(543): unsure at all n locations
  Clone ID: PAT_TA_93626
actcntgccgaattncggacganggcgggttcccctccgccatggtcctcnattaanaaattcctggtgaaaattcccgccgggctggngccggaacaaggcggngccnctgctgtncgcgggggtgacggtgtnaaacccgctgaancacttncggctcaagancccgggnctccccggggggatactgggcctgggnggggtggggcaaattgggcgtnaangngggcaaatccatgggccaccacgttaccggnattaactcctccaaaaaaaaacngggccnaaggncaatnggaccaaactnggggnggccgaacgccgttaacttcgttaagcttccgaanaaccgaaccaaaaattgggccgcccgcccgccccgaantccccttnggggnttanaattcaattccaanaacccgttgccccgcccaaaagcaacccccctgggggggncccttaaccttgggggcttggttccaaaaaattggaccgggaaaaacnttgttgctttaattggggcggtttattntccgggggccc

SEQ ID NO: 93627 - DNA, 458 bp, Triticum aestivum
  unsure (1)..(458): unsure at all n locations
  Clone ID: PAT_TA_93627
gaaacacagagcaagaagagaagagagaagcaaagcttgagattggcgcaaaccatggcgtccaatgaccggcctgtcncaaggcgtgcgtctcccaagcccggncggcangcgcgccaacangttcatcntgagggcgtcctccgcggangcgggaggncgccgggcgccgcgcggtccttgggctcaagggcaacggagtcntccggcaacgcgttccctcaagtggtggacgcccgggaacgttcncgggcaataaaggnttggcccgncgcccggcgctctccgggtgggactcccccggaaagggncaacttccnaacnaaagggaaangggaantncaaccttgcccttgaaaaaaccggttntnaccttgcaaaccgcttgncaaccggccggaaggcnggcggtncccgggccaaaggaattccggccaaagaaaaattcctcaaaacct

SEQ ID NO: 93628 - DNA, 491 bp, Triticum aestivum
  unsure (1)..(491): unsure at all n locations
  Clone ID: PAT_TA_93628
ctcttcctctccacaancacactgacgcacttccatggncgccgnctcctcctcgtccccccctcccagctccgcttcctcgcaccatttanngactttgnntggcgtgcgtctggtanggtggatcttgcgagaacaaaagcgtacgtcttggtttgtcggttaanggaggagctaaagctgtggtgtggggtggagctacgtgggggaacaccatgaggcgaacnacgancttgnnggaggncgcnccgccgtccgtgttggtggtggtgttggtggacnangacnacgacnaccaagccaanngcggtggtgnaaagncgaaaaaagtggngccnccgggggggggaagactggctgngcggcccccanagcggcggcagcagggggccccccggacaagactggggtcctccgnggtatcnncacgccccgccgcggcccagngcgggnnggggggntcncnctgcaaacntcnncgactanctcna

SEQ ID NO: 93629 - DNA, 465 bp, Triticum aestivum
  unsure (1)..(465): unsure at all n locations
  Clone ID: PAT_TA_93629
gccgctgggcgtgtatccccttttcccacctcccggctctgacctctcaatcctccttcttgctttgaatcctatttaccaaaccatgtaatatccangatatttgagagtctatcgatctgatccatcttaggatcgtatcatttggtaccaagagccttcaaatccaccaccaatttttcttccgcggncgatctggcgccgaaaactancagtctgaaaganatnatggcggggactgatgtccanaagcagctggaggaanccgcggcggagcggagcggcatcnccaaagntcttctcgcgatncaaaanacgttggntntgatggcccccgccgtcncgaacatggaaccancggtcnccaaaatggagccggggctcgcctccttggagccannggggcaagatntggnggggtggcgcccccgtgttggtactgggatggggcaattcacgtntatt

SEQ ID NO: 93630 - DNA, 413 bp, Triticum aestivum
  unsure (1)..(413): unsure at all n locations
  Clone ID: PAT_TA_93630
aaaatgaagcagaggccgagtcaaatggagcacaggaacctgactaagccaagagcgcgccgtcggcggcgcgtgcaccggccggcgccgtcagctcgccacatctcccgcacatgctactgccggccacgacgactaccacggtgggcgccgccgcagctggctgtacctgcatctgcatgggcgtgtcaatcatcgatggagaggcccggcaggacgggcacgangcgcgcgtccggagccaagcgtcgacgcangcgatgtgtaagccgtggccgcatcctgggagcacgcgcacannctccccgtcggcaaattcggccaggcatatatcacactccgacgacgacgaaggcgccacnaaagagaccggggggaaggcctccaattgccctttttctgaagcccccccc

SEQ ID NO: 93631 - DNA, 335 bp, Triticum aestivum
  Clone ID: PAT_TA_93631
gcagcagagttcacaagcctgttgtaactgcattggctgatccatgtggaccaaaaaagcgtgtagtcgccgaaaacggcaagattctcgtggttgattcgtcaggtaatgtttaccttgaacaaactgatgaggaaggtgaaaatgaagaaatacttcttgatccgaacgaactgatacgcccaacttttctcgacacagcactctgtcgtcttcctatctgggcctattctagcatttccaatagatttatgcaactggctccagataaagaagtacatgatgtcaaatttagcgttgattcaccagcagttactagcagtgataatgactgt

SEQ ID NO: 93632 - DNA, 483 bp, Triticum aestivum
  unsure (1)..(483): unsure at all n locations
  Clone ID: PAT_TA_93632
tttttttgaaaaatgtaaagtaaagtggtattgatgaaatctctgctcctcaactcctctccagcagtgatgctatatacccatctgaaactatttcgaggagagattatcttctcctcgtttcccaaaattacatatgaaatatattacatgtgttgaagatcaaaagatctcatgttagagctttgactatcctgaacatcctaatcatcctgaacatcctagtcatcctgatcaccatatccctggtgagatatcaaagctcgagttagttaatctgacaagatgtgtcatcccactatccaatgattctcattaccatattcagtaggttccaaaccatcagatgtttggcagaaataaacataagaaagcaataaagtggtttccaaacaaaatcgccctgcgccctgtcctattnttccaagcaactggnntactnaaaatangccactgggtacccccanggggagcgtaatgatc

SEQ ID NO: 93633 - DNA, 388 bp, Triticum aestivum
  unsure (1)..(388): unsure at all n locations
  Clone ID: PAT_TA_93633
aacagggatgtgcgcagccanttccctctggncncctgggttcntgcagangcccggtangantntgcacaagcttcttnaacaagaatacatgnncanactgctggctaacatattattgcncacaaatcanngggccactgcctccatctccaaaatnanacnacaggtcaatggngacgacaccnaatatgtctccactgaccancgggtcaccggattattcaaaaccncaaggnaattggttgtgattgatggngtgaatacacatgagttgttcgacgtactatctgccntctcctgggctgatggggtgggcggnaaaattatcaaaacgaaggggcattcaactgccaaaaaacnacntttntgnaaaatttggggaaaa

SEQ ID NO: 93634 - DNA, 427 bp, Triticum aestivum
  Clone ID: PAT_TA_93634
gttttttttttttttttttatttcgtttcttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgagcaagatcgcgcccttcgttacgagcttgtacacaggcttctaaagccactcgattagctgctgcaccaggtgcatttccccaaggatgtcctaaagttcctccaccaaattgtaatacagaatcgtccccaaagatttcggtcagagctggcatatgccaaacatgaataccacctgaagctaccggtataacacctggcatggatacccaagtccctgagtgaaaaagggggggg

SEQ ID NO: 93635 - DNA, 562 bp, Triticum aestivum
  unsure (1)..(562): unsure at all n locations
  Clone ID: PAT_TA_93635
cccggggtggganggtttttttgngnaaatcaatccacaacgcatggaaaatcaagtgtngctcctcnagttacanatancgtggaagcnantcanacctcaaagtaaaaaggaacnagctggatacatctnacaatgngggaagtncttccattaacaaaaactaaanngctgggcnaaatccaagtggaaggctaaccggttctggccacaaaggaactaaacctccnaaaaatttacaagacaattntgggggaanaattnatggncaaancttcaanaaaaattaacaaaagatncgatgtttaatccccaacaaccaacgtttngtntggtntcaacnaaggnttgagtgnaaagtggacaanccnaaacnttggtggcctggccaacgnctttggggcnaaattcaacaagatatcctcaaagaagtngacnttgggtttaacctcnccgggaacgaagggggggggcccgggtaaccaatttcgccctaanagtggagtcgtaattacgccgcgctcactgggccgtcggttttanaaaggtcgtgaactggggg

SEQ ID NO: 93636 - DNA, 484 bp, Triticum aestivum
  unsure (1)..(484): unsure at all n locations
  Clone ID: PAT_TA_93636
tctcactatccacaacgccccggacccactagatgccgggtcttggcgaatacgacaggtgcacgacgatcgagataattgtctagtatttttccgggctcttctcaacaatccaatgctggctaccagtcgggtaatagggcgaaggtgtgtataccacacggctttgacagctccgaatccaggctcatcacttctgccgctctcaacagcaatctgtcaacccttttcaacctctcggaatcgcccgtcgcaaatcggacgcgtgccgctcactattccacctgacgtaaagttcttacttgtccaacccccaaaatccaaatacggctcagtatcaccattgctagcacaacgaaaagttcaggtcgagggaccgcttggaaagctagcattgtctatacctgctttcgtcaatgtcgactatgacgaagagtacacgaaaagcaaagcgttnggtggtgnaaaataaagntatcaaaga

SEQ ID NO: 93637 - DNA, 351 bp, Triticum aestivum
  unsure (1)..(351): unsure at all n locations
  Clone ID: PAT_TA_93637
ctcgtgccgaattcggcacgagggaaaaccattgctcctgctaaaagaggtgttggnagattgattatggatgctgacagcctaccggttgttgtcccctttgtccatactgggatgcangacataatgcctgttgggaaacgtatcccaagaacangccaaagggtgatantggttgttggtgacccaatcaactttgncgacctgatggctgagaacantaacgactcccaacatatttctaaaagtgncctgtntnacaaantnaccnaaaggattgggcancnggtgcancaactcnanggggnggtcgacanattggtggcanaacaaaaagggcgagctccaaaa

SEQ ID NO: 93638 - DNA, 352 bp, Triticum aestivum
  unsure (1)..(352): unsure at all n locations
  Clone ID: PAT_TA_93638
tttcgtggtcgccgccatcgccgttcttcagctgccgccatgccgtacctccagcccccgcgcccccacccccaccccacctcccgcctctcgcgcgcgtcgccgccgtcgccgttcccgttctttcccgccgggacatcgcgctccgggcgtctccacnccgtcccagnctccggnnactcggcctcgaggacatcaacagatggnatcaaaagtctcagacnaatcacancggtcaaaacccccnatttgncaaganggaanatttgttcttgnngcaaanaantcttgataaacacacaaataaatggtgggtgcngaanggtgtaataattggggggacaaacaaaga

SEQ ID NO: 93639 - DNA, 470 bp, Triticum aestivum
  Clone ID: PAT_TA_93639
ctcgtgccgaattcggcacgaggcgacgacgggtgcagtggtcaaccacacttaccgacatgatctcgagtcgttcttgtatgtcttaagtctgggtttgcattaactgtggatggaatgaaggcacaaacccgcatgaagctttcctatcaaaatggtacattggtaccgctcgagaaattcatcgaaacaagcttgacgatataaagcgagacagtctcgacgagatcttgtacaaattctcgccgatatttgaagatgtcaagggtctagttgaggaattcagggacttattatttaattcaaatataaagacgcggacaggaaatcttgaggaccccaacaaactatacgaaccaatcattgcggcgtttgatagagctatcgaggcattgaaaatatcacaagcgaaacatcctgaaaacgcgacacgtaatgaacctgaatctccgaagcaaaactcagtaact

SEQ ID NO: 93640 - DNA, 512 bp, Triticum aestivum
  unsure (1)..(512): unsure at all n locations
  Clone ID: PAT_TA_93640
aaagggggccggggcgtgggcgtggcgacnacngtggaggtggtggagcacactggcagccagccaaggatcagagaccctccctccctccctccctcctttcgatctcaacttacacccaacgccaacgccaacgccaactccaaggcaaggggcaagagcagagaaggagaagagaaccctgcacctttccaccttccctcccaggctcccaccacctctcctccgtcccccacgcgaccgcacggggtgnaggacgaggaggaggacgggatccgtccgttgcttccgacggccgcctccttttccgcgggctccaaccgcggcccgccgttccgttccgttcccctgaaaangcaaacgccctggatngggatttcgggggggttccaactgnngcccgcctgggtcccgccgangggcaaccaccnaccttgcccgcaanggcaaaggggaaanttttnaaaagggngggattcttnaagaaacccaaaactttctnctcctgangg

SEQ ID NO: 93641 - DNA, 478 bp, Triticum aestivum
  unsure (1)..(478): unsure at all n locations
  Clone ID: PAT_TA_93641
ctcgtgccgaattcggcacgagccgaggtcgaggtcgtgcatctcgaggtacccgggaaacccacacagaaaaggaagtacaaaagcctgcggatgataatccttccacaagtgaagttacggaacaacagaccgcaacttcaggagaggtagaagtgcaggttgaggccgattccaaggaaccaaaggaaaaacctactcgcactccgcgcccgcgccgttcccgtggacctcctgccgatggtattccatcgaaaactaagatcatgggtgctaatctcccttatgatctgtccgaagagaaactcaaagagcttttcgtanattttgagcctataactgcaaagattgcgcttagacctaaccctcgttttatggncaanaagctgcaggctccaaatgaacctcngnaaggncgtgggtttggattcatatctctancccctgaagagctccanataaagggcnttgctgncan

SEQ ID NO: 93642 - DNA, 209 bp, Triticum aestivum
  unsure (1)..(209): unsure at all n locations
  Clone ID: PAT_TA_93642
gaagtttatctcngncaatcncctaaaaggggaggtttgtccaaaacancnccnccctaaaaaatttaacanctttcncaaggttcttcaaccnngancggaatttcttganccaatccttnctcctaaagacngcaaggccggtatncaaaacaatttnaaagggccaaatatgcgccngtcctanaacgcaattccccttttggttt

SEQ ID NO: 93643 - DNA, 503 bp, Triticum aestivum
  unsure (1)..(503): unsure at all n locations
  Clone ID: PAT_TA_93643
ggtgggcgggacggctcctaagaaactaaagtgggattcccccggggctggcaagggctccgtggccggctccgtggcccgaatttcgggcaacgaagcttcaattttcccctcaataatgggatttgggagggtaacctcttgggttccttccgaactttgttaacaaacccgggggattcaatggctggctcatttttcctttcaccccgggcaatcttccgaaataactggaaaccccaaatttgtccaacctttgtactttgctgcccgaccaatgcaagctgtgggtcaaaactggattgtacatccgttccaagcaagtcttcttggggatcaactgttccgcagaaaagncaattacagtctccccctttttacgccaataaaatatggtattactcgggttggtaccgttagtaaaaaaaaagaataaaccgttggtaaacgaatggggatngcntggggcctaantggaggtaaatttaacctggggcccttaa

SEQ ID NO: 93644 - DNA, 479 bp, Triticum aestivum
  unsure (1)..(479): unsure at all n locations
  Clone ID: PAT_TA_93644
tcctcctccatggcctccagtgatgatggccccctccgacagggtgccaagagagggcctagattgatttttcatggcaacagaggcttgcgacggtggaactctcgatctaggtttctttctgggggttttggtaattataggaatttttggcgtatgtctcacgtcaagggggtccacaaggcaagtgacaaggtaggaggaccctcctggggggggtagggcgcgccccctacattgtcgtccgtatcgggacacttctgggccaactcttgtgcttcgggggtctcttttggtccataaaaaatcaccgtnaattttcaacccaattccgagaacttttatttctggcacaaaaaacgacactaccggtaagttatgctaaaaaacaangccagtcccnggntaagttctaatcaaaatcnataccaaaaaccaaatagaaattgttatanaacatggcatgaatacttcaattt

SEQ ID NO: 93645 - DNA, 466 bp, Triticum aestivum
  unsure (1)..(466): unsure at all n locations
  Clone ID: PAT_TA_93645
actcanatctccaccttggnatgggcanaagatttgtggncggccnttgggtggngttttgcaccaagttactgaggagaagctgggcgattgcctactttcanatcattgacaatctgtatgatgagctttatgtgcgggtggncanancttgggctcggctgatgaagaagatccacaaggacacagcatgaggagcctgcttcatgtgcagttgaactactcaagacctgtatgttaagtactttgtaatttggataataaatgggactttggngtgtgtactgcnactacaatgtagtactantccaagtgctaccaactactgtgaggcacntagctcggtaaattacttataagatatcttattctgtcgatcgattccacaatctaaacagtactgttctcttttccncaaggatcatntttaaagggatgcaaaaatcnngtattaaaggtgtaaaan

SEQ ID NO: 93646 - DNA, 324 bp, Triticum aestivum
  unsure (1)..(324): unsure at all n locations
  Clone ID: PAT_TA_93646
ccccgccccgagggaaancgtcccnagggaganaaacaaacaaccncncgggangaaaggggncatggatttcctgcaagggnggngcgtcnaaancaaggggggcgtngccgtcncgggcgtcgccgtctccntggggggggcactcctcctccgccgnttcaananggccaaaggntgcttgggttctgagaaactcaaaaaatttnaaactgtggggaaagnnanaaaaaaccaaaaatgtttggccaaattcnagttttntnttccaaacccccanctcctgggnttnagggccttccaantttggccacnaaaatcaaa

SEQ ID NO: 93647 - DNA, 261 bp, Triticum aestivum
  unsure (1)..(261): unsure at all n locations
  Clone ID: PAT_TA_93647
canctcccgaagccactactantagcacactagcttngctgcacacaantctgcccttctcttctcttcctcanacagaccagcccantgtgcgtntttnagcaggaagccgagatnaaaatgacgagacgctgntcgccgccgctcgctgctcttgtcctgcttctcctcctctgcttctcctanggggtggggggcgntcgggccctccccgccaaaanntgngtcctcaccaaagganctgcgtggtgagaatcaaag

SEQ ID NO: 93648 - DNA, 593 bp, Triticum aestivum
  unsure (1)..(593): unsure at all n locations
  Clone ID: PAT_TA_93648
tggcccaatttccgcaccaaaggganngncccgagcctgaagggtgaaaaaccacccanggaccaaaggggatgaagtactgaagtggggntnanaagtgtgcgccccntatttggtggggaagtgttgtgcacttcacagcggggttgntccctcncccgtcccngntttgctgntgcatccgtgantgttcgggtggggtaagcacaagtacaaaaaattgtcaaattgggntccctgtggctcaaaacangntcgggtgccnatcnanaatttgncaaagtggggggggttacntttaaaaaactcncacgtaaagtccnacctaatgtggtnaantgttgcnccccccgtgaagggaaanggtggggatcccatacntcnccaaaataaatggngaccganaagaagtttttgtttaaaaaaaaaaaaaaaaaaaaaaaaacncccngggggggggggggggcccggtaacccnnaattccncccccaanaanangaggtncctatntaaagcggcggcctcacctgggggcgggcgtttttntaaaaantncccggacctggggggaaaaancccggngggttacccc

SEQ ID NO: 93649 - DNA, 483 bp, Triticum aestivum
  unsure (1)..(483): unsure at all n locations
  Clone ID: PAT_TA_93649
ctcgtgccgaattcggcacgagccaagacaggtctacctcaccggagagaaaagaagagaagcggagatgtcggggcgcggcaagggaggcaagggtctgggcaagggcggcgccaagcgccaccggnaggtcctccgggacaacatccagggcatcaccaagccggcgatccgtcgtctggcgcgtcgtggcggcgtgaancgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggattcggaggctaggccaccaccaccaagattagagtgtctggggttcgtggtcgttgatgtaattgcagcatctcgctgttgtttgctatcttctgtagnaatggaatggaatggan

SEQ ID NO: 93650 - DNA, 342 bp, Triticum aestivum
  unsure (1)..(342): unsure at all n locations
  Clone ID: PAT_TA_93650
ttgncatcaggtctggtgcgagganagaatctacacttccaacgcaaaaacanaatcctccaangatcatctacagcataaggagcgaggagatggaggggagcagcaaccggncnccggagataaccatcatcccggcgcctangacggcggagggcngtggcggtggnggtggngccgtcnaggcggtgaaggcggcgagcaaggaggccatcaaancgggctcgccttccccggccaagnaaggagngncccggaggcgtctccctgcccgggtggaagctcgantccctctgcaaggagtccaagctcgccgccggncatganggcgcgcttccccta

SEQ ID NO: 93651 - DNA, 478 bp, Triticum aestivum
  Clone ID: PAT_TA_93651
ctcgtgccgctctatcgtacctttatcgacccccaacggattgcagcttttactcgagcaccaccaaaaatatttgaaggagcaaatgtgggctgtaaatttgagctctttggtgggaacgttgcaggtgaatatactgagctactagaaccaacaaagatcgtccagaagtggaggttagacacatggcctaagggccacttctctcgattagaaattgtctttgatcaaaacgatattgacaacgtaacagtaatgagagtaacttggagcggtgtaccaattggacacgaggaggtaacaaagaaaaattggaaagagtattatgtacgtagcattaagcagacatttggcttcggtgccattttgtgacgagacattttctgttgaaagttaacatcttcaacggtaattaagtcacgtgataatgtgctgacaacaagttggctttgcttgtcatgtctagcaaaaaaaaaaa

SEQ ID NO: 93652 - DNA, 481 bp, Triticum aestivum
  unsure (1)..(481): unsure at all n locations
  Clone ID: PAT_TA_93652
ccacaangaccacgacggatcaatctcncctcgtnnttcanagaataanggnanctggngtcccaaacatacgtgatttcgaancgaataaagtttgtcgccngacggtgttttctatgncnagttaaatganttctttcaacgtgaacncgcctaaaagggttactcnggaagtccaggttcgagtaaggccaagcgtcacaagacatcaanatccgggctacgcaatanccaaaaanttcttggngaacancgactncnaattcgcgagctcacatcncttattcaaaagcgctttaaattccccgaaaattcaagtttctctctacgccgccaagngngcaacaatcgtgggctttctggtgntggtcaangtgagtcagtancaatacaaacngntaaaatgggctccgctgttcggaaaaccgtgttatggngttcttcgaattcaatatggganagtgggtgcaaagggaggcca

SEQ ID NO: 93653 - DNA, 467 bp, Triticum aestivum
  unsure (1)..(467): unsure at all n locations
  Clone ID: PAT_TA_93653
ncanccaccagcgcgcanccaaancagaccagagngagcgaacgacttgcctctcccctgctcccgancccagccccagccatggcaatggangacgtcgccttcgncgcgggctcctcctcgtccgccatggacgccctcgccgcctcctcntcctcntcgtccgccgcgcccgccgacccctcncacggntggcagaaggtgacctacgccaagcgnagatagccgcaagcccgcngccgtggccccggccgcggccgcggcgcacgatctgggnggcaangccggagtcttctatggcctcgacaagcgctcgcaggagcgncaccgcgcgatcaggccgcccgggactccaaggccggttactacgatgacgangatgangcngccaangccgcccgcgncncctgggggtcccgctcctccgacgagggctcccactcggaacggggcngtggccaaangac

SEQ ID NO: 93654 - DNA, 266 bp, Triticum aestivum
  unsure (1)..(266): unsure at all n locations
  Clone ID: PAT_TA_93654
ctcttntttttttntttatttcaaantacgtnacatcacatccaangcancttaaccnatccttttgttgcggcaggaacaaaataggcnatgtgcgtgtgcagatggtgtacattgcaangttgaggtgnggtgcattgttaatgttcnctctcatagcagctgtcacccatgctcctaatcttcctgcaaggccattcatcanatagnccctgttgaaactctggccatccaaccccatgtgacaatggttgcaagnaactcga

SEQ ID NO: 93655 - DNA, 470 bp, Triticum aestivum
  Clone ID: PAT_TA_93655
ctcgtgccgaattcggcacgagaaaaggacgagcaattcttgaaacatattcaggtgcccatttagaacctgatccatcaacctgccgattttcatcaagcaagttttataaactcagattcggtccaatattgagggaattacacacgaaacgacaagttgtcatctacaccacagaggcagagtaccttgtgacaacaaaaaaatggcctcaacttcaacgactgaattcctcattacaagaattgaatatcactgtgacggctgtcaagcctaagggttcccgtagcctacgctgtctaagcgcaggcaattatacgaagggaggttcctgggaagatcttggatgacagggaaccgagatgattcacattgagcctttttgaaacctactgagatttcatgagggttacaagaagtatcaaaagatctacaggcgattgtcggagagtccgagttgacaaagtcat

SEQ ID NO: 93656 - DNA, 471 bp, Triticum aestivum
  unsure (1)..(471): unsure at all n locations
  Clone ID: PAT_TA_93656
ctngngcaccattcgtcnggaacngggaccgaagccaagaccgcgccttgccccntcnccgggtccgctgncgcgccgccgccatgccgccgtcagtccgcacggnctccatcnccttcgccgacctcaaggagcggggnaggganctgancggaangatnnaggaggggntcgggcccaatggacncggcatcatctccatttccgacgtgccggatttcccanctctgaggagaacnctcctgngcttggcgncgagagtcncanacctccctgaagatgtgancaaacntcttgnaganccggataacangtntnattttggctggagccatgggaaagnnaaacttgaatcngggaaactatanacattcancggggtcctattangccatcccaattttgggatgtccctaataccgatnntgtccttgtaaagtaggtaaccatnanactgccgaccanntatat

SEQ ID NO: 93657 - DNA, 410 bp, Triticum aestivum
  unsure (1)..(410): unsure at all n locations
  Clone ID: PAT_TA_93657
ncggttgcagctgcggctcaaactgcaagtgcgggaagatgtaccctgatntgacngagcanggcantgncgcggcccangtcgccgccgtggtcgtcctcngcgtggcgcctgagaacaaagcggggcanttcnaggtggccgccggccaatccngcgagggctgcagctgcggcgacaantgcaagtgcaacccctgcaantgttaaaactgcatgcactcntgtgatggtgtgagagtatacaatgaataacgaagcgtccctctgatctgatggagtcnaccaaanggtgcgtgtgcgtgtgcgtgtggtttacttgntcgctctccgcctatgctctgcccttggggtccttgtgtgtatgtgtgtgcacgtgtcccngtaattgcttcatctatctccaaaaat

SEQ ID NO: 93658 - DNA, 320 bp, Triticum aestivum
  Clone ID: PAT_TA_93658
cactattcctttctctcctgctaggaaagtcagctcatcagattactcaaaacacccacgttcgtcccccctgccaaccctcgacgacgagactagtgtcatcatgttcgccaactaccaccgcactctcgcctacctcctaagcttctcctctatttccgtcatggctgttcccgccccacccgctgccgccgtagcaccaatgggcgctgctgtgactattgccgtctctgatggaggctccgcctaccctcgtgctaattacctgaacaacggcaagattattggatcatatactgcctttccggccggcggtcaac

SEQ ID NO: 93659 - DNA, 471 bp, Triticum aestivum
  unsure (1)..(471): unsure at all n locations
  Clone ID: PAT_TA_93659
ctcgtgccgaattcggcacgagctctctcgtactcgataagaacgccaaaatgcatctaaatttcctacttgcttccctaattttggctacgggctgcgacgccgcctcaacgtgttggtatcccgatggcgtaaccagtgaccccagtcatgtgccctgcaatcaaactatcaatacagcttctgcctgttgcaactctcacgacgcttgctcgtctggattgtgtgttagcatgtacggtgcttatcgtggaacgtgtaccgatcanagctggaattctccaaattgtggttcaagggaatggcctcaatgtataacanatncctcaacgcgtcgaaaatataaccaagtctacttccantttaccgtgtggatcgcctgnngactcaacggggaaagctactgnctggtagctattcaaaatgggattttcttgttgcaacgaccaattccgtctaagganatctngg

SEQ ID NO: 93660 - DNA, 465 bp, Triticum aestivum
  unsure (1)..(465): unsure at all n locations
  Clone ID: PAT_TA_93660
agagaattagctatgaatactgtattgcgtccgattgcaagagctagaatgttcttacgaatcaaacacatcattaatctgaactcacagcagaactggggatctgcaatagattggaaaagaagcaaggagaaagaaagaaggcggagataagtccagggaggactgaaattctatctcaatgcctttacagacttagtcctctcctttatgttgctgaaagcttggatcgacactttgttcaaacatgactggtttgcagttcttcagcttatagttagcaaagctgaataagatctgacgagctatgttttgagaacataagagttagagctcagtaaatgtgagatgggtatgtgaaattaccaaattccttgtgttctataataagacaaagatgcacaaattagtttanttaagagcttcacaagtgttgacaacaaaggncaattatcangtgcaatg

SEQ ID NO: 93661 - DNA, 415 bp, Triticum aestivum
  unsure (1)..(415): unsure at all n locations
  Clone ID: PAT_TA_93661
ngacaacacgcctccctcccgcgaccccaaaatcatcagtcagcgcgagcgagagatctctccctgcttcttcttccatggagaaggngatcgaccggcagcgcgtgctcctcgcgcacctcctcccctcctcctccgccgccccgtcccggatatccgcgtcggcgtgcgcggccggggacancgccgcctaccanaggagctcctgcttcggggangacgtcgtcatcgtcgccgcctaccggacgccgatatgcaaggccaagcgagggggnttcaaggacacgtacccggnggaccttcttantcctgtcctcaaggggtgncctggnnaaaactggnatcaacccaaactgaaatcngcgacnttgtngtcggganggtgggtaaggccaagntctnaacgtgngattca

SEQ ID NO: 93662 - DNA, 450 bp, Triticum aestivum
  unsure (1)..(450): unsure at all n locations
  Clone ID: PAT_TA_93662
ctcgtgccgaattcggcacgaggtttcggagaccttcccctgactggggattcacggatgaggcttgaccggtggtgaaaaagaagccgccataacctcgcagtggtacttgcacatgagatgcgaggtataaattctctcattttaactcaggtagtgtatgggcgatgcgatgcacattgcatggttggatggtgcaatcgtagctcatccgggcctatctgtaatatagatcctgaatcgtttgagcacacgtgagacctangctaggagatggcatgctcaaagacagtcatgcttcatcaaaatttctgcgatattggtgtgcccggncaatcaaagaagtgttaatttcaagtttggggggtactaatggaagagggatnaaccgtcctttgcatactaaaatagcaattagaatttaaatatacgcactcccggatcacttgt

SEQ ID NO: 93663 - DNA, 464 bp, Triticum aestivum
  Clone ID: PAT_TA_93663
atcacgccggcgagcctgaggcgggcgctgagccggctgggcgccagccgggacgtcggcgactgccgcgctatgatccaagaggttcgacctcaacggagacggggtgctcaccttcgacgagttcgtccacagctcgatgctatcgaggatagcgtccaggtctggacgctattagtaactgcgtccagtcaagtgattcgcctaaccatcagattcgactaaaccgggtctttcctaaggtttaaaaccctagtatgcatgcagtctgcgctcctggagctcaccgtatggtaagcaatctctggcagccggcaacgccgatcatcacaggagcggcaaggtctcatcagccgctcgccattaggatcctccaattgattttgtgcttgattcatgttagctgttgtactgtcctattgaatctcctttgttttaatctctatgcaattgattcaatgatt

SEQ ID NO: 93664 - DNA, 448 bp, Triticum aestivum
  unsure (1)..(448): unsure at all n locations
  Clone ID: PAT_TA_93664
tagtacagncatggnccccaccgtgatggtctcgtcggccacctccgtcgctcctttccaggggctcangtccaccgccggnctccccgtcagccgccgctccaacggngcnagcctcggcagcgtcagcaacggtggnaggatcangtgcatgcaggtgtggcccattgagggcatcanaaacttcgaggaccctgtcctacttgccaccgctcagcacggaggccctcctcaagcaggtcgactacctgatccgctccaagtgggtgccttgcctcgagttcancaangttgggttcatcttccgtgngcacaacgcatcccctgggtactatgatggccggtactggacanngttgnaagctgccnatgttcgggtgcacccgacgccacacaattgatcattcatgtggcnggangtcaagaatggantnccctggagcgnntt

SEQ ID NO: 93665 - DNA, 469 bp, Triticum aestivum
  unsure (1)..(469): unsure at all n locations
  Clone ID: PAT_TA_93665
cctacgtactctttcccacttagctagctagcagccatggccgccctctcctctgcagccgtgtccgtcccttccttcgccgccggggccaangtggccgctccccggagcaacaggatggtggtgcgcgcgtccctgggcaagaaggccgccagcgcggccgtggncatggccgcgagcgcgatgctgctgggcgggtcngcgatggcgcaagacgtgctcctgggcgccaacggcggcgtgctggtgttcgagcccaacgacttcancgtcaagggcggcgagaccatcaccttcaagaacaacgccgggtacccgcacaacntggtgttcgacgangacgcggtgccctccggcgncgacgtctccaanatntcccaaagaggagtacctcaacgcccccggggagaacttctccgtcaagctcancgtccccgggaactannggttctactgggaggcccacgcc

SEQ ID NO: 93666 - DNA, 478 bp, Triticum aestivum
  unsure (1)..(478): unsure at all n locations
  Clone ID: PAT_TA_93666
cgaagttttttttttttttttttttaaaataaaaaagatgaaaattctctacttaatccacatgcatgtcttttacgtcacagcttagctcttcaaatgcgtctataacctcaaaccccatgcccagtaaaatatcccttgcatcacaataaacccagactagcacgcacgcattgaacccataagatatgtgttgccgtaggcctaaaagagtgagcccctggaggacaatacttgcctgggggctgctanaaatcactggacctagaattcctgctacaccaacaccagatgccatactatctttagttatccaagaagcgtattttgcgttcaaggctgggacaaaagttgaaagttgtgatttagggcgtgtaatgataatagttccaacgagactgccatcaatgggacntttagcacggggcgaccccaatcccatcagctagagcaagtcccataaagtgcgagagccatg

SEQ ID NO: 93667 - DNA, 285 bp, Triticum aestivum
  unsure (1)..(285): unsure at all n locations
  Clone ID: PAT_TA_93667
cacttccaacgcacanataaaatcctccaagatcatctacagcataaggagcgaggagatggaggggancagcatccggactccggagataaccatcgtcnccgcgnctangncggcggcgggcggtggtggtggaggtggcgccctctacgcggtgaaagcggcgagcaaagaggccatcannccgggctcgccttcnccggggaaaangnagngccccgggggcgtctccctgcncggntggangctcgnntccctcngcaaggagtccacatcgccgccggt

SEQ ID NO: 93668 - DNA, 277 bp, Triticum aestivum
  unsure (1)..(277): unsure at all n locations
  Clone ID: PAT_TA_93668
ccttcgtcnattgggtaacgaaaccaaacnnttcancaaangancacaanggatttccangaggatcgtgcagtgcaataagggatcaatgaccntgtgcgcctgatttcgatggcgctccnggcntcggtgggcggacnttcggattntcacgtcggacggggcagagcatcccggggcaatccctgcnttcttgcctccggngncgccggtggntggnagcgcangatnnacaanggcgcggcgcnggttggggnggnccactgnaacaatccgc

SEQ ID NO: 93669 - DNA, 469 bp, Triticum aestivum
  unsure (1)..(469): unsure at all n locations
  Clone ID: PAT_TA_93669
ggagggcttcctggaggatcatctcctccattgagcaaaaaggangagaaccgtgggaaccaggcccatgttgcttcaatcaaggagtaccgtaccaagattgaaaccgagctcaacaagatctgtgatggnatcctcaagcttctggactcccaccttgtcccctctgncactgcagcanagtccaaggngttctatctgaaaatgaagggtgantaccacangnaccttgcggggttcaaagngggtgctgnnaggaaagaagcacctgagaacactcttgtngcatacaantcggcccangacatcgcgcttgctgacttgnctancacccacccgntaangggttgggnnttgnactcaacttctcangtggttctactaagaaatnctgaaantccncaanaccgtgcnttgnancctttgccaaancaangcatttttttntaagccaantgntngggctggg

SEQ ID NO: 93670 - DNA, 474 bp, Triticum aestivum
  unsure (1)..(474): unsure at all n locations
  Clone ID: PAT_TA_93670
cccgagcaagccacactctccagcaccagcaggccggcggcaagcagcgcaagcacaacaaccaaatggncaccatcagcgccgccgcggcgaccaccgtcgtcgcccgtgccgccatcgccaggncgcaggncctaggtctgccccacctgangacgangagcgggagggtgaggtgcagctactccanggacgccaaggaggggacccctgccgccgccgtccgcggggctggtgcgtccctactcnccgcggcgggcgcggtgaccgcntccgccgggccggcgctggtgctggtcgacgagcggatgtcnacggagggcaacgggctgatcctggggctgancaacaacctgctggggtggntnctcctggggcgtcttcggcctcatctggttgctctacaacgtctataacctccgggctcgncgaggaagaggaagttcggcggnctctcgctcttnaaatacacan

SEQ ID NO: 93671 - DNA, 295 bp, Triticum aestivum
  unsure (1)..(295): unsure at all n locations
  Clone ID: PAT_TA_93671
tcttcggggtgaatctcnagtgcgcggnggacgccgaggaggacttcagcgggcccgggagaacggngacaacggcgctgcaactgctgtcaccggcctcctcctcatcgtcgtcgtccgggaaagcgaggtgctctttgaatcttgacttgtgaancgctaaagtgtgggcggtcgcacgatccactactaccaccactactgctactcagattctgacacaaacggggtcgccgccggccgttcgcaaagaagaaattaacctgtccatcggagaaaaaaaaaaaaaaaaaaa

SEQ ID NO: 93672 - DNA, 502 bp, Triticum aestivum
  unsure (1)..(502): unsure at all n locations
  Clone ID: PAT_TA_93672
ctccacccattccctgcgaacctgccgcccttcgccgaagcgcccctcccttcgcttcgtttctccctccgccacgtacgccacgcacccacctagatccttagcagctgctcgtgtccagtcctcctgctcatcctctactgtgtggatcctctctcggttgagggatgacaccccagagagttatttgactttgaagataaacgagacaagatgggctcttatctaagcactgcaatcaagtaaggctcaatccatggattcaagacgaggtacatggatcaagtttcaaacaaaagggccaaagataaccgcatatgtttgtgggtcatattcaaggataattccgactcttcctgatgaagctttcatttcaaattctagcaaggggtaccacgggttcattacctaaagatgaaagttggttaagccgaacttgggaggcgggaaatcaaccgggnactnctccgtgccgaattcgggcacgaaggggggggccggt

SEQ ID NO: 93673 - DNA, 411 bp, Triticum aestivum
  unsure (1)..(411): unsure at all n locations
  Clone ID: PAT_TA_93673
tttcctcattttgctccantccaatattcccatctggcgggggtcaccggagctggggtagcaagcatggaggctgctctggcgaacgctctgaccaaggaggtggtactgaaactcntcacgctgttgggcganaagcacaagctgtccaagggcctcaaggatgacatccgtttcatccacaccgagctagacattatcttgggngacatggangagcacctgggggatncnagcgccanctcncggncgcangtcgtgtccatggaggagatgcgcgatntngcgcatgacatccaggantgcataaatcggttcctgccctgcgtcnccctgcgagggggggagnaaacatcngtcctccaccgcggtcaaagaaagggggtcactaataaccgggatcccncggtc

SEQ ID NO: 93674 - DNA, 511 bp, Triticum aestivum
  unsure (1)..(511): unsure at all n locations
  Clone ID: PAT_TA_93674
ctcgtgccgaattcggcacgagtccctccctcccatcctttcttcccctccgcctccgcctctgcggccgccagtgacgcgccaggcgctagctagccatgtcgtgctcccacctctccaccgcgtggtcctcctccgcgcttgccaagcacctccacccgccgccgcgcctccaccggnagcancaacctggtggtgcggtgctccctccgggtcctccgtaaccgcatcgactctgtccgccgccaaggtccgtcgcgcgcaggaggccgtggtctcctctcgccccttctcggaggctctggtggaggtgctctacaacatgaaccaaggagattcagtcgggaggacatnganctggccctcaaccgccaagcgcggccgtcaancgcgtcgcgatcgtcgtcctcaaccggcgaacgtggtctctggcgggcgccttcaaacaaacaaagtggctcaaanaaagggcgaggggccncantgggagggaacctcaangcaagctttg

SEQ ID NO: 93675 - DNA, 217 bp, Triticum aestivum
  unsure (1)..(217): unsure at all n locations
  Clone ID: PAT_TA_93675
aataacttcnagcaactttcggatctctttccatttagggggagtttccaacgctccaggacaataccttcttaaggtaaaaatctctaagtaggcctanttacgataacctanaaagtggntcatatagtgagtgttgtcgcanttaagtagtcatatgtattctacattttgtcgatcgtaaaaaaaaaaaaaaaaaaaactcgagggggggccc

SEQ ID NO: 93676 - DNA, 481 bp, Triticum aestivum
  unsure (1)..(481): unsure at all n locations
  Clone ID: PAT_TA_93676
cccaaaagggactcccttgtattgtgtttaccctaagtttcccatcctgccgcatctcatgcatacttcttttcctgaagaaaaatctaagatgtctagggatgaccaagctcctcgtgagcaaaggattgtatatggtcttagatcgacacggcattaagatcaaggcagagatgcttaatgagcatattattaagaagacccgcgatgtacgtaatactgatttacgtgaagatgcagttgcaattgtgttgcacgaaatggttgatgcctatttcgaggagttttctaaaattgataccgaggaatggngtttattcaaactaacattaactttgaaagtaatgattgatcctcaaggnggacttaaagctgggggaccttatgagatgttcacacatgacgaattaataatgatgggggcngtgacgcntccaaaatatgaaggnactcctgataaaaaaactggcctgggcaatgg

SEQ ID NO: 93677 - DNA, 406 bp, Triticum aestivum
  unsure (1)..(406): unsure at all n locations
  Clone ID: PAT_TA_93677
aaaaaagaatctgacaaattnagctangcancatgtcgatgatntccaacatgctgggccggaagcanccgccgccgcagccccaaccgcaacaanacgcggnggnccacaagggcaacggccacggcggngggggggacgaagtcgtggagccggtgagcatcnacatcctggagccgttcatggagggcatctcactgactgcgttctgcggcggnggnggggtgccggccggcgctggggctgcccttcttctacggcgagcataggacttgggaangagaacccnaacngcgcacgttgttcaatggcgggaccgtngccggggccctgctggcggggaaggaaggtgaaangtgggagggttgtgcaaagaacccnggtttctcccgctttatcggggaaa

SEQ ID NO: 93678 - DNA, 500 bp, Triticum aestivum
  unsure (1)..(500): unsure at all n locations
  Clone ID: PAT_TA_93678
tttttttttttttttttttttttgagggttgtaatttgctcnaaattttttattagtgtatanattgttttggattcatgagcccaaaattttaagatatacaaacaatgataaagaacgtaggcttaactaataggtgacttcattccacaaaagagacccgttttttgctagcgtcacagtatttctatccaagatatcctgcactttttcctttacaccttgtttccctcgggtgagcttaataaagtgctcgattacattggaagggttcangtatttgctcgaaactaaagtttccacttgttcttccgatggaagtccatatttgtggntggggatactccttaaagtctttgtttgccanaaaactggattggttcaattcccccgtgtatcgaaatangggtcttccgatcccacntttggggcgtaatttccncaaaggggaaagcaaggggnccaattttgggcttcccanccntttccgaancaagtgg

SEQ ID NO: 93679 - DNA, 490 bp, Triticum aestivum
  unsure (1)..(490): unsure at all n locations
  Clone ID: PAT_TA_93679
tccaagcattacatagggcaccgttatatttctaacttgagcttaccgtcaggatgatggtacaatagaatangtctttgttaagacggaaagcagatctgatggcgtgataactatgctcgtacttggaatattctgtagttagccagcgtgtttaggggaatgatggcgagccttgtggatgataagggcatgggaagttgcatgtttttgaggtgggtaaatgtcagggtgagcatagaaaactgtgttactatttgttcctgttacccttaacgacgataggctcatgaaaattcttctttccagcacctgtatcaactagtttacttcaccatctcgcccgcttgaggaaaagatctcaaccaaaagaaaaatttagaaacccacaaatactgccaacgatacaaaatttcttgtgcgccctctgcgttttcaaattaaattcactgtcttgggggncaaaaatcaagtanggattacaagcctt

SEQ ID NO: 93680 - DNA, 408 bp, Triticum aestivum
  unsure (1)..(408): unsure at all n locations
  Clone ID: PAT_TA_93680
tttttttttttttttttttttttcgngaaaaatgatgttttttcttatttanttanttatttgtttatttantttgaatttgatttcattgtcctgatttggngccttaaaggcccatgcaggtgactacaaancnaaactatatatttacatgagggggaaaccattacnataaaaaccccctccctctttaaaaatttttttgtatctgtaggccttcgttaccctacaggaangtgcnattggccaacaagtccngncgacaggactaggntaaaattattactcgacctcgcnaatcctttccctgccctcgcgtgctaaaaaaagngtttgactttgggntctgaggttttganccccgnatgggtccnaaataaatntgangggtgggnttgattggaccaa

SEQ ID NO: 93681 - DNA, 504 bp, Triticum aestivum
  unsure (1)..(504): unsure at all n locations
  Clone ID: PAT_TA_93681
gtcnacatttttcaagctgggtttcccccacacggtgggccgtggaggcgcaggaccacaacaacttcctccangcatgtacggacttcctgctcaatttccatccaacaanccctatggncaacagcaaaatcctcanttcatcgctgngatgcaacaggctacccacngcaagctgcattangntgggggacgacctgaaccaggcgcccgtgtgcctctacagggtattcccangtatgccgcctaacatagcagttctacaagggcaacaaggtatgcccccgggccttcaaccaaggcaagtcgacaaccaaggtattgccnggtcgaggttcacaagggaccgcgtcctaatcagtaccaaggaggaaactcctcnaagctgtttatnaaatgganattgcccccgcacattgatngggaattgccacaagggatttnncaagangaagtgtccttaacaaanctcaacctangcnacgtggtcccctccacnaagca

SEQ ID NO: 93682 - DNA, 244 bp, Triticum aestivum
  unsure (1)..(244): unsure at all n locations
  Clone ID: PAT_TA_93682
ctcgtgccgaattcggcacgagctcaagcacggtgtcttcctcaaatcggggncgattgaaancatcttcctgtcggagaaatcgatgagcgactacaaatacatgggcggngagaaccccatgttcatgaatgaccactccnngctggggaggganaccnctgtgcgcttcaaagtcatngggntccncnggatggaggcagancgccagttccanctccttgngncgctgggtggngatttc

SEQ ID NO: 93683 - DNA, 482 bp, Triticum aestivum
  unsure (1)..(482): unsure at all n locations
  Clone ID: PAT_TA_93683
ggtttgcagtgataccaaggctatgattcacatcggtgatgcaacatactatgtgtctgccatcaactacaagtggttcttccttctgggtcatcgatgccaacatggatttacacaacaactgccctctacctcggtggaatcctccataccaacccgacaacatggaaatcgaattgagcccccttgtacatagtggggcttgctttgtaaaatgctctcacgaagtaaaggacactggtacgtacatgcctgttgcttgcctaagcaccaacgattcttttgtttacgtgttaactgggntatgggtcnacatatatggagtaccttgaaccttcttgtgggtacttgggcccgaactcctcnaccctgggacggtctggcgctaaaaaatgcaagttatgcanatgttgtgaaatccangaggaatggggttttgcngttcnggnttccctancccnaagggaagagnaacaaagcan

SEQ ID NO: 93684 - DNA, 509 bp, Triticum aestivum
  unsure (1)..(509): unsure at all n locations
  Clone ID: PAT_TA_93684
ggctactcccctgcctcccccaagagctcgttagggttttctcttttttcgggggagaaatctcaagaggcggnaacatgctcgtgtaccaangacaagctttccggcgacgaagcttctgtcggattcgttcccttacaaggaagctggagaacggcgtgctctgggaantcgatggncattgggtcgttcaaggagnaattgatgtggncattggtgccaatccctctgctgagggnggnggngatgatganggtgttgatgaccaagcccgtnaagggggttgacaatgttgacaacttccgtcntcangaagcaacctgctttttganaagaagcagtttatctcncacatganagcgntacatcaagaacctctctgccaaagcttgaaggggatgacccaaaatgctttcaanaaagaaagntggagttcggccacnaagtatcttcctatnaaggctcaaaggaccttcaagttccttngttggggggaaaagcaatcnatg

SEQ ID NO: 93685 - DNA, 151 bp, Triticum aestivum
  unsure (1)..(151): unsure at all n locations
  Clone ID: PAT_TA_93685
tctcaagatanaccacgctctcttggntntccgctgaaagagcgacgtgggnatcactantctacctccanctgnaatctttggggaccttcancaactctgnaacaatgngctgcaagcntgctcntttattgnttaatgacancaaacc

SEQ ID NO: 93686 - DNA, 349 bp, Triticum aestivum
  unsure (1)..(349): unsure at all n locations
  Clone ID: PAT_TA_93686
ctcgtgccgaattcggcacgagctcgtgccgaattcggcacgagaggagaccgaccgagctatctagggttcgcgcctccccgccggtcgccgcccgnccgccgatcntcnccncgccgccgcncacgccnagctccggtcgctcgccgctccggatccgcgcccctcnacctcggtccccgccgtcgggccgaccggaanatgataaacctttttaagatcaaggggganaaaaaggaagaggcggccacctcaaatggggggnctcctgtnaanaangcaacntcccaaagggaattacgtnctccacaaaagatnttgcatgaggcttnactcntagcanangata

SEQ ID NO: 93687 - DNA, 356 bp, Triticum aestivum
  Clone ID: PAT_TA_93687
tctgtgcgcgcagattaccaaggcattgtttaatgctgctgagggtgtaacagagtgtttcaacgaacagcagaaaaatcagtttgatgtatggatgcttcatgcggtggtggctaatgatctctgtactgacgacagttttgtgttctcaaaggctgtagggaagatcaaagatgccatctcagccctgccagtggcaacagtggacgatgataacgatgaagcaacagcactcgcggcacttgctgaaagccaatctggcaccacaagagaataaggcaagctgatagcaacgcacacgctgcagcgtccaactcgggggaagaatcctctgatcctttcggtctaaatgatct

SEQ ID NO: 93688 - DNA, 210 bp, Triticum aestivum
  unsure (1)..(210): unsure at all n locations
  Clone ID: PAT_TA_93688
cgcnggtggcggggcgctcctaaaaactaaatggantcccccgggctggaaggcccgttggccggtncttgcggggggggggnaanttcnccccccncctnncaaaggccaagggtttggngtgctataaaagaganagaggtttcccctcnngcacatctcgggagacnccncnagacgctctgggggagacnccnnggtctgttgaaa

SEQ ID NO: 93689 - DNA, 496 bp, Triticum aestivum
  unsure (1)..(496): unsure at all n locations
  Clone ID: PAT_TA_93689
aggaaatccactccaatccaatccccacagaaatccccatctcaaaaccctaacccgtccgatcccggcgagatggccaacccgagggtgttcttcgacatgaccgtcggcggcgcgccggccgggcgcatcgtgatgngagctgtacaaggacgcggtgccgcggacggtggagaacttccgcgcgctctgcaccggcgagaagggcgtcggcangagcggcaagcactgcactacaagggcagctcgttccaccgcgtgatcccccgacttcatgtgccaaggcggcgacttcaccaaggggcaacggcaccgggggcgagtccatctacggcgagaagttcgccgacgaagaatttcgtccacaagnacaccnaagccccgggatnctctccatgggcaaacgcgggnnccaaacaccnaacggntcccaagtttcttcanctgcaaccgtcccctgnaanttggggtccnaccgggaaancnacnttgttct

SEQ ID NO: 93690 - DNA, 452 bp, Triticum aestivum
  unsure (1)..(452): unsure at all n locations
  Clone ID: PAT_TA_93690
gtgcaaaaaaaaaaggagctgcgaagctctgctggggctcgccgtctccgtcttctccggtctccaccatgggctctttcnccgcccttccgctggncgctctcctggtgctggncgtctcntgggcatgggagcacctcgtgtggnggccctacgccatagccaggaggnacanggcgcaagggatccatgaggcccccatacaggttcctcaaggggtccaancangaggtgaggcgggtgaaggcggngacagccgacgtggtgctcgacgtccgccgaccacaactacctccccanggncgcgccgcacttcctcaantgggggggacagtatggagagccatttctgttctgggttggtgccaaaccccggntctgtgtctttttctacaaagntggntagnggagatttttcaaacaaatccgggcacnttncgnagaaaacgcgc

SEQ ID NO: 93691 - DNA, 498 bp, Triticum aestivum
  unsure (1)..(498): unsure at all n locations
  Clone ID: PAT_TA_93691
cgataccatcnacatggctgaaggtggtggactgacaatgccaatggcgacgccattggcggctgtctgccggcctcgggagtttgtcaagagtatgctctctgcttccatttgatggacttgaagacaggtttctggagaaataaaagaaactggattaaacttgtttagcaacggtgccaacttccaatgaatcttgagaagaatacttgcagcaagatttcattcgatgatgctgaacatcaacggcgaagcttgatgaagattgttaaggggagctaatctgagtttagggggcnaaaaagataagttatgcatgaaatttaanaaaattttatattcaagcctaataattataggtgcacttaaaagttttgctagaggggggcgggggggaatatggcccccatnaagctnccccnctgctgaacattacaataanaagacgaagtgtnaaacaaanttcaangaatgggnggtggggcaaaaaaaaaaaaa

SEQ ID NO: 93692 - DNA, 191 bp, Triticum aestivum
  unsure (1)..(191): unsure at all n locations
  Clone ID: PAT_TA_93692
ctcgtgcagaattcggcacgaggcagcactccttcgctacacttcgttcacttccaacgatctccacaccacagagagacagagagagagagagagggtgtgtgttgnagcaaagatgaancttatgggganccngnggagcggaggaggcctgntcaggagcctcaaggagcacaggggcacggtctaca

SEQ ID NO: 93693 - DNA, 488 bp, Triticum aestivum
  unsure (1)..(488): unsure at all n locations
  Clone ID: PAT_TA_93693
cttctcgccccctcctgcnccgtggtccccaaccggcgtccgccgncgcagaggggagaggcggncgccgcccgccnccacagcancgcatgccccgtcgcccccgcgcaccccgccgggnttgatcccatggcgtccaanaggatcctcaaggagctcaagganctgcagaaggaccctcccacctcaaagcaagcgcaggtcctgtaggtgatggacatgntccactgggaggnaactatcatgggaccctctganantccgttcaccggttggtctatttttggtgaacattcatttcccaccggtttaccccttcaancccccgaaggtntctttccgcaccaaggngttcnacccaaacatcaacaaggangggtagcanttgccttgacattctcaanngaacaagtggganccccgggttttgnccaatatnaaanggcctcctntcnaaactgttcggttgctgacnggtncccantccc

SEQ ID NO: 93694 - DNA, 167 bp, Triticum aestivum
  unsure (1)..(167): unsure at all n locations
  Clone ID: PAT_TA_93694
cggcagacaagctgccttctcctcctccggtgcgccccgaccagacgagcagatcccagctagggttttgagattttccgtcgccagaatcgaccgccacctcgtctccgcgagcacccgccggcttgcgcaccggagacccttccggatctccgccgncccccccc

SEQ ID NO: 93695 - DNA, 484 bp, Triticum aestivum
  unsure (1)..(484): unsure at all n locations
  Clone ID: PAT_TA_93695
gagagaactaagtctcgagnnntttttttttttttttttttttnttttttttttttttttttttttttttnccanccctacnaagcctgtntttgccananacaaagttttanttcctcaaatgggggatgccanatcnccttgatcagtgngngtanaaatgttcaaatcganaaaatnttgagcaaaaggtctgctctaaatactctaaccaccaaanaagtacccaanctgnctgatcctcgttgccgttgcanaactggggtgcttgtattanaaatgcncggncaaatccaatttccacgaagctttatgacttttgnttcaaaatcncccccctggtgggggaattanagctggagntcctgcanganaggatgccaagtggcaaaatcaagagtcttcccacgtgcctttgacgantccccanctggcnccntggntaaaaaaangctagggtncacnatttntccccaanccngnt

SEQ ID NO: 93696 - DNA, 509 bp, Triticum aestivum
  unsure (1)..(509): unsure at all n locations
  Clone ID: PAT_TA_93696
ctgcaacctacccaaaatccccccgccgccgccgccgccgccgccgccaccgctgccggcgcaatgctccgcctccgtggctgcatcgtctcccanctccgctcctctccggncgcctcccgcgtctcttcgccccancgnctcctctccgccgccgcggnccccatttccccgagccagcgcttcgccgtggaggagtacctggtcgacacctgcgggctcacccgcgcccaggcgctcaagggctccangaagctctctcaactcaagtccccccgccaaacccccgacgccgtgctcgcctttctcgccggggctcgggctctccgggggcgacatcgccggccggcgtcgtccaaangaaccgcgggtgctctggcgcggggcggttgggacangganccctgggcctcccaaacggtcgtggggggctcaaacgggccttcgggggctggtccaagacttccgaaaggtnncgggctcccntcgcccaaacaatcgnccggggg

SEQ ID NO: 93697 - DNA, 280 bp, Triticum aestivum
  unsure (1)..(280): unsure at all n locations
  Clone ID: PAT_TA_93697
caaaaacctttgagctttagtcaagcattccagctttaccgcgatggcgcaggaagctactttattttcaacgacatcttcaggcttgtttatggatagagcgtagtacaaggagaagtcggatgtatttgattgtaaaattcgcgaaggtcttcacctgaaagcctatctaacgagtatcgatcgaaatttcaataggaatagagtatttaaaatttggtagaatcaatacttatccagttaaaaaaaaaaaaaaaaanaaaaannaaaaaaaaaaaaa

SEQ ID NO: 93698 - DNA, 478 bp, Triticum aestivum
  unsure (1)..(478): unsure at all n locations
  Clone ID: PAT_TA_93698
cgaatctgatggccgcactacaaacgccttccccattcgccggcaccgcccgccgcttcgtccctcgcctccgctatctactcctaccaaccaccatgtctctctcctcctccatcgtttcctctcgaagccgcgacggcgacggggagcagcctctcctcccgcactcgagcctcgagatcgccggcgcgcggcgcggcctcctcgctggcttcgacagcctccgccgcccgtaccgcgccttccccgtcttcgcgtccaaccgccacgtcgagaccatcttcgcgggcttcacgcgctcgctccccaccgtggnattccggcgcgaatgcctacgcacccctgacgacggagccgtcgccctcgactgggtctccagcgacgaccgcgcgttgccgggagaagcaacctgtgctaatccttctgcctggtctgacaggggggaagtcaaggatacatatgttcgacatatgctttt

SEQ ID NO: 93699 - DNA, 476 bp, Triticum aestivum
  unsure (1)..(476): unsure at all n locations
  Clone ID: PAT_TA_93699
gaactataaccacaatgattgccccctacaaaacatttattctagctttggcttcagcttctctctctctagcttcctcctcagctgtattagatctaatccctaaaaatttcgacgaagtcattttttccggaaaaccagctctagtagagttcttcgcgccatggtgtggtcattgcaaagcccttgcaccagtctgggaagaactcgctcaagactttgccttcgccaaggaaagtatcattgtcgctaaagttgatgctgatgccgaaaaaagcctagggaaacggttcaaaatccagggatttccatccatcaggttctttgatggtaaaactgagaacccagaggaatatacaggaaacagggatttgggaagtttgaccgaagtatatcacgaaaaagacccggaatccgtgcaaagaaaccaaaaacaagctcccagcgagattgtattcttgatgntagctcaattn

SEQ ID NO: 93700 - DNA, 425 bp, Triticum aestivum
  unsure (1)..(425): unsure at all n locations
  Clone ID: PAT_TA_93700
tttgtttctccctccgtctccgtgnccaagcaatgggcttggnganatgcctcannggctgggccctgcangcgccccangctggnatcagggaacggnttagcagtggaagatangcnccatcccgggcaaggaccgccgcccccgccgttgtctcgccgtccccatacaatgtccgntctggtggcggcacggttggccgtctcgcttcgtctgcaaantgcaanaangtcgtcgacgaatntgattggnngctgacgagaagaattgggataacatggtgatcncgtgcgaagtccncggtgctggngganttctggagcgccgtggngcgggccgtgtcggatgattgccccggtgatcgacgaaatggnanaggantacgtggnggaanatcncatgctgcaaaatgaaaaacaggcgaa

SEQ ID NO: 93701 - DNA, 282 bp, Triticum aestivum
  unsure (1)..(282): unsure at all n locations
  Clone ID: PAT_TA_93701
ctcgtgccgaattcggcacgagccggaccgtgctgatgacggcgctcaacaaggcatgnggggcacccgggtcgttcctggagctgttcctggngagcttcancnacngcgagaacaccncncacctggtgaagcacctcctcatcatggccatgggcaacnaaagccttcttccggtgcaacgcggtggaccccttctgcnactggtgtcancagtggnggggcatanacttctcggcggggcagaagtacatnaagggggacnacctgtngatgatgtgg

SEQ ID NO: 93702 - DNA, 488 bp, Triticum aestivum
  unsure (1)..(488): unsure at all n locations
  Clone ID: PAT_TA_93702
ctcgtgccgaattcggcacgagggaaccaacaaatccccacccaatctcgtctccgatcgactccacgctcgtcgaatactcctcccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggncgaaccctcgctgactacaacatccagaaggagtccaccctccaccttgtcctgcgtctgccgtggtggnatgcagatcttcgngangaccctcaccgggaagaccatcactcttgaggtggagagcttccgncaccatccacaacgtcnagggncaagatccaggacaagggnggggattcctccgggaacaannaagaggtcccancttcnctgggaaaacaacttt

SEQ ID NO: 93703 - DNA, 481 bp, Triticum aestivum
  unsure (1)..(481): unsure at all n locations
  Clone ID: PAT_TA_93703
ctcctagcaagctatatacctacatagcacagccatggnccccaccgtgatgggctcgtcgggcacctccgtcgctcctttccaggggctcaagtccaccgccgggctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcaacanggaggncctcctcaagcaagtcgactacctgatccgctccaaatggggtggcttgcctcnagttcagcaagggtgggttcatcttccgtgagcacaacgcaacccctgggtactacgaanggncggtactgggcaaatgtgggaagctggctatgttcggggtggaaccgacgccacaaaangtgattaacgaggtgggaagaaggtcaaagaagggagtaaccctgaangcgtangt

SEQ ID NO: 93704 - DNA, 175 bp, Triticum aestivum
  unsure (1)..(175): unsure at all n locations
  Clone ID: PAT_TA_93704
ctcgtgcccgaattcggcacgaggtgctccattagtaaaaaatgtattttttttcaaaactactaatggcgcaccacgncaccggcgcgcaattaggggattggccagcancttccaagcgnangcattccncnccccncccccagaggntcngccttttnacctnagtngcggt

SEQ ID NO: 93705 - DNA, 170 bp, Triticum aestivum
  unsure (1)..(170): unsure at all n locations
  Clone ID: PAT_TA_93705
atnnacccacaagnttntatacatatacttgtgtanatttnacattctcttanaattttacagaaaattgtgctccctggtcacacnccnccaaaaccctctcgcacagatcanaatatattgtgccacacnctcctcnctcgcacaatctcacactcggganatctgtg

SEQ ID NO: 93706 - DNA, 413 bp, Triticum aestivum
  unsure (1)..(413): unsure at all n locations
  Clone ID: PAT_TA_93706
ggcnncgagttttttttttttttttttttttaacaaagcaaaatcattatactccaaaagtgaaaaaaaactttttacttgtagccgagggagctattgccnattgtgtacaaggagncaacaatcangctgnaacttttacaacattcacatcatccancgtgggcatcgtatggattgntcttcaccantatccactcatccatgatccanccgaagnttttttttcctttttgncaaagcaacctttctttttaaagganagacccgcccnaaagnaaagttcgcgggtcaanacggtggtcaatggggcaacnanacacccgtggatggggttcttggggggccaccaaatggngcaaaactccgccaancttttactccnggggcgtggggggnactccccccnccca

SEQ ID NO: 93707 - DNA, 514 bp, Triticum aestivum
  unsure (1)..(514): unsure at all n locations
  Clone ID: PAT_TA_93707
ctcgtgccgaattcggcacgaggaaacacgctcccgtatcaagcctcttgggtgtgaggcttcagcctgatacgtaaaattagtcaattcaattcactaccatctcatgcgtggatcgggaagtcttctatgaggtcggctcgttgctagacttgcggcttgcaagcatagacgtatatccatacttaaaatacactacattcgttcgcgtgcctgcctgagtccaaaaaccaccatgagctgacgctaaatctggggcgataatattcttagtgagccatagagtagcagagaccagaaatatgtcattaatcttacgtagctggagttttggngaggcctttgttctactccataaggagcgggtgtgttagaaaggtaaacgaaacagaagtcatctaacttcacccgcattaattaaaanaagttgggacgcaattatnatgaggntaggggtgaaaagatngagcgacnatattggttgtcattaaatcccgcgntnaattgnacnttt

SEQ ID NO: 93708 - DNA, 202 bp, Triticum aestivum
  unsure (1)..(202): unsure at all n locations
  Clone ID: PAT_TA_93708
gctccgggcctctctctgtttgctctcgcgtccgccgcgcccgtcccgtcccgcctgcgcccgcgcgtgtgntcgctcgccgcctccgattcancgggccancaacgcgccgggggnatgggggatnaactcancgacgaccaaatngccnagttnaaggngggcttnaacctcntccacaaagncngggatggntgnatca

SEQ ID NO: 93709 - DNA, 547 bp, Triticum aestivum
  unsure (1)..(547): unsure at all n locations
  Clone ID: PAT_TA_93709
nttttttttatgaaaaataattagncccataacattatagtattcaagctaatttcatctacgaaagctatgattgtaaatctcattatattgtcgctttaaccttagcttttctcgaccgttttttcttccgccctcccagtaaaatattactttcattattaagctggaacaatcacatttgtattattagcattaagttggcattgctggaccttcttcattcccaaatgtctcttttcgccactgtcttaaacgcgattttttccctagatgtttcttaaccttttcgtttcttcccaacatccctaaaaggtgccaacctccttaattccaagcaaaattgatttaagtgacttcctccnggggccattaaggatatctanncggaagtcaaagccaaaaaagagaangggggaaggttcacgggaagccgaaaacggnntcccntgggtttggagncaagnccantnaagntaacnggccnaancngactatccgacaaagggcctccaantttcaattcggnccaanaacgagccggatg

SEQ ID NO: 93710 - DNA, 483 bp, Triticum aestivum
  unsure (1)..(483): unsure at all n locations
  Clone ID: PAT_TA_93710
ttatcatctatccaaagctgcaatcttgctcacaaacttgaattaaaccgacaacttttcaattaaacaaagaagcacatcttgtcaacttctgtgatcacaatggctccctcaaaaacccacaataaaatgaggactctaaataattttaccaagcgtgctcgcttcagcttactgtgttgataattcgggccgccttactggatttcactactctactaccggggccggcggggccgagtggtatccctgaagtcgaggggcttaatatggggnttcagtccccgccacatagcccctctctcgctgcccaagcctctagtaatcaactcatgtcgcattccaaatcctggggatgatacatcaattattaaacgaggaaagacaattattagagggggctgcctacaacatccgggaanagtgtgaagagactcttttgngagacaatgagggtagctttccttgngtgaagaaggaaan

SEQ ID NO: 93711 - DNA, 367 bp, Triticum aestivum
  unsure (1)..(367): unsure at all n locations
  Clone ID: PAT_TA_93711
ccaccaccaccgccaaattacttccacaatcctcacttatcttaacctggaatgccagcataaatactatttccttgccatcaaaaatgatcggaatagagggaagttaaataatcgggctatcgatgggaagtanttttgattatattttagagttttggattaaatttacggcgaaatgttgaatttatgatttaaagtatataattgggcatggtaactgggaaactagggtgaagtaaaaactcgtctttaaacaaaaaagcagacaaacggagactttgaagtcgaaggtatagatgtacatgtattgtttctatcaaatttaggctgngctctgaaaaagaaatctacccgcggttantca

SEQ ID NO: 93712 - DNA, 503 bp, Triticum aestivum
  unsure (1)..(503): unsure at all n locations
  Clone ID: PAT_TA_93712
ctcgtgccgaattcggcacgaggttaatccatctagcgagagggaggcgcctgaaggcgacgacgccggcgccagcgcaagtaccttggcgacgacgccggcgcgaggtcgtgtcggcgaaatcccggctgggcttggtcgtacttcgtagtggtcgctccctgacgcccccgtggacgccagggcgaggtcctgggagatgccggcgccgcgcatggacctgggcgacgacaccggcgcgaggtcctggaggcaaacccctggntgggcttggtcgnagtggttgaccaatggagcaaantgattgtggatgtccaccaaggaaagttgcggttcaaggacttgtttcaacangcggnattttgaggtcaangttcatatnaaagataggaaatacctntttggtgagggtggaggctgatctgnaaantggagtgttgttttggggatcanancaaanattggccttgctgcttatcctcctgcaacaaaaacgggaggaa

SEQ ID NO: 93713 - DNA, 492 bp, Triticum aestivum
  unsure (1)..(492): unsure at all n locations
  Clone ID: PAT_TA_93713
ctcgtgccgaattcggcacgaggcgaagtgggagccaacgccaagccagccgagccgactcctctcctcctcgcagcagttcgttcccgattcgnccccaaatccagcgccctccccgccggaatccggcgncgaatcgagcagagagcttganctgatgctatggacaacttgtggnatctcggngatgangttccgtgggcaancaaaggtggtggnggaccgccaatggnctctcannacatcaaagctgggtgagatcacaaantcaaaggctgngaggatgaatgactttttgtatgcaaggatgaacaccgtccctnatgtgnagcantgggataagcaatccntccaccacnaagacaacangatgggggnacctcantcttgggntcatnaaactggggtctttttatgaacgatctcacccatgaacgaggntggccangaaagtanccttttnncaanatggggntntaanatgaaaccccn

SEQ ID NO: 93714 - DNA, 540 bp, Triticum aestivum
  unsure (1)..(540): unsure at all n locations
  Clone ID: PAT_TA_93714
ctgcagcctacttaatcgtcagtaaataacttcagccaaaccttcactaatgcctaatgatttcaagccatagctaacccaaatttatttgngccttatcaatcgtaatttactatttatcatataaagaatcatccgtctaaaccgattacaatttaattaccgcatgcttatccatacacaccaaactgtnacgcaggcagtaccactcgccgtgtgtgtatgagttgggtaccaaataaaagatactctaatccagaatgaattcaggtggggggggatgcaaaagctcttcgctagaggaaaagttgcagagctacgtacgggngctgantaagtggggcctnagaaaagataaaaactacacgggctaaaaanaatccncactaanagaaggncgnttgcgaattatgtcaatgaggcaataatgntatgggggggntctccttcccccnctattggttggcttgtttgggaactgcncantccaanaaaattaaaaaaaagggggttttttatttccangttaanttccccccg

SEQ ID NO: 93715 - DNA, 326 bp, Triticum aestivum
  unsure (1)..(326): unsure at all n locations
  Clone ID: PAT_TA_93715
agancaacccgctgctcaacaaggtggacggnccggcgccctccgccggtggnaccgcctccaagaaggncggnggnaccacctccggcaanaaacccgcggccggcaacganggcggnggggggttcaacctcggcgggctcttcgccaagaaaggntaagntgaaccaacccncctaatancttagcgcgcgcntgggtgcgtggttccanctcaaaactcnatttattgntgtaactccatgaaaaacancncaaanattttgatatatgtatatncggtgnggctaatcaaatgaatcntnctgtgntgccttaaaaaattt

SEQ ID NO: 93716 - DNA, 452 bp, Triticum aestivum
  unsure (1)..(452): unsure at all n locations
  Clone ID: PAT_TA_93716
gctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccaagctgcggntgctcctgctgcaagctgctagatcgatcatcgaccatatgcatgcaccgtgcccgtgcgngaatccancgattnatntcgattttacttactaccaanaccaatgttaacccgcnacccttgntcganggggccttttntnttntgccacccntgaaccntggcatnnaaaaaaatcaaggg

SEQ ID NO: 93717 - DNA, 532 bp, Triticum aestivum
  unsure (1)..(532): unsure at all n locations
  Clone ID: PAT_TA_93717
ctcgtgccgaattcggcacgaagagctcccagctttttccccttccgtcccgtcgccgccgccgctctagggtttcctcttcccgatccccgatccggatccagcagcagcagcgagcgagcgatggcggccgcgggagacgccggcgagaagaagatgatcacgctcaagagctcggacggcgaggagttcgaggtggaggaggcggtggccatggagtcgcaagacgatccgccacatgatcgaggacgactgcgccgacaacggcatcccgctccccaacgtcaactccaagatcctctccaaggtcatcgaagtactgcaacaagcacgtccaggccaagcccgccgacgggggccgcggccgccgncggagcctcggacgccgccgcccccgccgcccccgcggngggactcaagaactgggacgccgngttcgtcaaggtcgaccangccaccctcctttcgacctcancctgggggtgccnanctaccttgaaanatcaagggggntgcnggggcctaacctgtn

SEQ ID NO: 93718 - DNA, 424 bp, Triticum aestivum
  unsure (1)..(424): unsure at all n locations
  Clone ID: PAT_TA_93718
ctcgtgccgaattcggcacgagcttgatcttatcggtggtagtgctacaagcgagtgacactaagttcttgcaccgatcagatccaacttctgcacaggatgctggacaagctgtgggacgacgtggtggncgggcctcgcccggagacgggnctcgacaanctccgccggggcgccgccacccaanccctcgccatcaacacaagatgcaggggaggcgattaancagtcgccgtcgatgccgacgaccccnaccacnccggtgacgccgtccgtcgtccacacccgccgcgcggggggaanagtgtgggggggcgtttttcnaccccnggagcaaacctggngcaccaaaaagctcgggggcnaactcttctnancgngccgcaaggccaaaatcccccaccggnctaaanaaatggggntt

SEQ ID NO: 93719 - DNA, 522 bp, Triticum aestivum
  unsure (1)..(522): unsure at all n locations
  Clone ID: PAT_TA_93719
tctcaatatgcgtncgagcgcaaggaggctattcaaaagaccatcatgtcaatgactttaggcaaagacgtgtctgctttgttccctgatgtcttaaaaaatattgcgacaggagatttggaccanaanaaacttgtctacttatatctcatgaattacgcaaaatctcatccagacttatgtatactggcggtcaacacatttgttcaggattctgaagatccgaatccactggttcgtgcactagcaatacggactatgggttgtattcgagtcnataagatggtagattacatgggnagaacctttgngcaaaacactccgagatgaatcaccgtatgtaagaaagacagctgctatttgtgtgggcaaactttttgacctgaattctactaagtgtctanagaacngattcccnccaggggggggnccggtncccaaantcnccctaaaagggagtcgtnttacnccgcgctcaactggggcgtcnnttttaaaacctcctgnctnggnaaaaccntg

SEQ ID NO: 93720 - DNA, 162 bp, Triticum aestivum
  unsure (1)..(162): unsure at all n locations
  Clone ID: PAT_TA_93720
aaacaaaccaaaaaattttcctccccaaatctctctccgcccctgggngaaccgcggagcaangaaagaagagnncgtcgggctaataaactcgggggntcccctcntatncngggggntttnggcgttaactgntgggggangnggcgccccnnttcttcg

SEQ ID NO: 93721 - DNA, 230 bp, Triticum aestivum
  unsure (1)..(230): unsure at all n locations
  Clone ID: PAT_TA_93721
cttantcctcttcccgtaacgcgtcagccctcanancgcgctccctttcgtctcanttttntccccgaatcaagcacgtcggncgacaaatggggcagatcataacgctccggcccgggtgcgtcgaggagtatctgcagagcccgcatatcgcctggccggncgtattcaagcaaatgaaggattgnaacttgggggggtataccatcttccaagatggcgccacacac

SEQ ID NO: 93722 - DNA, 430 bp, Triticum aestivum
  unsure (1)..(430): unsure at all n locations
  Clone ID: PAT_TA_93722
ctccaatccaatccaatccaatccaaggggggggncgagatnaaagccaccggagatgaagttcttctcggcgttcgacccntgggcggtgttcttccgccgggagtgggggcgcacctggggccttcctcgccggcttcgccgtnacggggannctcancaccaaaatnacngccggnttcaccgagganganctcaagaactccaanttnntccaggcgcacaanaacaaataatcaccgcccncccggcccgtccgccgncaggtcacaagggcaaaagctgagttaccggnatntgtccntgttncggngaaggcaanccccnnccccncaactgtgattganccttctgtnttttggtcgnatgcaaacagcncgnaatttttgccgctcctgngggtgttngngttataaaggaacaattggat

SEQ ID NO: 93723 - DNA, 236 bp, Triticum aestivum
  unsure (1)..(236): unsure at all n locations
  Clone ID: PAT_TA_93723
aatgaaatcaaccatcaaggnctagagctgaagaanggaggtctgtttgttgatnaaagganctgacagtttccaagctgatgtggagatanactttgagctgacgtccatcnataaagccgatnctttcgacccctcctggcttttgggcgtccagaancantgccgggaancgggtgcancaatcaatggngggatagggccanttgggcntnttgtcctgncctcnggcaaca

SEQ ID NO: 93724 - DNA, 362 bp, Triticum aestivum
  unsure (1)..(362): unsure at all n locations
  Clone ID: PAT_TA_93724
cctcctcctaacaagctatatacctacatagcacagccatggnccccaccgtgatggnctcgtcgggcanctccgtcgctcctttncangggntcaagtccancgccgggctccccgtcagncgccgctccaacggggntancctcgggagcgtcancaacggtggnaggatcangtgcatgcaggtgtgggccatccagggnatcaaaaaattnnagaccctgtcctacctgncancgctcannacngggggnctcctcaagcangtnnactacctgnttcgctccaaatgggtgncttttcccccagttcaacaaagggtgggntnatctttcctggaggaaaaagcaanccccnggggt

SEQ ID NO: 93725 - DNA, 510 bp, Triticum aestivum
  unsure (1)..(510): unsure at all n locations
  Clone ID: PAT_TA_93725
nagccacaacaggngtctaagggtgtactaaagcanaaccgtccctatttttccaaagttcanctcantcacagtttaacccaataaaagcattaagattacatgttttatccgcggtgaanggaccggatggntggcttcancggccacaatgactcaccaactgngggagagncagccctcanatctaccaaaggaantgagggatttggnaagaagtttncaacaacancaagtcatttnatagggggncaatcncaantgcccattaccaaaatgcgatgaatgncttacacatgcaacttcngngaccaaacatccaaccaagtatattttcacttgtcaaaacnaanccaacanatcntgtgnggtctcnattgnccaaatcaaagatccagtatcngggncnaacaaaaattcctgnggaanttgtnaaaaaanntaccnggaaattggngaaaaaaatttctcnntttccanggggttccangncaacnggggccccggacc

SEQ ID NO: 93726 - DNA, 419 bp, Triticum aestivum
  unsure (1)..(419): unsure at all n locations
  Clone ID: PAT_TA_93726
ctactgngagcagagacntgttatcancctgcaanctcaaaaaaattggggtnacttctttatttgtggctaaagcgaggnggggnatggnaagattgagttatgancctccngcgagattgtgaagacagtcattaatgagaagttgcacattgncgatgtatttggtttccccncncgccnaaatctcganaaaantcccgccnaattntcgcacgagggggnngganatacatcggnaanctgggacttctcaaaaaagantgggnttgggcaaacctcgngcgggggggcaaaactcaaacttncaaaaaacaacccgcncctttnncacaaaaaaaaggangttccccccccnttttttnngaantgtggggggggggnaacaacaggcccnggccggcantaaggggnaaaat

SEQ ID NO: 93727 - DNA, 458 bp, Triticum aestivum
  unsure (1)..(458): unsure at all n locations
  Clone ID: PAT_TA_93727
agctcgctctctccaccaaccaagaacagcaggaactcgacctcngngcancaacgaatccnccgccgcccggnaaaagggatncaaagctccaatgggtgggaantanatcgtcgccgggctcgtcggntcctgtgtcanctcgtatgcctgtgactacatcgtttctcanaagaagatcttcngtggnancancccanggactgtgtccnacaaagagtggttttaagcgacngagcaaaggttccanngctggncccnggtcnctgggccgccggtcatcaannaaacccancaancgccanaacttnatcgncaanggnctcaaacccctgagggntcaanatnttaangggttgtggggcggttgnggaaccttntcccganggggagngccngttgctaaatcnacccatgtgggggtggggtggnnctctccanggggaattttttttggt

SEQ ID NO: 93728 - DNA, 355 bp, Triticum aestivum
  unsure (1)..(355): unsure at all n locations
  Clone ID: PAT_TA_93728
ccgttcgacaatttgcaaagnngcacttggtgataaatnataaaatatttccccccaccttttcanntgttgcgaggnactgaactcaacacacctcctttcatcgngatggtgtttgtttgtcatttgtcatgttacaaaaattgngncttgtannttgntgaatcgagataatcnatcccagtttgcgcatatctatgcattgatccatgtnntaanacaatattgggtatcntgctgntttcagatcaantgaacnactgnaactcttnaanaaaaaaaaanaaaaaaaacnccnagggggggggcccngntaccaaatttccccctacnantngagctcgtattaacncgc

SEQ ID NO: 93729 - DNA, 492 bp, Triticum aestivum
  unsure (1)..(492): unsure at all n locations
  Clone ID: PAT_TA_93729
ctcgtgccgaattctgcacgagccaaagacccaccggagaaaatgcaccgcgccggntggatgcgcgttcgcaacgcattcaagccggcggctgtgcgccggcagagcaccaaggcgaagcgtcggcgacggcggngccaangcgggcatctgcganggcggggagcctctgcacaccaaaggnggnggcggcggcggcggcgangccgggaatggttctggngantccacggaaggaccanccgtcgtcatccccgtgaccctcncgggcatcgccatntggncctgngagaatcagtcggagatttcatcaatgangcgccgtatcanctgnggggatggntgggtacgttgctcccgcttcccttccacaaaaagaggtcccccgagccgccaaactggggcgacttctccgcctatnaatcttccnggcgagactgcgagaaatcntcgnagtatatgtntccacngtnatcccnntttagggtttca

SEQ ID NO: 93730 - DNA, 479 bp, Triticum aestivum
  unsure (1)..(479): unsure at all n locations
  Clone ID: PAT_TA_93730
acggnacctaccccctcctgccccgattcaaacccccacctccctccaccttctaccaccgccgctgcnagaccaccggtctccgtctcgctgccccgcccctgtccaccttctgccgccgccagagcaccgccgtaggttgccacccgccgcgccactccatctccttctaccgtcgcccctgccacaccgcccctcccatgcatcgctttgcccaacccagttccctagtgtgccactactcctccccgcaaccacctgcttgtcctcttcggcgcagcccaagcgatcctggcggccctccgagggactgggccgttcctctatgggccaagatccggcgagattttaccaatcccgcacctcctcgagccagatncggtgagatccatcggntctttcctctccgacgacggcncaaaatcacggcctagagtgctcggggtcctcctctccgtccaagggcaagaagcangcan

SEQ ID NO: 93731 - DNA, 261 bp, Triticum aestivum
  unsure (1)..(261): unsure at all n locations
  Clone ID: PAT_TA_93731
ttttttttttttttcaataagagacttagaggctatcaagttttagaaattagntctcttttggncttttctcctctagctcacttgtccaatgccacctgaggatcccgccacaactatcttgaatcccatgttgttaaatgttagatgcgtaaaatttctctgctattgaatcttgcttaaaatttgggtgttgacgacagactaaaatttcgatgataacgagtagggagaaagtatgaatcgaaacctacatanatt

SEQ ID NO: 93732 - DNA, 485 bp, Triticum aestivum
  unsure (1)..(485): unsure at all n locations
  Clone ID: PAT_TA_93732
gagaagacagttttcacagcttatagctactcaaggcctgatttgcatcagtctanagtcatcccaacgcttgtctacacacctgaccagcagagccagagtgttcaagctataaccttccctgagaaatgtttggcctttgctgacacactttttccacatcctagggtcgaagatctagtgtctagccaacagacttgccatggatatcccaatggacaatcctccttaaatacagtcaccatgaataaatgggactggcctgaactaactattgatgaagtacaaaatgcaataccaataaagaaaactgcaccaaggcattgactgccttgattggactattatcaagatggcaatgactatcataccacaagttcttctatcaagcttacaacagtttatttatcagtggggaacatccaaagcaatggaaaaatgcagtgggtatcattatccccaaggaggaacaaaaagggactatn

SEQ ID NO: 93733 - DNA, 528 bp, Triticum aestivum
  unsure (1)..(528): unsure at all n locations
  Clone ID: PAT_TA_93733
tcctgccaatttaatcaatccaaaaggggtcaagcacctctcctttggactcccgcccaacaagaagacatttgcattgaaggaagaaaaaaacaaaatccatccaatcccaacaaaacaagccctttttcttccccaaacccttgtttctacaattaagaacgctcactgtctccggcactcaattttaatttctcgaggaaatcctctaaatgaaggntccatatgcctgcttcgatggcggcactgactggtctctcgcttctggtgccttcggcgtatggaatggaattttttaactggcggcgataatgcaaagatttctcgtcaagcttaatgatgggttttggattacggggatcctacaacaatacaagcgaagacaccgattcaactttatcccgagggacaaatccacggtgncaagacgatttgaaaatgcccgatacaagagnaacactaatgagggagcttcaangggtttaaaaagcattantggggaagcccaaacccaantcnaactcctaa

SEQ ID NO: 93734 - DNA, 647 bp, Triticum aestivum
  unsure (1)..(647): unsure at all n locations
  Clone ID: PAT_TA_93734
ttccccgggggctgcaaggttccggcccttccttcccaaggctccttcgtcaaacaagncctggctttaaatttgattaaataataagacnggnctgggaaacaaaaaattgccctcgacttttacgaacctacntaagaatataacctatcaatatctccctggctnggcattctcttattcaccacgacatgggctaactcttgggcgacgattctccctccgggaataagtgaaataaaacttcaaagatctaagntttttaaataactantgggggaaacgataagtctaagatcttcccgcaaaatttgtccgtttgtggggggtcctcaagtccggccggggaaaaatcaatcaagtaactttgaaaaaataattggntngggacgccgaattttcctaacccaaggggggaagtnggcaattggtcaactccnnaagaaccntttggattccntcaaacttaataaaacaattcccggacccgganggaagggattgtcctcctgggagaaaattttccngggaggttcaaggctggaaatgggggccgaagnttcaaccaacggttaccaaagcaagnaaggattccacaaagattttcaaagggacngtcaaagcgaagagaanttgaagaaacgaac

SEQ ID NO: 93735 - DNA, 473 bp, Triticum aestivum
  unsure (1)..(473): unsure at all n locations
  Clone ID: PAT_TA_93735
acatcatcgcccctcgctgccgctgcatctcgtctccacaacccactgcccccggaccaagaggtctcggagatgtcggacaccgatgagcacacttcgagtccaaggccgactccgggcgcctccaagacctaacctcaacangccggcgccatccgcaagggtggacacatcgtcatcaaaggccgtccctgcaaggttgttgaggtctccacctccaagactgggaaagcatggtcacgcaaaagtgtcactttgttgcattgacatctttaatggaaagaagctttgaggatatcgttcttcatcccacaactgtgacgtcccccatgttgaccgccaagattatcanctgatttgacataactgatgatggatatgtcagccntctaactgagaatggnaacactaaggatgancttgaaccttcccactgatgatgtttctgcttgggcaaattaaagactggattn

SEQ ID NO: 93736 - DNA, 632 bp, Triticum aestivum
  unsure (1)..(632): unsure at all n locations
  Clone ID: PAT_TA_93736
aggaacaagggaaacactcctttgaatcttggaagtcacaaatnacaccacgcatttcaattgtcctcccctttaatttcacccnannctggaactcctgaaagtcccgatnccttgctttcttcttcttccttctttcaacaaatctaattctggtcnatgtctncttggaaaaaaagaaanacaacgcacgcaatttcaaagacacggaaactggtttgcaagccaagaagtcaactcaactgggtcaatgntgcatcaatnaagctccctccctttgggncttttgnggcgtccggngtcatcctccngnggcgnggtncttccttggtacgggtggtaccaaagctgggnggaattgaagggagggtaagaacgggcgaaacntttgaagggaanggctgnaggcnccgggtgaagncaaggcccaagaaaggaaaggtaagctcnnaaaggtggggcccggacggtttgancggttggtccggggggaattccaaccccctggcctttgcccctccccctgggtgggtngacacttggggccaacggancgggtgaacgaagcaaagcggtggctgaaggggtaatttccccggaagcgcnaancgggnggttgaagccgaagaatg

SEQ ID NO: 93737 - DNA, 584 bp, Triticum aestivum
  unsure (1)..(584): unsure at all n locations
  Clone ID: PAT_TA_93737
ggggtgnccttttggtactcggtcaaaggtcgcctccgcccanatcatcgtgctctcctcctactcctcctaacggnaaagttacaaccccgcantgggcgtgggctgttccgaacgancttggccccgcgttcaaccgcaaaggcaacgccgtgggctcatcgtgctcatgcactcgccctggtaacaacaagcaacaaacttaccactacatggaggggggaagacgaatgcngggttgcanttcgagaagcttggctcgtcgcccgccaaaggngggacatcggtcctcgccggggcaacgtccactccctaacgaagcggcaagcccgcccgcttctccaaacgtcgccctacaacatcgtcaaacggggaaanggccaacgccccgttgcgcgaacttnggacgccgccccgtctacgttancaatcnggngaacggggggnaaacaatcgaaggggcatcgccaaacaaacttnaacgggaggcccgcaagncggtcctaactcctgncgtttcaaggganggcgaagcnttccngggcnacgccgaacgcctgggagaattnaagnaaaccgggnng

SEQ ID NO: 93738 - DNA, 426 bp, Triticum aestivum
  unsure (1)..(426): unsure at all n locations
  Clone ID: PAT_TA_93738
ctcgtgccnaattcggcatgagagaactangnctcgagggttttttttttttttttttttttttttcggccacccgcggntccccagntcctcaacgcgnccatngtcgnggatncccaccgcctccacgcgtcgtcgccgcagnttcccacagcctccaccccaccagtccaatncaccgacgccgggctgcccccancagcctantganccgncgccccctctcccggatncgcgaagccccattgacgcctgcctgccggacaccggccaggatctcgcggncaccacncancactaccaaggngggcnncccatctacgncgntggatcccgtcttgccggaggttnccncaaagacgggaggaacacatggcttggagcccgccgggcgtcggggagggatcaanancnggggcgggagct

SEQ ID NO: 93739 - DNA, 374 bp, Triticum aestivum
  unsure (1)..(374): unsure at all n locations
  Clone ID: PAT_TA_93739
ccgaattcggcaccagagacgaccaacggattcgggaaaaatagttattcaacctgaacggacgggcttaacaagactgggtgtaatttctcccaagatacaaatgttgcgtcttggncgacctaagagaaatggggttggttaaagccttttgccaatcccgtcaaatttgggatacatggtccttacaaccctctgncggcattaatgggaccaacgaagggagggcacgaaagaaaacaacgtangcctggaaaagataattgggntttttcctactagatttcataaaaatctgccctaccaaanatttaaaaaaaggtaaccancccgnngcccgcccccatcccccaatccctganctcnccctctac

SEQ ID NO: 93740 - DNA, 506 bp, Triticum aestivum
  unsure (1)..(506): unsure at all n locations
  Clone ID: PAT_TA_93740
tgcangctctgccgaattcggcacganggaacggcttcatcncctgcgcttactagatctggcaagctgttcgactacnagncattttatctcagttagncaagatttattcttaaagaacagtctgatatcacactaggtattaatactcacatttgatccccttgatttcatcgtcaaacgctttaagaatgaggncataaacctcatctgcgaagggattcgtacttgtatcgacgcccgttgatctatcaaatagtattatccgcaatcttgtcactagtgctttgacacaattgtaccttgctgagaaatggttcaaaattagattttgaaagaattttgatcccattgccccgtgcttgggnatcgnacatctgtttgaccgttcctggngtaccaacctggctagaatataagggtgacctggactttttatccccccaagccaaatcgggntgnacggntgaaacgagggacattgaangannggactccnagatcna

SEQ ID NO: 93741 - DNA, 500 bp, Triticum aestivum
  unsure (1)..(500): unsure at all n locations
  Clone ID: PAT_TA_93741
gcaagnncgtgccgaattcggcacgagggataatgaaattaaatttgngtaaaatattaattaaatccctgcttaacccaagncaccctccggnataaacttgaaactttcgtaagggctaagntctaactaatccaatttgtaatgaattattaagctgccgagtcaaatacgagctttatctgaacggctcagaacttttctattctttggctactgcctcaagtcttaaattttcctgctctttttgatatttttcatgtatccagtcattcaaaccatgcctatttcttgcgatttcaattgcataagaactgcatacggggtacaaatataggctccttcattcccatactcccacttcgggtttgatcttacaattgtaccgaagctgtaatccgtccactctattgttgtagccatcataaattttcgccaacgttctttgcctgctttacttttcatttcatcctcgntaaacagtaacctgcggggtcgaa

SEQ ID NO: 93742 - DNA, 512 bp, Triticum aestivum
  unsure (1)..(512): unsure at all n locations
  Clone ID: PAT_TA_93742
cgangaaagccatcaaagatgccaaaataccctaggtgatggctagatgtcgacaaagccatcaaagntgccaaaataccctaggtgatggctagatgtcgacaaaaccatcgaagatgcctaaaaaccctagtgaaggctagatgtcgacaaaaccatcgangatgccaaaataccctaggtgatggctagatgtcgaaaaaaccatcgaagatgcctaaaaaccctagtgaaggctagatgtcggacaaaaccatcgancatgcctaaaaaccctaggtgatggctagatgtcgacaaaatcatcaaagatgcctaaaaaccctagtggaaggctangatgttgacaaaacccccaaaagatggntacaaacctatttgatgggtcaaaatacattaattctaaacaagatcagatttcatccaaagtactctaaatacaatcacatttngcattaatttcaantccatacataatcatnggnacctaagntttngtactttacaagatt

SEQ ID NO: 93743 - DNA, 485 bp, Triticum aestivum
  unsure (1)..(485): unsure at all n locations
  Clone ID: PAT_TA_93743
agatctgaaccttattggggatacctggctaagatccatttggnaacaagtattcttccgattggggacagctacagaatgcaagttatacagatatcacacaactaataaagaaggggtttactgtccgatttcctgtggacaccaatggcatgtctttgtctgaggagttaagaaagaacatcaatacatgcctcactaagttcaacaagctatttcaaggagcaaatatctggtggaaacattgtgagttggactcntgcttttttctggattgaantgcactcttaaaatgcatggntcaatcctttaacctcncaacaaggntcgttttgggntattgcaaccaatagnaactattatttgccccaagttccttttcgtaccaagcaggttattgnggcacctttggcctggggtggatantccnancctacaaagtactgggaaacaaaggatcaaaaattgatgctggttgagaaatc

SEQ ID NO: 93744 - DNA, 594 bp, Triticum aestivum
  unsure (1)..(594): unsure at all n locations
  Clone ID: PAT_TA_93744
ccnaantaaantgcnctcacgcggggggggagctctagactantggatcccgggctgcaagctcgtgncgaattcngcacgagtcgagttttttttttatcaagggtcacacacacataagtacatgggctctcctcctcggcggcgcagctgttcctccatggcgtgnggcggtaccccgcatggagtgggtcccgagctgcccgctgacctcgtgctcgccatcttcgcgctgctcccctccgacgccgaccgcgtccgcttccgggccgtctgccaagaggtgggccgccggtggcggcgttctggcgcccgccggccgtggctccgtcggctcccgcaccgaccgctccggncagggcgccgcccatgtcgtccttctggctctcccaagccgggccactcgtgccgtttcgcccgccgccgttcccttcccggggcctgggaagtaacctctccntctttcccacgggctaaccctcggtgntctccgaaccccctccggggcgttcnccaaaggggaattaacgnctgggtcaaaccccggtcaaccgggccgggcgcaatcccgctcccctcccaatcgcccttctt

SEQ ID NO: 93745 - DNA, 496 bp, Triticum aestivum
  unsure (1)..(496): unsure at all n locations
  Clone ID: PAT_TA_93745
ctcgtgccgaattcggcacgagcctcgacttgcgccgccgtccaaccacttcctcctaccgcgcccgagccttccctgcccgagccatgcctcgtccctgggcccctcctcgcctcgccgtccgacgacgaacaccgccgctgaagctcctccgccatggacgccgggccccaaggncgtgcctctcctcctcctcaccttcccccctttccgttttcccctaccatgggctctctcctcacgtcactctctttgcaggagcaagctacgccctggncaggagcacgccaggcgccatggccgccgaaggaactccgccacctctcccctgcgtctaagtcgccgtccgtgccgaaggccgcgccaagtccctctccggagctgctctgtttcttgcccgaacccgcatgagcangagntccctcctcntcttccccgtggccggcagcaagaagagcaagattaaagcccgttgccctcctctcctttggaagca

SEQ ID NO: 93746 - DNA, 509 bp, Triticum aestivum
  unsure (1)..(509): unsure at all n locations
  Clone ID: PAT_TA_93746
ctcgtgccgaattcngcacgagctcgtgccgaattcggcacgaggctaagatgagaacatggnataaatgggagaaagaaattcaacaaggaagactcaacgagcgtgaaaagaggccaggctggatgaaaccatctgctgtaagatggattattgcattcttcaagcagttttataattctgtcggtaaaccagattatcaagtactcagatcagcttttgttctgcggcactacccaaatcgcccagactttgatttccacaagtacatggttcgtgcccttgaagcatgatttcaaagaagtagttggaatcagctggtacctatggcttttcgttatccgtcttcctgctgctgaatataaatgggtggnacacatacttctgggctgtctttcttgcccttgattcctctgcttattgttgggnactaagctgggnggtacatcagcactcgattgggctcaaagaaagcaacggatttgttctggatgaaagcnatcaaggga

SEQ ID NO: 93747 - DNA, 492 bp, Triticum aestivum
  Clone ID: PAT_TA_93747
cgcttcatcgctcacccagtcgcgtgcatcacgacagcctaaccatgaagccgagcgccgccgtcctggccgccatcgtggcgctgctcttggtctccgccgtgcggggcgatgacgcctgcaggtcgccggagtcggcggctcaggaccgcgcgcgggcaaaccctctcaaaatcgcggccttcttctccatcctggtttgcggggcgatgggctgctccctgcccgtgctggggcggcgcgtgcccgcgctccggcccgaaggcgacgtcttcttcctggtcaaggctttcgcggcgggggtcatcctcgcaacggggttcatccacatcctccctgatgcgttcgacaacctcacgtcggactgcctgccttctgacgggccgtggaaggacttccagttcccgttcgccgggttaggaagccatggttggcgccatcggcacgctcgtcgtcgaacaccgtcgccacggggtacttcacgcgcgccca

SEQ ID NO: 93748 - DNA, 492 bp, Triticum aestivum
  unsure (1)..(492): unsure at all n locations
  Clone ID: PAT_TA_93748
gtaacaatgaatcttctgcctgctaacgcgacacgcgcaccatccgatgggcttgattgcgaaagtcttggagtcacggttcacaactaagtctctcgacaacaattatacaggcaaacattgagaccaaaaagtataaaggtagctttacatttcacctcaaccgtcgaaatttacactggagctattcttaacccgagtgagagtctgaaataacatcaaaatactcaataatattggtgacctccacgagagaagaccaatatttaccaagttaatcgatcttagtaactaaacataccaagtctcatcctgcatggtangtaatgggtatcaatatgggccctataaaagataacataaaaaggaaagcgaccgatgaacccaatgaaattccaaacactaagcgggntaaagacggnatccagtcagccagaaaaattaaactcccaagcaatttgcctttccaagaaaaaacctgctataatttgg

SEQ ID NO: 93749 - DNA, 491 bp, Triticum aestivum
  unsure (1)..(491): unsure at all n locations
  Clone ID: PAT_TA_93749
acgccgccaagatggncgggnttcgccctcgccaactctgccctcctcgtctccggcgcgagcgcggagggggcgcccaagaggctgaccttcgacgagatncanagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggncgagggcatccanaaagaacgaaccgccggccttccataaaaccaagctcatgaaccgtctcacctacacccttgactaaatggaaaggcccgctcgaggtcggcgcccgacggcaacctcaagttcgatgaaaaagacggcatcgactaagcgggcgtcacccgtgcanctccccgnagggcgagcgagtgcccttcctcttcaacntcaagcaactcgtcnctaccggcaaagcccga

SEQ ID NO: 93750 - DNA, 180 bp, Triticum aestivum
  unsure (1)..(180): unsure at all n locations
  Clone ID: PAT_TA_93750
gatcccccgggtngcaagctcgtggacgaattcnggacgagtctctccctctccggcccccgcccccttgntctncacaccatggccgaggacncccccaacgccggngcctcanganatccaccccgcgtgtactgaagcctccgacgaangctgctaacccctccggnaccagcaaga

SEQ ID NO: 93751 - DNA, 544 bp, Triticum aestivum
  unsure (1)..(544): unsure at all n locations
  Clone ID: PAT_TA_93751
naaaatcacaggactcttcangagcaccacaaaaatgagacctttccaacttttgtctgcnattgcagtattcattggtttggngacagnagaggctgcatcttattggnattgnnatggtactccaattccaaatganaaggttcgagatgcagtaaatttggccttttattatgcaccaggatcttttcatgattacccctcagtttctaagcgcaagatatcgaggggctggaagaaagcaantacgacagtttccactaacaacttccattggaaactggcaaggangagaagtagacttcctatattttgactaaacatanatgcgtcttttctcgaagttttttcttcaaaaggaactgggccaataagtgggcatattttgaaaggcnaagcccngtcctgggtggtggccgagcnnaggctattttgttgnctatcaaagcgtggaaaagtgcaaaggacaatctgggaacggggatnaatacgctataaaagcggtcatagccctcccancnttacaaaattttcccaaaaggna

SEQ ID NO: 93752 - DNA, 537 bp, Triticum aestivum
  unsure (1)..(537): unsure at all n locations
  Clone ID: PAT_TA_93752
ctcgtgccgaattcggcacgaggacgaccatcggcaaatcacaagatgcctgggcagagcctctcaaaagggacaactgccggtcgtcctgccacttctacaactgctgccgctaccgctgcgtgcaaaagcgtgcgtacggctaagaatgaagaacctgcatgggacatggaggcatttcctcagttctgtatgacgtgtgagaagcaattcctccactcacagacaaccttgctatactgctctgataggtgtcgtctgcgagaccaagccggcgctatctaatatcacatcttcgcgcttcatctacaacgactacatgccaagctacaaatcttcgaactgaagggncaagatattcttcctcgatattccgccgactccgtcttacccagctccccatcgtccgggcttctancctaatcaaagccttagagtctttgcgctctcctgctacgggngctgcccccntgtcnaaagaatagctcgtccccatccgtggccccgttccccgancaaggtcctgggattcnggng

SEQ ID NO: 93753 - DNA, 455 bp, Triticum aestivum
  unsure (1)..(455): unsure at all n locations
  Clone ID: PAT_TA_93753
ttgcaaaggtgtgtgccgctgctggcctcatgggagggcttctggtgatactgggaaagatgtagattggttttgtgtagaactgagatgacagatatgactaagctgagctggtatttggagtagcagagtaacattttaccatttcttggnttctctctgtgtgccgttgtaatggtgcattcgtgggaaggcttgcacggatactancaaagatctggattagaggaacatggagtgcttctttttgttttggagtggccanatgactatgttgagctggtatttggtgtaatgtggtaagttattgactgtttccttgggtaagtaagctgtgtgccattttgtggcgctttgttagaacccgcaagagaagcaagaagaaagccnaagtgacaagattgtcnatattgcaagntgtccccaaggtaaccctgaaggctttggctgggcca

SEQ ID NO: 93754 - DNA, 459 bp, Triticum aestivum
  unsure (1)..(459): unsure at all n locations
  Clone ID: PAT_TA_93754
ccccgggctgcaggntttttncttttacttgcgctgggaattcttacacactccatganaactcaagtcngccatcnttgnaccatctcattttgcgnttctagaaatcatactaactagaccaagaggctgncgaggattgcttaggcnccnttgctgctggnntacacccantctcntcccctttaaacacagcttttacccaaaagaanttcntttttaattgtacccccactttgactgngacancgacaatttcantatcnncctccataattgaatgtntgnnatttcctacagcgcaaaagttcatattttccgncattttggctcgctacntttgnagtttcaatttccgnnagtcacgnncaaaaacggtnattggtacngtcnatatccnactngaanaaggtgngcctggncacaacacatcaactccgcatcgggcacantacaggg

SEQ ID NO: 93755 - DNA, 274 bp, Triticum aestivum
  unsure (1)..(274): unsure at all n locations
  Clone ID: PAT_TA_93755
ctcgtgccgaattcggcacgaggacaaattcaaggggaggatcagtggtcaagccgagcaggacgaaatcaaggggaggatcagtggtcaagtcgagcaggacgaaatcaaggggaggatcagcgctcatgtcaaatacgaaatcaaggggaggatcaaggagaggatcacggcttcagcccagaaacactcagtgataattttactgttgacagtactcaatgataaaactccatttttcataaaaaaaaaaaaataanaaaaaagggggggn

SEQ ID NO: 93756 - DNA, 381 bp, Triticum aestivum
  unsure (1)..(381): unsure at all n locations
  Clone ID: PAT_TA_93756
ctcgtgccgaattcggcacgagtcaagcattactcccacataactgcaatttttttcaatattaagtcatgcaagattcggaagtagtcttggaacctcctgtcgaacctcaatcaaggcatgttgtgtactgtggagtttgctatttaccacctgaatactgtgaattcggnggaacagtaaaaaaatgccaagaatggcttcanaaaacacatccggnaatgttccatcaagttgtgggccgaagattcattatcangaagcggnttcttcctctgtccgtccacgcactcaagnggagcagagaaaagncnctctcaangnaagntatcnaaagnccaggctgncngaagntaaaacaagctgccaccanttggagca

SEQ ID NO: 93757 - DNA, 488 bp, Triticum aestivum
  unsure (1)..(488): unsure at all n locations
  Clone ID: PAT_TA_93757
agacagccatggcccccaccgtgatggcctcgtcggncacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcaacaaaggtcgggttcatcttccgtgagcacaaatgcgtctcccgggtaactacgacggccgctactgggacaatgtgggnaagcttnctatgtttcggggtgcaccgacgccaacacaagtgattcaaacgaggtgggnggagggtcaaagaaaggagtaccctgacgcgttacgtccgcatcatcngggtttcnacaacnatgng

SEQ ID NO: 93758 - DNA, 513 bp, Triticum aestivum
  unsure (1)..(513): unsure at all n locations
  Clone ID: PAT_TA_93758
ccgggctgcaggctcgtgccgaattcggcacgaagcaacctttggctcacttcatttgagaatccccgtccaccaccggcgcacttgccaccggaattccccaccgccgccgctgccccgccgtcgcggcgtcatgctccacctccggaancgcatactcccccacctcctctcaggcacgccctctccttctacatccccantcctctctctcgaccggcctcntctccgccgtttccccgaaccctaagcttcgccgtcggcgactacctcgtcgacacctgcggggctcacccgtgnccaaggcaactcaaggtctccgccacgctctcccacctcaaggtcccccgccaaggcccgacgcgggtcctcgccttcctcgccgggnctcgggcctctccnggngntgatgtcgccggggcgtcgntcgccaaggggaacccgaagatnctctggtgccggcggtnggngnaaaacgnttgnccccccggtcctcnnctgggggttnaccgg

SEQ ID NO: 93759 - DNA, 389 bp, Triticum aestivum
  unsure (1)..(389): unsure at all n locations
  Clone ID: PAT_TA_93759
ctcgtgccgaattcggcacgagctcgtgccggtcatctggatactattcccgtcaataagattcttcaatgggaatctgacttcatctctcatttaaagactagtgagcccgaaattcttgctactatcgacaaagagggtgcgctgagcaaagatctcgagacgaagttgaagagcatcataacaacatttaccaaaaggtttcaactaaaaaatctaactgcantatgcccaacagtgttttcatttgttcaaatttgtctcaattaacagagctgcgtgtatttcaaaattgtgattaggaatgaagagaatcaaaaggcaagaatgttggtagatgatagcacgattgtaaattagaaatgcttcaatgctgcttttatatttac

SEQ ID NO: 93760 - DNA, 501 bp, Triticum aestivum
  unsure (1)..(501): unsure at all n locations
  Clone ID: PAT_TA_93760
agattcacgacacctatctttcacttagattctcannatgcctcgccanagcaagatcaaggtngtgcangtcgcgctcctgctcgtcccaaaatcgctccatcgaaacccgctgtgccgcagcaanagtctcgtccagcatctacgcttgcccatccacccactgcacanccacccagctcggctgggcccaggaatgctaggtcaaattgcctcaacggcggccggtgttgcgattggctcatccattggaaagtgccattggtggccttttcggcggatctcaaacgggtaggctgaatcancacctgctgcangagtcttcaaatcaaacaaacaanctgggccgcangaaagctgtggatatgacgtggctaagcaagttaaactaaggtgcttagattgataaccaagggcanataatgcaagatntggcaaacttggtnattttaagaaacaactngnaatcgtgncaagcagggctgncaagccaagttatnt

SEQ ID NO: 93761 - DNA, 256 bp, Triticum aestivum
  unsure (1)..(256): unsure at all n locations
  Clone ID: PAT_TA_93761
gagagagagaactagggttcgcgcctccccgccggtccccgcccgccgatcctctccccgccgccgcccccgaggatccgcggccgctcccgtcggtcgccgctccggatncgcgccgcncgcgcccctcgacgccgccgagctccgtccccgccccgcncnggggncgctgaaanangagaaacctttttananatcancggggcagaagnaaggaaggacgcagcnanntcaaatggnggggcctccgtgttaa

SEQ ID NO: 93762 - DNA, 445 bp, Triticum aestivum
  unsure (1)..(445): unsure at all n locations
  Clone ID: PAT_TA_93762
gctgcaggcttttgacgaggttgagccggtttgttggaagtttgttggaagttgttgctgttgctgttgctgttgattttgttggttaggagcatcagtgacggctttggcgtaacttctgggttgatgatgagctggggtagcttgcggtgcggcagaggtgctctatgtatcnaggttataaattgactgtctagtctggggctgggatggacntgcngagtaaggccctggcggtccaggtgaacctctgacatggcattcaanagtgcctccgcgccacaaagtttaaatccgcgnataaactcgcggnatggttttagaaangtgnttgtgggaagggnactctccaaccaanttnncgtccncaaagggncgcaacccaatnattttnnaaaacaannaggggggggcccccttgnatttcctggtngtcaagnggcgg

SEQ ID NO: 93763 - DNA, 458 bp, Triticum aestivum
  unsure (1)..(458): unsure at all n locations
  Clone ID: PAT_TA_93763
gccactttccgatttcaatttggcaagcatcaaacgatttcatcaagaaatatagtactccctccgcaaacttatataagagtgtttaccgagggagtacctttttggcattctccgggtccgcgcacgcggngactatctccaggcacacagcagcatcctcacggcagttgcagagccctccgtcgcttggcggatgtgcgcatggtcttcacgaccggcgccgcgtgacgcggaggctatgcgatcccgcggcatgacagcgcccgctcaagagcctccgttgcgcttctcgcgcgacggccatcggccccggtgaggtcccccggtggggtggncctccatctggggcctgtcggnctccaaggganaacngctgncctccgcntggtcncaagccctttgggtcccancaggcgngtcccaagtagggtngccgtcnggtgggtgacaacgtt

SEQ ID NO: 93764 - DNA, 269 bp, Triticum aestivum
  Clone ID: PAT_TA_93764
ctcgtgccgaattcggcacgaggtttttagattgatacctaagcgtgtcgcatggtagtcagacatgcgactcgagtagcatatgcacggtaaacctcaactccaaaatgatgatacgaatcaagttttatatgctacgtcctgtatggctagcgtggttggaatatgggaaatttacctgtagatagataaatacgttgtagccctctgatagttgggacaagtcttctacaatattatatcggggatcaaaaaaaaaaaaaaaaaaa

SEQ ID NO: 93765 - DNA, 465 bp, Triticum aestivum
  unsure (1)..(465): unsure at all n locations
  Clone ID: PAT_TA_93765
ttgtcttctcttacagcaaagtgccaagattttctgatcgttgccgcttcaattaatccctccgctctatcttaagagacatataaataccaaagaaaagaacgccacgagtcatgtcacaactcgatgccttctttggtcaggtagatttttgctcaaaccactttattgagagactaaggaaggctgttgctattccatctatctcggcggatgaagaacgtcggcccgatgtaattcgtatgggatcatggctggctcaagagctcacagcactaggcgcagcagtanagctaaggccactaggaaaacanccgcacaaagaacatctagaactacctccgggtagtagctgcgcgatatggtaacgacananataaacganctatccctaagtctatgggcactatgatgtgcagccctgccaagcaacagaangacgggttgggccacaagaggccttcg

SEQ ID NO: 93766 - DNA, 461 bp, Triticum aestivum
  unsure (1)..(461): unsure at all n locations
  Clone ID: PAT_TA_93766
ctcgtgccgaattcggcacgancctctccccatccgtcttcctcggtgctctcggcccctcnccttctcccctcccatcctctcctctcttnatacgcctccgcccccgagctctcctcccccattccgccgcattacgtcgcgcacacgggcaggggagagccggcagcgganagngagcangagacnagatggcgggcgngtccttcaccgcccgcnaagttcctgggcgccggtggtcgcgagatccggnggcgaccgggcgnccttcnccgngccgtccgcgntctccatggagntcgcntcnggcaanaaggttntcgccaagggngccctcantntcccggtccntgngacacgctctccttccnatagctgcttcaanggcacggnggncccgnccgtcacgcacgacngttagtcccgcgctgtggctggaacaaccgnccgcaaacganggg

SEQ ID NO: 93767 - DNA, 216 bp, Triticum aestivum
  unsure (1)..(216): unsure at all n locations
  Clone ID: PAT_TA_93767
tccacaatgtgnncaaaaaccaccgcacttcaacaactatggggntggggagnancaacaacagtggcngcacggtggntctngncttcttgaccgtcgncgtggtggtctccccgggcctgttcgnccctctggngggnngcggcttcnactcngcgacgtgnccccaaaatggngaaanaacatgctgtcctccctncaagngggggctccaaa

SEQ ID NO: 93768 - DNA, 291 bp, Triticum aestivum
  unsure (1)..(291): unsure at all n locations
  Clone ID: PAT_TA_93768
cccaagtccctttccaagctcagntcactgagattcangcgtttgtncaanaanaaacttgnngggtcaantccncgggagctgggcaaactctccnanctgaaagtcattgttttgtctaanaaagacttatgtgggacgatcnccgtcgatgggccattctcaagcttcnctcttcnaagcttctcagaanaananaaaagctgnacggnccggngctgnaaggagtggnttccnangacttctcggtgctnggagagcacccgtgnacaccacaatgcacgtgggagg

SEQ ID NO: 93769 - DNA, 323 bp, Triticum aestivum
  unsure (1)..(323): unsure at all n locations
  Clone ID: PAT_TA_93769
cttaagagccancctcctcnaagaantccaatggtcaacttntactcncccctgggctaatccaaccaatctttcggttcaaaaagggaggagggnggggggnctggtccaaatntcgtggncgccatgggggngcaantngcggngtcagcgaacaatgtaatcatcnaagaggngaacaagggnctgaaccctggggatgataagncctgcntgtgggtgcgancanccngctgcttttctttgttgggaantatgcgctgtacctgtatgcgcaaaanacgctccctccnnagaagaagaangccagtctccaaaaagaa

SEQ ID NO: 93770 - DNA, 452 bp, Triticum aestivum
  unsure (1)..(452): unsure at all n locations
  Clone ID: PAT_TA_93770
gagggtancctccaaggnggncgncctcgtccgagantccgcgggctacggggnanncctcgctgacgcgctccgggcgtcgccgggggtcangangggntcctcgcccttngatntccctctcgataagtanggnctcaacgggganaaagnctctggngagctcgttagcttctctgantccantgggtctcctcanggggccttttttgntctgcctgantanangcctcctgntgntgnatgtgntatgaaatgagattttatgcantganttcttctgaagctccctccaaccaacccgttctgnttgtgccattcatcacaaggacaacaaggtgnttccatggaatgggtnatggaaacaaaaactggggcanntaaatncacntcacgctnctgaaataaagggnancaaaatgaggttaaacacactgtttgggtngtgggaa

SEQ ID NO: 93771 - DNA, 278 bp, Triticum aestivum
  unsure (1)..(278): unsure at all n locations
  Clone ID: PAT_TA_93771
ctcgtgncgaattcggcacgagcggnantgcccgaggaggagaaaaaangcttcttgtgtaaanatcaangagaagctgcccggcggncacaaaaaancggaggacgctgctccggtgnccgtcangcacgctggtccancaacaatgaacgcgccggcgccagccgccgaggaggtgagcaaccctgacgcgaaggaaaaaaaaggcctactgggcaagatnatggacaagctgcctggttancaaaaagacaggggaagggggnaaggccgccccc

SEQ ID NO: 93772 - DNA, 336 bp, Triticum aestivum
  unsure (1)..(336): unsure at all n locations
  Clone ID: PAT_TA_93772
ttttttttaaattaacgtgcattgcatttgacacccccttcactccgctgggagcttgagcactgatgggtccaggctggatctggntaactactttgtaagtacaataaacctcgttccacctgaaggnctgggccacctcangatttaaccatgtgttgnaaatgncaagtccaaccgttcanagaacccgattctgacgcgccgaancccagtttcaccttcaaacttggncaccangtacccgagcgggtaatatcctcccaagctccaatcnattctttctggtcaaaactaatcatggctcanctcanctagggggtgnccntcccacta

SEQ ID NO: 93773 - DNA, 429 bp, Triticum aestivum
  unsure (1)..(429): unsure at all n locations
  Clone ID: PAT_TA_93773
gagaactagnctcgagntttttttttttttttttggatcttgnacgggaaattgattacctgcatttttagctatgggtccttctacgctattcaagaccttgggcatcattaaataagcatcaatctttttccagcacacagnttcatcaatgggctatcantgacctggaatgatgtaagctccactcangctcctcctccccatactgncgggaattaatccattttaacatgttggtgggcacctctccagcttcctgatcctgntttaagaccacaaatcgacaatatgttctctccaagccaaaaannccgcactggggnaaacacaaggaagntggtccagagncaaatacctcaaggaaggcgccccctccctttgaaggncccangggggggtcctcgcaaaaaaaaactttcgttcccg

SEQ ID NO: 93774 - DNA, 230 bp, Triticum aestivum
  unsure (1)..(230): unsure at all n locations
  Clone ID: PAT_TA_93774
gatttgggataaaatgnaagntctntaaccanangtgcatgncatatgccanatgnaagtatgggataaaatgnaagntctataaccttttgtgagaaggagggaacatgttgcatatacactcnngcgntaggtcaaatntgccnaaatgcacaactganttnctctgggaaanctgccnccgnanatcaantgttgtctccgcgtccccccggcggggntgggaaatt

SEQ ID NO: 93775 - DNA, 513 bp, Triticum aestivum
  unsure (1)..(513): unsure at all n locations
  Clone ID: PAT_TA_93775
ctcgtgccgaattcggcacgagccgatatggtaagcgctttacaagatatcccgcacagctcagtttctatactaacaagaaatctccaaagatggngtgttaagatgtggcatatttctatggagctctcngaaaacaatgccaagcttcacaagccgcatgaccgccttgagacgcgacggggatgaattgtatgagacgttggtaaagctcaagcgtgaccttcncaacnanaggcaacggacgacgcggntgagacagcangcaaatatgtctantgtaccccgggctatggggcaaaatattggggggttccaaactttacgagggaantattggnccccatactcgcttcaccacgggaacnagatgttcaattcaattccntatggncaagncnggtacaantacatggggtnccanagggttcangaaaccaangaacgnctcaacancccatgtcnatatgggaaacatgtctcaatttcaacaancaacaacgggcannggng

SEQ ID NO: 93776 - DNA, 555 bp, Triticum aestivum
  unsure (1)..(555): unsure at all n locations
  Clone ID: PAT_TA_93776
aaaattatttanatcccaaactatcaatttatcggggcacaactccgcttcaacaatttgacacgatcccttggnatttctgcccatgaaacgacaaaaccttggggggcactttatgcgggttgncccgacagtatatcggggtccccaccaacaagaattgccatcgttgagcaacggnatagctttccacaaagcgggtcctaactcaatgntgttaccaacaaagtggggcacattaanntttgggggaggaaaaaggaagnattcaaagccccgntttaccaaatggngggggggttgccccncgaaaaanaaataaanttggggcctttccannaacggggggagggnttttaaaaggttgggnttgggatccaaaaggggggngcttttcccngggnttcaaaaaaaaaagngggcaanaccgaccngggttnatgggngggccnggaaggccctcccctttggccctttttgggaaagggggcaacccnaaccnccngcccanttaanaaaggggggnttttattgttaagggggggggccccggnc

SEQ ID NO: 93777 - DNA, 573 bp, Triticum aestivum
  unsure (1)..(573): unsure at all n locations
  Clone ID: PAT_TA_93777
cgcggtgngcgggacgctctaagaactaagtgggattccccggggctgcagggctcgtgccgaattcggcacctcgtgcccgaattcggcacgagacgcccaataaagaagtgcgatggcgcaaaaataaggtctcgttcacatgctaagaaacaccattgcagtaccaccgtcagctatgcacgaataccgccagccttaccatgaccaagccagcttcaatagagcacaggaatacattcttaccttctgtctatggagttccccgagcctcactctacggatctcaaggcanttcgcaaaccacaatttctactgacatggaccaaatccctatcactcactcaagcgaaaatcaancataggatnacaaaatagcctacagnacgccttctattttgcatgtgttttgctgccgttaaagctgttgggacacacatgtaaagcaaacagggtgtttcgggaaaaggatacaactgagacgaaaaatcgnttaaaatctctggattcaaagttattttgacaatgaagagtgggatggttgaccgggagatttcaaaagggcccgggatn

SEQ ID NO: 93778 - DNA, 202 bp, Triticum aestivum
  unsure (1)..(202): unsure at all n locations
  Clone ID: PAT_TA_93778
tggggggccgctcctaagaactaagtgggttcccccgggctggaaggaatcngcacnagggagggagtggacaagcaaagatgggtatcaacctgttgctaaagcaagttgaatgggagaccaaatgtntctcntgtttggtggggaancaagaccatntcaattccattacancactaagttatgtatgtcccntgnaata

SEQ ID NO: 93779 - DNA, 376 bp, Triticum aestivum
  unsure (1)..(376): unsure at all n locations
  Clone ID: PAT_TA_93779
ctcgtgccgaattcggcacnagcacacattcactttgttgcttcaggntgcaacagctaaattatagctacaatgggtctgaggntgtgggcaagctcacantgncaangccctcaagatttcaancanaggggccangggcgctgtgcccgggctaanccatctccaaataattctccancgntattgnngggtttgantacacttcctcccacaagagggncaaaaangannggtccntgtggcanaattgggancanaggccacacccaaggggcanctccgggaagnggngttcccggngctgcccgggacccgnacaaaagngngccaaagggggggcnttcgaaccgtgggagagtgtganggacaaaag

SEQ ID NO: 93780 - DNA, 168 bp, Triticum aestivum
  unsure (1)..(168): unsure at all n locations
  Clone ID: PAT_TA_93780
ctccgtggccgaanttcgggaacgaagattctactctaagagcaagatacaaaatactgggaccaaccatgcgtncttttggttngcaaaaatcaaccggcgtcctancaaatccttaagactacccaaatggngatattcaaccccatcggcaaaggcctaagctcg

SEQ ID NO: 93781 - DNA, 392 bp, Triticum aestivum
  unsure (1)..(392): unsure at all n locations
  Clone ID: PAT_TA_93781
caaaagtcaacgaagctgggagncatccaacaacaacgaaatggaagcttnangggtaagccttcttcctcctggtggancanggacgcgacgggccgggncggtgactttctncnncgtcgaaacaaagagtntgggcancgccgggngggaaagcgcttctacaaangcccgtccggnctcgcgtaatcaaaaaaaagncctctccgancggctccaaccttcatctggggggaacttcaaacaaacncggccgnntgccggancgcaaaaacctgtcgacggccgtcaancctccttcgtgggangganatncaaagggnggtncgcccttcaccaaatngncaaacngggatccaacctcaaacggccangttttgttcnnggggggg

SEQ ID NO: 93782 - DNA, 224 bp, Triticum aestivum
  unsure (1)..(224): unsure at all n locations
  Clone ID: PAT_TA_93782
ntcgtggcgaattcngcacgagcggncgtacacanctagctggccanctctcaaaggctcgctcgaatcatcanctagcannctcnaatcatcancatggggtctgncgggcgccgtcccacgggggtcangcanattgctctcttcttcgtcgtcgcgggggncancaanaanaantccntctgncttggtgccgccgccggcgannccactgcagggtctgg

SEQ ID NO: 93783 - DNA, 511 bp, Triticum aestivum
  unsure (1)..(511): unsure at all n locations
  Clone ID: PAT_TA_93783
gcgatcgtggcgggtctcgttgcgccggncgcgaaacctctcgggctctccggcgcgcggcggcggcagcaccggggccgatggagagttgcggcggcggcggcggccggggtggacctcaaggcgctcgggtccgccatcgacaagaaggacagccaggaggccaggcaggcgctggacgaactcaaggagctgggctgggccaaacggtgggagctcgcagccctacatgtcgcgccgcacnacgtctctgagggagctcancaacctcgggatcaagaacgccgagaacctcgccatccccgagcgtcaggaacgatgcggggtttctgttcaacggtcgtccggcaacaacgggattcctgggcgtccttgcaaggcaagctccccggggatttgggggttcttccgtccctactttgaccnggaangaatttccttgctagtactaagccaatcgggaagcaatatctccaaggtcctcctgcaaggttgcaaaattgggtttttc

SEQ ID NO: 93784 - DNA, 426 bp, Triticum aestivum
  unsure (1)..(426): unsure at all n locations
  Clone ID: PAT_TA_93784
aatgaatacagccaacattatcactgncataggatctctgaatattgacctcgngaccctcaccccacgcataccgtctgggggggaaactattacagctagttctttctcaagctggccccggaggaaaaggnggnaatcaagctaccgcatgcgctcgactttctcgtcccaaaccaacgtttgnaccccatcttacccctactccagatattatcgttaagtttattggggcgataggggnaagataattttggnactcanataatttcttttatgtcaagatgtaagnattgatacatcaaangncaagatcgtcgatagacaagcccacaaggggggggcgttattctcnctcgcaaaaagacacggggggagaannccaattttggttaagtccnaggagcaaacctttgtttttggtcc

SEQ ID NO: 93785 - DNA, 449 bp, Triticum aestivum
  unsure (1)..(449): unsure at all n locations
  Clone ID: PAT_TA_93785
tctacaatacagaaatggtatttcgtctataatgacttgacacagctaattctgtaactaacaccgaaggntatggnttaatgattctcattctcatgcaatgagcttagatgtagtacatggaatccctcatactcggcggaataacaatgtcctcgatcgtttggntggnggcgccactcatcanactctggggctcacttgggtcgaaaacttcaaataagtaagaagcgtacccttgtggcangagtaaatcaaacaaaagtnaagcaaggagggcaaaagaccggccgggttttttgttgnctccgnccaaaccanaatgaccncaanattgggtttgggcaaattcccncaaaggggnaacaancggtnggntttttttggggnccnaccctttaaccnttattgggggccggggaaaaatttccgcccaattatcaaaaaaa

SEQ ID NO: 93786 - DNA, 373 bp, Triticum aestivum
  unsure (1)..(373): unsure at all n locations
  Clone ID: PAT_TA_93786
ctcgtgccgaattcggnacgagggctccgtctccatcccccgccgtcatccccggggggcgaaaaaccccggagttgnccancggngcggncgtggngcctatggntaccgtggggcaacccgcggggcagtccacttnanggaaaaanctggncttcttcnggtcanagggcgccgtccaaacgttcnacttgggtggaactgttgtgcgcgtcnggccgaggtccttttganaagnnggcaacgngaanaactaaaaaaggtgtggttttatncaaaccctaacgtgggngggggaaaacgggctcaaaaggaggtcaacaaagtnctggngccnnaaatttcntntaggggcnatgtggggggaatttgg

SEQ ID NO: 93787 - DNA, 545 bp, Triticum aestivum
  unsure (1)..(545): unsure at all n locations
  Clone ID: PAT_TA_93787
ctcgtgccgaattcggnacgaggtcaagctgttttcggnaatgaactgttcatgaaatttactggggccagccacaattctcatttccaagccgnacagnacaatttaacgattgggggnctctacaagatgcaaaaccagttggngctgaacctcacccgggcaaatcaagtagacctcatgtatgacgcgactcntctaggtttatccanacttgctttgcgcaagattgttggaatatcacaactaattacaaactaagattgatgnnaaaaaaaaaaaaaaaaaaaactcnaggggggggccggtanccaattcccccctataanngagtcntantncgcgcgntcnacnggggcgttngntttaaaanggtccgnggntgggggaaaaccccnggngggtannccnaacttaaatccccctttggaggaaaaacccccccttcccccanaggtggggggtaanaacngaaaaagnggcccgcaacccggttngccctnccccaaaaaaattgggcaacccctgnatnggggnaacggggg

SEQ ID NO: 93788 - DNA, 152 bp, Triticum aestivum
  unsure (1)..(152): unsure at all n locations
  Clone ID: PAT_TA_93788
ggtatgtnacttcctgggggnggntggtaaaattnagagtaaagtgntnccaagggtttggntatttnaaaactggccaaaacttnaaaaaaaatggaatnctgggtttttnatggggtggaagggaaggtnaacccggataaatccccttt

SEQ ID NO: 93789 - DNA, 390 bp, Triticum aestivum
  unsure (1)..(390): unsure at all n locations
  Clone ID: PAT_TA_93789
cgcagacagacagaacttgagagagcgcacgcgagatggcagcctccatgatcacctcgccgattgtggcgccgacgagcgtgccgtccctctcccgccggggctcctccttcgccgtcgtctgcagcggtggcaagaagatcaaggncgataagcccctcggactcngaggcggcttgacantcgacatcgacgccaacggnangaaggtcggnaagaagggcgtgtaccantttgttgacaagtacggtgncaacgtcgacgggtacagnccaatctacacgccanaggaatggtctgagtctggtgaccgctacgccgggggnaagaccgggcttcttatctggggcgtcaacctcgccgggctcctccgggggggggtcctcctcg

SEQ ID NO: 93790 - DNA, 448 bp, Triticum aestivum
  unsure (1)..(448): unsure at all n locations
  Clone ID: PAT_TA_93790
ctcgtgccgaattcggcacgagtccgagatttccagatggacaaaagcgatatgggcaaagagtctgcggataaacagacatcatcactagccaccgatcttcagtacatcccctacgaccattcactcgaaagaaagtacttgccttccattaaagcactcatcgccaaggacttgagtgagccatacagcatatatgtttatcgatactttctctctcaatggaaagatctatgttttatggcgctttctcctactacgcaagctcttatcggagtcataatttctaagctcgaagtccatgtctcacattctcccgccacatttaggggctacatagcaatgcttgctgtgtcatcagagcatagaaatcacggnatagcgacatcattagtgagggaagacaattgacgccatgatagcncgtggagcaagacgagggttggtg

SEQ ID NO: 93791 - DNA, 475 bp, Triticum aestivum
  unsure (1)..(475): unsure at all n locations
  Clone ID: PAT_TA_93791
cattcgcataagaatggcagcaccatccatatcaactttactgattggctaccatttatcttctcaaccctcggaatgctcataatcaattctatcgaaaagacccgactttcggccgatagcttcagctattcgggtggagacgtcgcatggaaagctcgagtcgtcctttttcttggctttgcaagcttagctggtggaatggctgggtggtatanctgttttggttctgaaatatgtacttggaaatgctgtctgggcatctctctacatgggagttgcaaatatcttcctcctaacgcctttgtgatgctcagctccggtcatgctttggggtcagtcaagaaattttgagggacgaaanactcngcanaaatttggntctaatagcgatttccctacaaggaattaattacctaatttaagggnggccaataactcctaccgaatngataaaaatcccaatgaanaaatn

SEQ ID NO: 93792 - DNA, 321 bp, Triticum aestivum
  unsure (1)..(321): unsure at all n locations
  Clone ID: PAT_TA_93792
attacatgcagataactggaaacaattgatagcagacttagaaaagttgagttgctgagtaattatctgcttaccatcctaacgccggctggaacggacgaggcttttcgaatggccatcagaaattgcgctatcgatagattaaacaaggtctcgaggttagattaaatatgaccaaacttcctgaaaggcatgataccagaaaaaaacagagatgttaaaggcggttgatagatatacgaagctatttaattgtaatgaattcattttgtggattcttgttgttcataaaaaacaaaanaaaaaaaaaaaaaaaanant

SEQ ID NO: 93793 - DNA, 374 bp, Triticum aestivum
  unsure (1)..(374): unsure at all n locations
  Clone ID: PAT_TA_93793
ataatcttcttcttctccacatctttgtagagataagaacgagagctgcgcgtacgagtgggancgcacacttctccgccctcancccctgtcttgtgcctctataaatccaccggcgtttcanctctcancgacgaggccggacaacactgnaacgaagaagtgctctgcttttgggtcaagaactcaagaacanagatnggggatacatcgatggntacgttcgcaacgtccacnggggggggtgatgggattggntcccctgggggcgnggtnggtcggggcctcccgcgggtgnccttngtgggngccggggcgttccncccaannattgnggggggccgggaancgggtgggnccccaaaggaaggacc

SEQ ID NO: 93794 - DNA, 163 bp, Triticum aestivum
  unsure (1)..(163): unsure at all n locations
  Clone ID: PAT_TA_93794
ntttttttttttttttttagtcaaatagtcattttgcccagnacagaanattcagttttctacagggantanagccatcgcancggnnaggttcggggcagntactgcaactatttanttcaangcgggggatatccancaanacacnctggggggggnatcg

SEQ ID NO: 93795 - DNA, 535 bp, Triticum aestivum
  unsure (1)..(535): unsure at all n locations
  Clone ID: PAT_TA_93795
ctcgtgccgaattcggcacgagatgaccggcatggncaattcgacttccttcaatcattaagaaaaaacctttatcgctatttttagtggccatctcgagagctttgagtgccgttcgagtcatttcatcaagtgagggataaacatcgttaagattgcgtcgatcaagttcgtagggnatatctgactctgcaaaaagcccgagtaaaggnaaattcatcgattttccgggtcttaagtgcgtcaaattcctttcggctgcttatataattccaaacaaaatcantttctgcaatcttaaaaacatttctatcggcccgtcgacaaactaacaagcgntggtattgggaaagaaaaatnaacagagggccccccccaaaacattagattaacgacgcggaccggggnggggntctctcccaaactttcctggaaggggggaanatcaaccgccaataacccttcgantccttggcaatggcgaaagnggaaacaaanctgggggntagcaacctggnaatgtccggtaggcaaa

SEQ ID NO: 93796 - DNA, 446 bp, Triticum aestivum
  unsure (1)..(446): unsure at all n locations
  Clone ID: PAT_TA_93796
cccacttctacaacgtacccatttctacatcgctctacaattagctcagcttctcattcaatatgtcttcatcaagacctcttgctgggccttatagcctttatcttcccacctattgcggtctgggtcaaacgcggcatctgctcggctgattccctcataaacatctgcctctgcgtcctaggcggaatacccggcctcctacacgcctggtacataatcgccaaatatcccgaaaacgaccatgtcggtgttgccgatccagaagctacgccagtaacctatgtcgtgattcatgaccctcacggccagaatcgtgttggnaatcccaccactcgtcaggtcaatgtcggatatgcgacaatgtcacccgcgggaatacaatcaaatttaatggcggnaaatcaccaagcaaagtccaataggtggaaatgggggtcatgtac

SEQ ID NO: 93797 - DNA, 465 bp, Triticum aestivum
  unsure (1)..(465): unsure at all n locations
  Clone ID: PAT_TA_93797
aaaataaaagtattcaaaaaatattaaccatgtgtgcaaatgtttgacatgtatatgaaaaggtttctgatgtatatgaaaaatattgattgtgtactaaaaaaagttgacttgtgttgagcaaaatataaaccgacaaaaatcaacaaggaaactaagaaaaaagaccaataaaaccaaaagggaaaacagaaacctaaaatggaaaaatgaataactaagaaaccaatgcaaaagaataggaatagagaaagccggaaaaaacaaagaaacccgatgaaaagcaaggaagaaacaaagataagcaaagaaaatagaaaaaggaaagcaaaaaacaataaaagccgngaaagaaaaaaatgggcaagctcaccccgacaagctagcgtggnttcatctgtagggatcactccattatatagcacgcctatttcccgcttggtggcgagatgtggggcanctcnc

SEQ ID NO: 93798 - DNA, 445 bp, Triticum aestivum
  unsure (1)..(445): unsure at all n locations
  Clone ID: PAT_TA_93798
caactacacgaaacgaagttncgcataacttcacgctctgtaatgatccttccgcaggntcacctacggnaaccttgttacgacttttacttcctctaaatgaccaagtttggncaactttccggcccanggtgagtgttaccactctccccgggccagtccgaaagcctcacttagccattcaatcggtagtaagcgacgggcggtgtgtacaaagggcagggacgtaatcagcgcaagctgatgacttgcgcttactangaattcctcgttgaagagcaataattgcaatgctctatccccaagcacgacagagtttaacaagattacccaggtctttcgaccaaggaggaaantcgttggntctgtcagtgtancgcgcgtgcgggccanaacatctaaggggnatcacagacctgttattgcctcaaaanntccaacgggt

SEQ ID NO: 93799 - DNA, 162 bp, Triticum aestivum
  unsure (1)..(162): unsure at all n locations
  Clone ID: PAT_TA_93799
cgccgccgcctctccccccatcctcctctcccanctcctccggggtcgggcancaagaagccatggggagccccgcgcgcatcgacgtggataagctgagcgtggagcaacttaaggngctcaaggagnaaaccgatttggaggncaatctcctccaagaca

SEQ ID NO: 93800 - DNA, 447 bp, Triticum aestivum
  unsure (1)..(447): unsure at all n locations
  Clone ID: PAT_TA_93800
atttgttatcatcaatcaaaaaggaattgatcctttatcactagatgtcctagtcaagaatggcatatttgcacttagacgcgcaaaacgtcgcaatatggaaaggcttcaactggtctgtggcggtaccgcccaaaatagcgttgatgacctaactcttgatattctgggctgggccggaaatgtctatgaacacaccttgggagaagaaaagtacacatttattgaggatgtnaaagatccaaaatctgtgaccatactaattaaaggncctaactcccacacaataacacaaatatccgatgcaagtccgagacgggcttcgaagtgtctacaaatatgattgtggataagagcgtggttcctggtggcggggctttccangttgcatgcgcagcgcatctcaacagcganaactttccgcaagacagttganaggcaaggngn

SEQ ID NO: 93801 - DNA, 379 bp, Triticum aestivum
  unsure (1)..(379): unsure at all n locations
  Clone ID: PAT_TA_93801
ntccccgccgccgccgcangcgccgcctggctcgagccgcgtcgccatggggagaagacctgcgaggtgntatcgggagatnaagaacaanccgtaccccaagtcaaggtaatgccgtggtgtgcctgaccctaagatcangatctattgatgtttgcatgaaaaaaaaagggtgtcgatgagttctctcactgtgttcancttgtctcaatgngagaagggagaatgngtcanttgaggggtcctttngggatgccccgttattgctttgcnacaagtacnatnancaaagccatgncangaaaagggatgccttccancctcaaaggncaagggggtnaacccggtttccatgtggctccgttttnaancaagattc

SEQ ID NO: 93802 - DNA, 485 bp, Triticum aestivum
  unsure (1)..(485): unsure at all n locations
  Clone ID: PAT_TA_93802
ctcgtgccgaattcggcacgagaaggaatcggttgggctggcttgcgccaacctgcatacattgagccgtcaaaaaatatttcctgcgcttttggaggagtctgagttattcggtcgtgactcaggaactctgttgacctggccaatactttacgaaagtatagctttcgttcatggcgtgaagggaaaaactcgcgtcgtcataaatatggaatgcgagcttgttggggttgtgctacgccatgaagataatattgaattatgtctcgagctgttgcatgatgacaacaaagtatctcatgaaggtaatagcttagactcagaagagtttgtgggctaccagtgttcccaagcgacattccgaagattcacatgttttgggatcnttccgtaggggtcttacacaanggnntacaaaataaccctagggctttntccgaagcanggnccttactggaaaaaaaaggntgntgatgccccccant

SEQ ID NO: 93803 - DNA, 216 bp, Triticum aestivum
  unsure (1)..(216): unsure at all n locations
  Clone ID: PAT_TA_93803
ccgcgggtggcgggacgctcctaagaaataagtgggattcccccggggctgcangntcgtggccgaattcggnacnaagctgggggatcactgctgtccaagaggaaagttcctangcatccatctcttccgcccccanatacctcgcttgggnccaaancgtcgtcttttnaagngaggnaaatgaccancgtgtggnanancaaaggtctcccc

SEQ ID NO: 93804 - DNA, 489 bp, Triticum aestivum
  unsure (1)..(489): unsure at all n locations
  Clone ID: PAT_TA_93804
ctggtgccgaattcggcacgagcacaaaagaagccaacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgntcatcgatcatgcatgcaccgcgcgcatgcatcatatctatgatcgatncatccatccatctagtaccaatgttacgcctccctgatcgaggggncttttgtatntattgttaagcaactgccnccatnaggcaagagcanggtgnaactcccaatgcaatgtnnt

SEQ ID NO: 93805 - DNA, 431 bp, Triticum aestivum
  unsure (1)..(431): unsure at all n locations
  Clone ID: PAT_TA_93805
gatatnccggggctctncaagtncancaagggaganctgnctcgggnccttccgcaagcttctcgcccgggtnaannaacccgccgcggggcanccgccggtcanctgngtcgtctccgacgtcgtcatgggnttctncatggagggtgccaacnagctcngnctcacctacgtccaactctggngcgccagtggcatcanctanctcgggtancgncaatancgcctcctcatcggncgtgggatcgtcccactcaaaaatggcgagcagctgangaacggntnacttggncaccncggtgggagacgtgccgggcctgntgaggaattangntcaaggagttnccgtcctttataagcaacaaaggncccggggnggagtacataatggnactaacgtcctgnngggagaaanggagccaacngccggg

SEQ ID NO: 93806 - DNA, 469 bp, Triticum aestivum
  unsure (1)..(469): unsure at all n locations
  Clone ID: PAT_TA_93806
ccnaccaagacgactctcgattcccctcgctcctagggntaagaagcaagccctcgccgccgccccgccgccgcagagacacactcctccctacttgaccgcagccaccaagacttcgcccaagcccgcagccattgacgacgcgaccctgacgccctcgtcagctgccgccgccgccggactgcaagccacccgatgccctcctctgtcccggacgacgccaccctacctccttcctttccttcctgcttcctgntatggcggtgagcgcgcggggatgatggaggccgtcggctccggtgacgcgacaagtgcaaggnaggcgatttcaagacatcggggagggggacagagccgacccaatgacgccgccanatctgtccccgccgatcncttcacggggtgggggaaagcccaacctcatncttttctcaaagggnncaaaagggacgttggggnaaatncctcc

SEQ ID NO: 93807 - DNA, 643 bp, Triticum aestivum
  unsure (1)..(643): unsure at all n locations
  Clone ID: PAT_TA_93807
gtgggcggncgctcctaagaaataagtggggttccccggggctgnaaaggtcctggccggaattccngnaacgaagcgtgattttccgcccctggaaagaaaaaagctgggacaatcaaccctccgggtgtttgccctttggggggccggggtaacccagatctccaatgttccgtgggtgccattgagtgtcctttgtcgccttgggatnaatggggggattcaagatgggatctcgacttcaaagctgctangagactgggggctctcttcaatctcaagtggctaagtgacggggccttcaaccctccaaggatggggacgtcacatttacctcaaaggggaagtcctcctcctcctatgctacattgttatcggggggcttggnttcttttgttacgaaggacaaaccatcaactcaacgccgaaaacgggnaaacgggcaatgctggcttgggattgtcccaaaacgggggtcccaatggaatttgtcccaaaggtcgccaaaaagttaacttggaatttgcttaaaagaagggggctggcctcaagggaaaacntgacaatgccggtggcaaaagacaagcggaacccggaagtggttttgaagccctgaaagccaaccaaaaanttcttgtctatt

SEQ ID NO: 93808 - DNA, 175 bp, Triticum aestivum
  unsure (1)..(175): unsure at all n locations
  Clone ID: PAT_TA_93808
ccgcggtgggcggggncgctcctaanaactaagtgggattcccccgggctgcangctcgtgcccgaattcctgcacgagctccgtcggagagggangcacngggaaaagacgggtatagatnggagaggganctccngngtccaaaggcgcggggggcggagggncntctatgcc

SEQ ID NO: 93809 - DNA, 446 bp, Triticum aestivum
  unsure (1)..(446): unsure at all n locations
  Clone ID: PAT_TA_93809
gaccacaatctatttattcagactagttccactcaggaagtatcaaagaaatacattcagacacacttgtatcaacacacgcaaaggaaatttgcagcttcagcatgaggacacaagctacaacaaacagtctgcattatctgcaaattgtcatacacataaaccatttatcctaaccatgcaggtattgtcccaggtacatccctactttttcagtcaactctctttcagacatagctccgctgctttgttgcaattgttctaccggtggccttcgactccacagttcttgcatcgggcggtcttctagcctgctatggcacatctccgcggtttgggtacgtagtctttttgtttccctgtcgccggcaagtagtgcaaaacatgggcctcttcctcaacccttcataaggnacttcctactgctgggcgcaggcctgcccatc

SEQ ID NO: 93810 - DNA, 411 bp, Triticum aestivum
  unsure (1)..(411): unsure at all n locations
  Clone ID: PAT_TA_93810
tcctaaagcagctatccggcgacgcgccgcggcggatcaaagagataaagtagcaaatgcacgtccttcgagtacaagagctgctggtgccggtggaagttcgagtacaatgttgaggctctacacagatgaatcgccaggattaaaagttgatccagtcgtggtattggntctatctttagntttcattttcaagtgttgtatcattacatgttatcgcgaaggttacaaggaaattttccaagttaggttcgaaaatttgaaaatttgaagcgtctttttactgtaatccattatggagtaaacgaattacttggttaacgtggaatccgtgtattaaaaattccgtctgggcctttgaaagatagcagaacatatatcattttgccgtgcgctggntcaataactttg

SEQ ID NO: 93811 - DNA, 370 bp, Triticum aestivum
  unsure (1)..(370): unsure at all n locations
  Clone ID: PAT_TA_93811
gcaaccatggcttcttatgacaaaacaattcaaggntctcgaggnacctccnatcgtgcaanagctggtgggcgccggngtgcaagagncaccgaagncagtacntggttcctgngcaagatcntnccgccgcgggggtctcccgagatgncgagnccatncccatcatcgnacctcagcngggtgtntgncgggagggccgaagagatcgacaagctgcgggccgccttggggaactggggagctcttcctggatgttnngcagggngatggnggctagctttcttgccgngggncattgaagggaagatgagaggtcttcaaaacttcccnactngggagtnggaaaaaggaagtnctcaaaacaatt

SEQ ID NO: 93812 - DNA, 521 bp, Triticum aestivum
  unsure (1)..(521): unsure at all n locations
  Clone ID: PAT_TA_93812
ntcgtggccgaattcggnacgagatgattctctaaactggnggtccatcgataatccttcatataactaaaagaaaccttgccatcttctgtaaagtagcgaattatatctacctactcacccgancaatgggctccctgacccagcttctgngtctagcaagttcatccaaatcagcttaggtccatattacaatggnaattatggnacgacccagttcacgcacgaaatcaagaaaaagaatcaccaactctcaaagaatgtttcaaataccttacgttgnctaagncgnagcttttcctcaagtgggnacaagaggttaatccnaaggtnctcgnaccggtgtaaaacttttctatcntaacctaaagaggggcttggtgtacaatccganggatgggttngcctatncccnaattnggantccaaaaagganccccccttcctttagannnatttttaaaaaaaaatccccttnggttggaagaaagggggnnggggatttttnataanaaaacngg

SEQ ID NO: 93813 - DNA, 464 bp, Triticum aestivum
  unsure (1)..(464): unsure at all n locations
  Clone ID: PAT_TA_93813
ctctgatgaaatagtgtggcaagttataaaccagcagttttgctcgttcaaactcaagactactaaagaaaaaaatttctgtcgccatgaatacaatgtcaccggtctatgcaatcgccagtcatgcccactggncaattcacgatacgccaccatcagatcgaacccagatactggnnctatttacctcnncatgaaaactataagagcgtgntcacacgccatcaaagttgtgggaacgaatcaaactatcgcagnactacgcaaaaggccctagctcanangtgacgaaaggactgngaatattggncaaagtttcttattccacaaagtggaaacaaangntcactccgtttaacanaaagntgggggtangaatgcgggaggacctgctangagagggntntcnaggctccggnggaaaaaaactantttccacnggggtggggggccccaaatttttt

SEQ ID NO: 93814 - DNA, 480 bp, Triticum aestivum
  unsure (1)..(480): unsure at all n locations
  Clone ID: PAT_TA_93814
ttttttttttttttttttttttttttttttttttttttttttgcaaagtcaaaggtgtctattatacatgtagcaaattacacacttttaaaacttgngtantgatctaaatttcctttatacttttacttttccaggccaatttatcttccaagagctcgcacggntatctgngccttcncntcctcagaccgaatcaattccanattcgcagcttccaatctttttcttgtacgttcaagncgatcgggtctcctcactgcaanatcttttgggttataggccactaaacggcgaacatcaangttttttcgngtgacccaacatcctaaataaccgagtatcatgacagttggcatagcatacntgaaancttccagaaaaagggnantaagtcgcaattttcctcaagtttatctcggggaantaaaattcccgctgggaacaanggagaatgngtntaccaagnttnctcccggg

SEQ ID NO: 93815 - DNA, 267 bp, Triticum aestivum
  unsure (1)..(267): unsure at all n locations
  Clone ID: PAT_TA_93815
ctggtgccgaattcggcacgagagaagctctccgcccccaacccctctatcgacgccaagaaggccaaacctccgaaacccgtcnaggagcgagagacggcggtggcggcagccaagaagccgaagccgaagccgaagccgaaggagcanaaagagggcaaggaggtctctgccaagaagacgaagaagcagaaggagagcaacgagattgacgagatcttcgaggccaccaagtccgacaagaagcgcaagcttgcagggaggggg

SEQ ID NO: 93816 - DNA, 187 bp, Triticum aestivum
  unsure (1)..(187): unsure at all n locations
  Clone ID: PAT_TA_93816
cggaagaagggngggggncttcctccgganggacttcngggcgntcctcctcctgggngtccaaggngcaagggccaacnctgggttgccctccaccaagacgagaagcaagaaangntgggaagggngangggganaaaaaagatgnaagcagancnaattgntcaangcaaaagagaggggatca

SEQ ID NO: 93817 - DNA, 484 bp, Triticum aestivum
  unsure (1)..(484): unsure at all n locations
  Clone ID: PAT_TA_93817
tttttttctagcgtttgttaacaattttacacatgtgctccgaataagaaaaagctaaggattatgaaatgactgtgctccatggcataanaaacgctgcaaatttcagagagctacaacctggatatttcgttattatgtacattaaaacaaactgcatttactaacttttagtaccctccgtatcctgntacctgggacgtaaaaccattagtttgaggaaaagtaacangaggngtatgacnancaactgatccggcnggggtcattaatctattaccgccgaggntcggcgggctggtttcctggttttcctgggnactttccccnagatttacgcccancggtatctttttcctagcancccnantaagnagaaatttggttgnggggaggntanntaatcaagaantgggnaatcnctaaaatcnnttggggggcgtggcgccatgntatcnccaagacnagaaggntgggaaaaatg

SEQ ID NO: 93818 - DNA, 396 bp, Triticum aestivum
  unsure (1)..(396): unsure at all n locations
  Clone ID: PAT_TA_93818
ctcgngccgaattcggcacgaggcacaacaancttanaccatgggcgncgncanctccancgtctccggnctcgccgggggcgngctcgcccgccggncagccttctctatcaacttcannaatggggggcgggtgtcggcgaggaacccgctgatnacgaggaacctgctgaggaacgggaggattaactncatgacgttcccccnggactggttgcggngggnnctgaacgtgatcgggttcgggctgattnggtgggtgggggcgtcnancaaccccctggttaacnggaacancnttgatgggggtcttcttctncagcaacngcgagggaggtcggccaattcccctcacccccgggtctcaatagaaantnttgntggttgtttgtgang

SEQ ID NO: 93819 - DNA, 496 bp, Triticum aestivum
  unsure (1)..(496): unsure at all n locations
  Clone ID: PAT_TA_93819
tggacttctgatccggggcctctcggatcttgggaggaangtgggtgacnggcggtgggcggtgggcggtgagccngcccggagatggncggcgggaaggagccnatcnaggncaagttccggctcttcnacggnacggngcatctggnccagcaagtacgancccgccaccaccgtctccgcgctcaaggacttcatcctcgcccggtgggcgcaagataangnaataactcccaaaactgtcaatgacctgaagctcancaatggtggaaangatattngggaataaccgggcacttgccngagtcccgtgttataaataggagaggnccctggnngggtgtnattacaaatgcatgtnggtaantgcnccctccacaagnttgtcananaccanaaggcaantggggcaatttcccccaaangangaacaaattgtggggtnccaccnatactgtgtatacgggcaacctccccccgcgtggatgtttncntt

SEQ ID NO: 93820 - DNA, 518 bp, Triticum aestivum
  unsure (1)..(518): unsure at all n locations
  Clone ID: PAT_TA_93820
ctcgtgccgaattcggnacgagcctccaacaccatggcccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacctgccacccctctccacggaggccctcctgaaagcaaggtcgactacttgatccgctccaagtgggtgncctgcctcgagttcagcaangttgggtttcgtcttcccgtgagcacaataagcttccccccgggntnctatgacgggtcngattactgggacaaatgtgggaagcttgccntatttttccgggttncanccgnacggcccacaacaaagggngtttaanccnanggtgggnggganggtccaacgaatnggagtttcccctggacgnccttattgtncggcgtt

SEQ ID NO: 93821 - DNA, 335 bp, Triticum aestivum
  unsure (1)..(335): unsure at all n locations
  Clone ID: PAT_TA_93821
ctcgtgccgaattcggcacgaggtccgcgtgggctccatgggcgcgccccgccaggtcgccatcgacgacgccgcgtcgctcaccgacccggccgtcgtgggcgcgctccagttcccgcttatcgccaagccgcttgacgtcgacggcagcgtcagctcccacgccatgtcgctcatctaccgccgcgcgggcctcgcggcgctgcagcccccgctcgtcctccaaggaagttcgtgaaccacggcggcgtgctgttcaaagatctacgtgatcggcggggcaacgccaacgttncgtgcgngcggnggcancctgcccggacgttgccgacgga

SEQ ID NO: 93822 - DNA, 495 bp, Triticum aestivum
  unsure (1)..(495): unsure at all n locations
  Clone ID: PAT_TA_93822
agcttcntctgcaccgcccctgtgcaggtagactaatcaatgcactgcgatacgggaaacgcatatttatttttcaatttcgacgtgactgggtgtcaattatgccangcaacaagataatcaagtttagcccgaaaataaataaaatatgtctgatgggacgctgagaacataagtttgttcaagttcagcactcangaatgcccttaactgtttacacgataccttaagttgataaactcgaataataattcacttgangatcatctcccgctccgnttcgagaatcgttggttctaggtcaggaagaaatatgagccaaccaaggggangacaactcaacgaaatcagancctggggngggctacgaattgcaaaaanccccctgngggggggggaaattatttggggnaatttttcanctgggnnagaatngtcgttccaanccngggnaagtggnnatggggggccaagaantttttcctccgaaaaaag

SEQ ID NO: 93823 - DNA, 206 bp, Triticum aestivum
  unsure (1)..(206): unsure at all n locations
  Clone ID: PAT_TA_93823
gccatccccgcgaaccggagagcgaggccgacaccgccgccncgatgagggccaagtggaaagaagaaaaggatgaggaggctcaanaggaaacgccgaaagatgaggcagcgatccaatgtangcgccttngtaggnggggaancatcatcttncatccaagnctgncangcacngagggatnacggtatgggctanngattcct

SEQ ID NO: 93824 - DNA, 383 bp, Triticum aestivum
  unsure (1)..(383): unsure at all n locations
  Clone ID: PAT_TA_93824
ggataatgtagaagaaccgcttcagcaaaataattataatgataatcctgatccgtcggntgatattactcgagttaatcaagtcaggaaacaaaatttcaaatggggctaatccaaatacacaagacctatctgcatcacgaaattacaatacagtctctaactcaagcagtaggcccaaccccaagtccctccgaggatntttcctccatcctgaaggacaaacctggctcggatnaaaatgaaacaaacaaactaatattgggattctatggggaanataacaaacaanggnggggttttcaaggacaaataaaaatcaaacctgggcccggtnanttaaatnggnttattaccaagcaanctttttcttnncctgggga

SEQ ID NO: 93825 - DNA, 448 bp, Triticum aestivum
  unsure (1)..(448): unsure at all n locations
  Clone ID: PAT_TA_93825
cttcaattctctaactttactcctagatcgacagattcctgctattctatcctatgttgaaggcgaagagtacagcggacagcaggctaaacagcagctaatccgaaacggcagcaataccgttgcatattttcgagattttctgggtcaggagtgagaataggtttctttggtgactcaatctctgctaattggcctcaaacctagtttcgaaagtatagatcggtcgaatggtcgtgcctcggnccaacccctcaaacatgaggntactattgcgtttaaaaatcaaagataaggtaggcgatgaggaatctttgttaagtatccatgagattgtgacgccgacaaatccgacggggtttntccaatctgcaatcctgganttntaaccgggtnaaacaaaatccaatgcggggtgtgnatttccnaattccccacaaaatttcaa

SEQ ID NO: 93826 - DNA, 485 bp, Triticum aestivum
  unsure (1)..(485): unsure at all n locations
  Clone ID: PAT_TA_93826
cttctcttcgtcccgcctcgcccctctctctccctccaaacccgaccctgcgcacgcctccctaccccgccgccatctccttcgccgccgggagctcgcccgggatgactgccgcggggttcctggtgggcttcctcctcggcctgcttgcgctcacggaggccgaggcagccacgctgctctggttcgtgctccgcctccgccgccggcgtggctccggtggactcggacggctcctctctgtctcctccctcgcccccacgtgtggttccgcttcccgctggncacgaggtgcagccttgcaggggcgcatcggggctgggcctctgtttccgaatatggtgcagcagctggctgtgggggttgagggtgttctggcaaacggtaggaagctcccggggcccgtccagggtctgtccaagtgctccatcctatgntggaatttttcaanaaaaactgttggcccaangagaagatctccaatg

SEQ ID NO: 93827 - DNA, 496 bp, Triticum aestivum
  unsure (1)..(496): unsure at all n locations
  Clone ID: PAT_TA_93827
cgcgccccanagcatctgggtacgggcctgaccgtcccaagtacctgggnccgttctccgagcaaaccccgtcgtacctgaccggngagttccccggcgactacgggtgggacaccgccggattgtctgctgaccccgagacgttcgccaagaacagggagctggaggtgatccactcgcggtgggcgatgctcggcgccctcgggtgcgtgttcccggagatcctgtccaagaacggnatcaagttcggcgaggccgtgtggttcaagggcggcgcccanatcttctccgagggggggctcgactacctgggcaaccccaacctggtgcacgcgcangagcatcctcnccatctgggcggtgcaagtggtgctcatgggcttcaacngaggggctaaccgtgttggtnggnggggccctccggcggaggggnctcgatataatctacccaagggggggggccttcgaacccaactttgggctcngccgaangaan

SEQ ID NO: 93828 - DNA, 361 bp, Triticum aestivum
  unsure (1)..(361): unsure at all n locations
  Clone ID: PAT_TA_93828
tggcgaattccgnaacanaaaggcaaagggccctgnancgtcttcancnatnagattgannccctccggagggaangtggggncngaatnggtngggggaaacacgaagagggagcaaaacaattaccaaatgctcaacggagatggacgggttntccggnaaaanaggggtcatcgtgctcnccgccaccaaaanggccgggatgtggctcgactccgggggcttctgcggncangggcgggtcgntntggaanggtcanncgtccnaccgtccgggatgtcgcccgggccgtggtcaaggattcctttgagggttcactccannagggaaaaagcatttgggcgnaaggggtgtaaaac

SEQ ID NO: 93829 - DNA, 653 bp, Triticum aestivum
  unsure (1)..(653): unsure at all n locations
  Clone ID: PAT_TA_93829
caagggaaatccnggnacgaagcaaaaanctttaaacggcgggtaactcaacctcaanaatctcaatcccggcctcgccgggaaaccgtctcaaactaaatcccctcaagattcaagtattcctatcaagcaatgcgccccntccaagncctcctgatctgccntgggnaatccgggcttcccaatcaatgtgtttcctggagcttgaantccggtaaattatccgatgcgggtaattgggcgtccacgggtcaagagactacaacaattccggatgggcaattgtagcaagcctcaaaagganggatatcctggggttaaagtgcaaatgaacatcaaagntcctaacaaaggatctggttgtacactgggagtttttagcgcgcaagtggctaatgaaagcttataccaaatggganggngggaccgtgccaaacaagtaagtggatctcaaatttatccggtacaaagtatnaaaataaccttcaacggtaatcaatatgnaaantccgtgggatttantttattatccgagaaaaatggggaatacgnttactgagggtggantggttgtaccaaggttgtgataaggncaagactaanaaattncccatnccaattacccatgggggtacgggtaaattaacnaacaa

SEQ ID NO: 93830 - DNA, 656 bp, Triticum aestivum
  unsure (1)..(656): unsure at all n locations
  Clone ID: PAT_TA_93830
ggaagggtccgtggccgaatccggaacgagcaaaancaaaatnggtccgaaccaaagcaaacccgcgcgcaagtccnatgggggggaaaggnaccccgaaaacaagntgggttccaagggtggctccgtaaagcgcaacctctaacgggaggggtaaagaagcctcaaaagatacaaagcccgggtactggttggcctcccgagaaatcccgtcggtaccaanagtccaaccgaactcctggatccggaaaacttccaattccaaacgtccttggttcgntgaaattgcgcaaaganttcaaaatccgacctacgantttaatccgtctgcaatccggtgngttacaaggaatcgggtgggggctaactccgtctccctcctcgnngacaacaaaacttatgcgctatccaaggctaagcggcggttcaaattcantcaaaaagatattcaagcttgcccgtcgccttcgcggggganangctcaaaggntaaattagaatttaacaacaaanctttcttgnaaaagaanaaanttttanngctcggnanatgggatanttgggttggganggntaggggttaaatantancgangacacgggttcgttangggttattgnccccgngcaagggggttaagccgggggtttttcan

SEQ ID NO: 93831 - DNA, 507 bp, Triticum aestivum
  unsure (1)..(507): unsure at all n locations
  Clone ID: PAT_TA_93831
tcggcacgaggatcgccgagaagcttcctagatcttgcttttgcgaaaaagagttacgattgaatgtccttcacgaattcgagcacagacagaacttccagtgtgttgcttaatatcaatctatttctaaatatctcatcctccgancttccttaanccgccataggaggnnttagtactcaagatcttttgngactgtcgaaacaatcaagtatggngcctattgaacctcnacgccaactgttgaaaaganactactgtgattttgatgggtactgcnataagacatcatgggatgtctgggggngatgggttgcatcaacaatcaatgncatcacaaanagccctttnggcttccntttttcngggcaaanaaaaacgtcggcgncgcaaacaagggntccnccccaatgtncggganaagagngggtaacaaagctcttagttccaacnacnaaaatantccngatcaatntccnccngantggggcananaanggggnanaa

SEQ ID NO: 93832 - DNA, 437 bp, Triticum aestivum
  unsure (1)..(437): unsure at all n locations
  Clone ID: PAT_TA_93832
tgccgaattcggcaccagctcgtgccgaattcggcacgaggtctcgagttttttttttttttttttctaaggtcgttactattctnaagaacagtagattacttttgncaaagatatttgtagagtttgaggnaccantcaggtatctccatctaaatcaaacctgtttantccctatttcggncancttacaattccctcgaaccgntttttgaaccattttatngattcntcacgnttantcctgtggcctgcnccaatgtgagtcngagntcgacngngnttggaaacagcgctcnccaggccgggtcatgcanggctanaaatccantccgtaaataccgatcgnggggtcatactgantccgngatngaaaacgttcgggtganntccgaatcnaanagcttcctgtcccaangaaattgcgtttgcnnaaa

SEQ ID NO: 93833 - DNA, 156 bp, Triticum aestivum
  unsure (1)..(156): unsure at all n locations
  Clone ID: PAT_TA_93833
ngaaatcgggaagaacctcnanttccggaaaaaaanccgncctttttaancccgncttggcctttctgggcgnganaggctnccccaaccccggcaagatttcggtccctcccgtgggnggtggttccgtcgaccctggctgnccctttnngccga

SEQ ID NO: 93834 - DNA, 263 bp, Triticum aestivum
  unsure (1)..(263): unsure at all n locations
  Clone ID: PAT_TA_93834
cagtcttgccctcacatgaagccaccttgngggatatgtcgtcttncaccccccgtgagaatancacgacatttgncgcccaccgtggggnggtactatgctancgcgctgctgctggtttnncaagtccgggngagancatcttcactatcaccgtcgtagcgtggngctgtctctccggtagtgctcggggggtcnacttctacacacccccngagcggncgcgcgggaggggcgtcctcntcgtcggntcgtgccgaatt

SEQ ID NO: 93835 - DNA, 608 bp, Triticum aestivum
  unsure (1)..(608): unsure at all n locations
  Clone ID: PAT_TA_93835
aagagaaatcctccaatcctcccaacttgggcccccaaatccgatttctcgtctcctcctccccgntcgaaaaangcatggggcccaagggcgagaanaagccgccgcggagaaaaaaccggtggggacggggaagaagccaanggcganaagcgcgtgnccgggaaggacggggggggcgncaaaaaaaaaaaaaaaggcaanaaaaaggtcgagacgtacaagatntacatcttcaaggngntcaaagcaagtgnaacccggacatcggnatctcctccaagggcatgtccatcatgaantccttcatcaacgacatcttcgagaaagctccccggggagtccggcaagctcgcccgctacaacaaagaaggccaacatcaactcccgggagntttaagaacggcgtgngcctcgtcctcccgggngaggtcgccaaagnangncgtctcccggggggaacaaaggggtcaccaaaattcaactcctccctaaattgccgtcgncngaaactcttantcgcnttgtttcgaaaggttcgcaagtcgtcaatcaananggggtagattcccctttnananatgtaaaatgagtcaganttnttaana

SEQ ID NO: 93836 - DNA, 522 bp, Triticum aestivum
  unsure (1)..(522): unsure at all n locations
  Clone ID: PAT_TA_93836
agcaatggggaccaacgcgangggggtctccccctcctccttcgccgggaaaggggtgaaaganctgncgtcgtccgggctcttcggggaggngcgcgtnaccatgnncaanaccgcgggcaaagncaanccggtgtcgtcgggcaacccgtggtanggntccgaccgcgtgctctanctcgggccgctatccgggganccccccaagctacctcancggtgaagttccccggngantanggatggganaacgcggggntctcgggcgnccccnagatcttngncaaaaaacgggagtgggggtgatnantgccggtggggcaanctgggngcgctctgctgcgttttcccggagctggttccccgcaaaggggtnaaatttgcnaagggcgtttgttnaaaggcgggtccaaaatttnaacganggggggtccaatantncggaaanccnactcgtnattngcaangaattncccaanttgggctggcaantcttgtnaanggggcntcaagggtancccg

SEQ ID NO: 93837 - DNA, 613 bp, Triticum aestivum
  unsure (1)..(613): unsure at all n locations
  Clone ID: PAT_TA_93837
aattcggcacgagatgatatcacactttattacattgctgaaaatatagcaacatccacacttatttaactaaaaatatagagagcatgttcttagagcaaacatgcttcagatttntcctacaatggnggaatttaagccttactagtctatggagctaattaaggnagttgatgcttccatcaacactgggattctcgatgtcctcctcccctacacgcatcatctgggatctggnccagccgcccatggaaagagcccagtgtatgtanaggaagagtcgtngcaagagatgaatccttacactgcactactncctggngttgttgctgctgcntgtttggngtactctactttggtnttcttcaaactcaacancacatctctcaagggcattctctgggcaggnaagtcgttnnagnagagcaaanccaactccaatattgggacaagaaatacttcaacaagggtgncacttnaaaaagaggnggccctgnnntaattggggggcaaacgaaactaccaaagcttnccggggaatacacangggtanccaagcccctaangggcaggtcttggcccgacananaaacanagggnnattcccgggggg

SEQ ID NO: 93838 - DNA, 298 bp, Triticum aestivum
  unsure (1)..(298): unsure at all n locations
  Clone ID: PAT_TA_93838
cgcggggctccncgaangggcggggggaancccatctnngcaaggcggccggcgcaatccggtttnaagcaagnatcacgggccaanccnnttctcccgcccaaanatantctccctccaagcatcgnctcatctgaacaactcgctgnaaaccaanattcgcatctgccgattaaggnttactacgattggtanttggtgagcaacttccaaaggggatgggtaccgtcggcgcttggnggggaacaaangatgggtccctnactaacggngnagcctccaggnactgggtngattt

SEQ ID NO: 93839 - DNA, 472 bp, Triticum aestivum
  unsure (1)..(472): unsure at all n locations
  Clone ID: PAT_TA_93839
tccatctcaatcaatctctccctccgncggcggggcancgtcctccccgcgactccgatgggcancaagtgggtcangnccgaggtgtncccgctgttcgcggngacnggcgtgggcatcggnatctgcgcctttagcctccttcgcaacatcaccggcaacccanaagtcnaggtcaacaanatgggganggcaacgggagtgcttnanaaccatgangagggnangngctacgccgagcacggctcaagagcctatgtgcaagacaaagacccccgagatcatgccaagaatcaacaagttcttcaacaagccaaaatgaagcactttngtctgtctgtgactcncaantagtaantggntgtgggcaaagtgnaaanctntttcaagcattcantaatgttggtggcgtccaataantcanagggacatcgtcaaattcctcctattggaaanaacaacgtnatggttg

SEQ ID NO: 93840 - DNA, 219 bp, Triticum aestivum
  unsure (1)..(219): unsure at all n locations
  Clone ID: PAT_TA_93840
cttcgactcgccganctcctcgccggggggcgngcccttccangaagaacccttcctcannttngccgactcccccgcccccgccgcgggcgacgtccanntctccgggggggncgaagaatcctccttnccgggntcccccgacccctangccttncgccangaatccgccgccgcgcancccttcgggatggccgactccaacgggaacgggatgca

SEQ ID NO: 93841 - DNA, 302 bp, Triticum aestivum
  unsure (1)..(302): unsure at all n locations
  Clone ID: PAT_TA_93841
ctcgtgccgaattcgggacgagctcgtgccgaattcnggaanagggcaacactacctcctgatccaagtgggctgtgnggctgcttcnncgacgttggtggntgttgcctgaccttcttctgcccctgcgncaacttcgggaggatngccgcgatccncgacaaggganaaacatnntgctttgtgaagcgggtccgggtatctgctcctgaactggatgacggggttgggatgantccactccttccgctatcgctcnnanctgcgggaacantatngtctccagnaagaaaacctgcccc

SEQ ID NO: 93842 - DNA, 498 bp, Triticum aestivum
  unsure (1)..(498): unsure at all n locations
  Clone ID: PAT_TA_93842
caagggtgtatgcactaacgaaaacantggaactgggncgtcggtacttcccaaantgctcncaggtgntcnacaaantcttggnaganggcctgcctgatggccttgatgcgttccancagcaaaacggcaccccngatgagcaacaagtgnagaagangcgcntctncgacgtgnaggaggacgtgcncnaaacataaaacaaaaacaccgccgataacancatgttttcngncctgtcgtcaaaatcctcntcctccgcgatgaagtgnaggtagtgttataaagntgttttctccacatgttanggntaaaaaaagggatntctggtcaanccgcatgttataaatggccaccancngtgtnaaaccngcntatgancatgatnanggngggcnccccaatantagaagatgntatatacttttctgnggccttggtggtttgtttgggggaaagntgtggcaaccccatcccnanattccncaanaatanant

SEQ ID NO: 93843 - DNA, 508 bp, Triticum aestivum
  unsure (1)..(508): unsure at all n locations
  Clone ID: PAT_TA_93843
attttttatactgggttttttcatctcaaacaaccttaaatccaatcgatacctttgttttctttggcacaccactcacccgaaactttaaaggatacaagataacctctctagatggtagataaactgtagtantgctcgataatttgcaatagttcaaaaatatttaattgaaagctatgactccgtattcatgtcggcatatttaagatttgaaagcaaacgaatggctacaaaaagtcgccagaaatttcaatggtgcattatttggggtgttatttttcttcttccaattaaccaattcctggctgctgctcgaggggggggcccgggtacccaattcgccctaaaagtgagtccgtattacnccgcggctcactgggccgtccgttttaacaacggtccgnggactggggaaaaaaccctggnnggttaccccaaactttaaaccgcccttggcaagcaanaancccccctttccccaanctngggggtnaaaaaaccgaan

SEQ ID NO: 93844 - DNA, 243 bp, Triticum aestivum
  unsure (1)..(243): unsure at all n locations
  Clone ID: PAT_TA_93844
tggcgaattccgnacgaggagnaagcaactgagaantcaattgttgctcccaacgagccanctattgctcctgctcctgctggagnatccgaaaccaaatcanatgntggcgnantaaacagncaacctggtgngggcancaatgagtcgccntccgccgncaacaatgggcagatgtctcctggcggctcnaccgtgnagtgcanctgaaagangtggcccctcctncgcgccgncgtctcc

SEQ ID NO: 93845 - DNA, 162 bp, Triticum aestivum
  unsure (1)..(162): unsure at all n locations
  Clone ID: PAT_TA_93845
tcctaaacaanaaacggctgggagaaaataatggcnaaaaaaattnccctnactaattattgatggtggggggncaacaaaannaacaaggtgggccnaattanttcctncacacaaactaaagatggttgnagctgagntttattgtgggtganctcccta

SEQ ID NO: 93846 - DNA, 514 bp, Triticum aestivum
  unsure (1)..(514): unsure at all n locations
  Clone ID: PAT_TA_93846
ttaagtcactaagcaacccctggnggnaactaattaatgggttctatctcccacgacgangngggttgcatctacccnatgcanctggcancggnagctgtcttgccgatgacgctcaanaacgccatccagctgggcatgatcgagatcctcnttggngctggngggaaaatgctttccccgtctgaggngggcgcccaactgccgtcgacgggcaacacggaagcancggccatcntcgaccgcatgntgcggntgctggcatcacacaacattgtgtnctnccaagtggaggaaaggtaaagacgggccgcctcccacgccggtaatggaacncnccggtgtgnaantgggtcaanccccaccaangacgncgggtncnttgtnccnatggtcctcctttacgaaaaaggcatnctgggggaatggtaacaanttnatggggaactggtccttaanaggggnntgcccattcntcaaaacgtaccggattannacntttttttncaaagaa

SEQ ID NO: 93847 - DNA, 431 bp, Triticum aestivum
  unsure (1)..(431): unsure at all n locations
  Clone ID: PAT_TA_93847
ggttcgtctcgcaanctgttgctcccccctgtcgtggnanttatcttgcaatgctcctcaatcgccaagttgcaagcgggggggaagcaagaagttattaagaattnttcttaaacaagnttcgcttaaagcctnaangcntttnggtccggaggccaaangggaatccaangtcntcgagtgggngccaacngtggcgtttnnaccanaaaggaatnggccggtngtcgnccggggggcctccaaaaaagggngggctaactttctangganctggtcncgcccgttgnacaaantncgancccggggtnaanttcaaacggggaagntnttcanagaaaccaaacccgggnggggggggggtgtgaaacaaattncggnggggggctnaaaaggngngcngcccgagncttgggggtctttcccctggg

SEQ ID NO: 93848 - DNA, 485 bp, Triticum aestivum
  unsure (1)..(485): unsure at all n locations
  Clone ID: PAT_TA_93848
tctcggggaagttgtccacagccagagaaatagcantggggnccaagaagattgtctcccagcaccaacaccaggacaaccacgaaagaccagtanagggaacgaacgccaccatccgtactcccnaaatgtttcttcccacacatccaatgatgatagccaagttgttcanncacgagactgagactatctcaatacatcgatcttcatcggatgattcagatacaaaggangagattcaattccgtatgcgatcaagccgcaaaantgcctgttctcctggggtccggggcactagtcaaacaactacaactatgtnctcctcgattgnncatgacaagtaagtaacgacatcgaaaatttgggaactgtgtcacgtttaaaaaacccanacgcaagtggagtcagcggacctaatccgagtccacttagtaagggtanaggaagctcaananaagggtgggngaggggngttatnantgggn

SEQ ID NO: 93849 - DNA, 495 bp, Triticum aestivum
  unsure (1)..(495): unsure at all n locations
  Clone ID: PAT_TA_93849
ctcgtgccgaattcggcacgagctcctagcaagctatatacctacatagtacagccatggcccccaccgtgatgggctcgtcggccacctccgtcgctcctttccaggggntcaagtccaccgccggcctccccgtcagccgccgctccaacggggctagcctcngcagcgtcagcaacngtggaaggatcatgtgnatgcaggtgtggcccatcgagggcatcaagaagttcnngaccctgtcctacttgnnaccgctcancacggaggncctccttaatncaggtcgactacctgatccgctccaagtgggtgccttgcctccangttcancaagggtgggttcatcttccgtgagcacaacgcatcccctgggtactacgatgggcggtactggngcaatgtggaaactgcctatgttcngggtgcaacgacgccacgcaagtgatanccaaggtgggggaggtcaacaaagantaccctgacgccnatntt

SEQ ID NO: 93850 - DNA, 239 bp, Triticum aestivum
  unsure (1)..(239): unsure at all n locations
  Clone ID: PAT_TA_93850
ctcgtgccgaattcggcacgagaaaccaancgcccgcccgcccgcattccatttnccttccgtttcgngattcgatcccgtcccgacccaagcccaancccggggcggnaagcctgntcacgcgcgnggccatgggctcgacgccngggagcagctacnactgctccttcaaggggatgcncaccggggacnccggcgttngcnaagatcaacntcntcgtcaagcttcgtctccgacg

SEQ ID NO: 93851 - DNA, 491 bp, Triticum aestivum
  Clone ID: PAT_TA_93851
ctcgtgccgaattcggcacgaggtttaaaactggaagcatggttcaattcatgcaagcagcaagccaaacaaaacattagtttggaactatcaggaatagtggctcaagtgtagtttaaaactgaaacaactaaatgtaatcctctctcgcttgctgaaaattacagatctgcacttgttcctaactcatgttatgaatagttatatgagtcttagcgcatgtatttttgcatgtccacatatgttgatcccagttcaccatatagtaagataaaatgtccgaataaattcaaatgtccaggccaaatacttcttatccaggtcccataccaggaaagcatttgtacaataaaacgctgattcgtagtcagttaaaggatgacatacaacagaaattttgcatctaagtccacggattgcatatacttctaaagaatgtgaattaaagcaatttatttctatagcatgggccctttcatttggggatggaa

SEQ ID NO: 93852 - DNA, 420 bp, Triticum aestivum
  unsure (1)..(420): unsure at all n locations
  Clone ID: PAT_TA_93852
tgctgaagcagtcanaagtggggcaaaaatggngaaatccagatctgtatttggnggatcacgatatttggnctctctacctctcgttcctcgaagtactggntgcgaagctttcgcaacaataacatcaagccaaaaaattactaaagtgcaaattcgtgatgaaggcggtaattgggaaacatgtnaacatgaaaaaaccactacttatgactcggacgaagaaggacggncatacgcaccaaaggcgtcaggaccttcatgtgactgcctaaaattccaagtggagtccaaagaggtatcaatatccgggatatgttaagaattttactaaatttatgttatacaattgagggacatgagattcaggcatttttgggaatctgagggttggnattgcaaattaatgtgttctctaaa

SEQ ID NO: 93853 - DNA, 498 bp, Triticum aestivum
  unsure (1)..(498): unsure at all n locations
  Clone ID: PAT_TA_93853
ctcgtgccgctcgtgccgaattcggcacgagcaaacatcttcactctcgaacatccatacatctttactttcgagcatccagacatcttttatatctaccgctcaattcatcatcagcatcatgcctgtcagcctctctcgcgcactcttcgaccttggtctcgatgaacaccttgctgcattctccggngctggatattctagctgggagaaattgacaaccatcactgagcaagaattagcgcgctcaacattcgccccggtaacaggngaaagctacaaaggggcattgcgcgatcattaaattgggcaagacaatcggncattancatcaccanctgagcttgncgttttcgtcgcagctaatcactttcaagataanttttnaatttaaaaaaaagaacaccgngncaataaataagggngggccccccgtgntntggggccnccggaggggcnaaggaaacnggaggtttgnttataccaatggntcncctt

SEQ ID NO: 93854 - DNA, 504 bp, Triticum aestivum
  unsure (1)..(504): unsure at all n locations
  Clone ID: PAT_TA_93854
gtcgtgccgaattcgggangaagtcaacgcgaatccccancgtctcgcagttggacgccccgtnccgcatccccccgattcctctcctcttcctcgccgagggcaaaacccaactccccgatntagccaactanccagatttcggaaccctcgccgtngccgcgggcatggngaaggagccccccttctcccttcccccggngggcctcaanccctccanancgggccancgccgncaccctaaccctgggnncggggnctccccgccaaccgncttcgcggctccccgcccctccaactcctccggtcggcaaacgcntgggccttcatgtccttcgatatanccgctcaatncaactccaagccgnccatcttcaacggggnccaatcggnggntccaagcgcctccttccaangacgaagncgncgntccttcgagggagctcggggatcaaanangcgntcaaatttggggggganggaagntctccatcctcacccggg

SEQ ID NO: 93855 - DNA, 495 bp, Triticum aestivum
  Clone ID: PAT_TA_93855
ctcgtgccgaattcggcacgaggaaacatcagcccgagcgcaggaatgaaagatgaagatcgtatcgagttaattaaccgtcagcgcagtaccatttacacagatggtccatcgttcgctagcgatggaggattcgaagaagccgcaggtcgatctcaatgtaacacccaaccaggtaatgggttacgcggccactcaccgcgtgcctacgagcagattaaaacccacgctatgagcgaaaacggccagtcgcagggcgaacctaaactagttaacactcaagtttctgggcagcaaaaatcacgcgctaacagtgtgtcgtctccgtcccatgcccctgggtagttatagtatatttgattcaaataatcaacaatcaaaccgcacctctacatcttcgcccgttgagtcacctcgtccgggaggaaaggcaatcttcaagctccggcgttgccccaattgggactcgtcctagtgggacaaactatgaatgca

SEQ ID NO: 93856 - DNA, 567 bp, Triticum aestivum
  unsure (1)..(567): unsure at all n locations
  Clone ID: PAT_TA_93856
cgggggtgggngggcgctcctaaaaatnatgggttccccggggtggangggatttnggaagaacctcctaacaaagctntatacctncatagtacaagcatgggccccaacgtggatgggctcgtcgggcaactccgtcgctcctttccaagggctcaaagtccancgncgggctccccgtcaancgccgctccaacggggctaggctcggcagcgtcagcaacggtggnagggtnaagtgcatgcaggtgtggnccattgagggnatcaaaaagttcgagaccctgtcctaattgccaacgctcaacaagggagggcctcctcaaagcaagtcgactacctgattcgctccaaagtggggtggcttgccctcnaagttcaacaagggttgggttcatcttccgttgagcaacaaacgcatcccctgggtactaatgatgggcggtactggncaaatgtgggagcctgcctatgttcggggtgnaaccgacgccaaaaaaagtgatnaacgaaggtggggggganggtcaaagaaaggagttacccctggaccgcgtatgtccgcan

SEQ ID NO: 93857 - DNA, 485 bp, Triticum aestivum
  unsure (1)..(485): unsure at all n locations
  Clone ID: PAT_TA_93857
canggntccactaccccctgagctgaatgggcgtccangtcgtaacaaacctcctcctcctcctcgccaagggcctcccgtactccgccctcgccgttttctccccggatttctccttcttcctcgcgtgcggggcaggcgccgacgtcaccttcccgtccgacaaccccacgcgcaccttcgtgcgggangacggntacctctcgcaagggcgtcccgccgcggtgtctgcaaacgccagctccggngngggctccaaccctctgtncgccgccgcgcgcgccgacagntcggncttctcctaacgcctcgcgtancccgccaaggggggggngtcgtcgttcctcgtcctgcgnctccacttcttcccgtttcgtccccgcctcctcctccaacaaactttntccgcggngnttcaacgtctcgggcctcgaacgnctaaaacctggctggccgcctttctcgnccgccnggncggacggggg

SEQ ID NO: 93858 - DNA, 391 bp, Triticum aestivum
  unsure (1)..(391): unsure at all n locations
  Clone ID: PAT_TA_93858
ggggggcgctctaaaataatggatnccccgggctgnaggtggnatcttccaagantantcttgcaatgtttgcactggncataaacatggncgtgggggntgacgtctcggcgcaaaanancccgcaggacttcgtcaacctgcacaancgcgcccgcnccgtggncggcgtcggccccntggnatgggacaacaacatggncangnttgttnangactggggggcgcancnccccggcgattgtnggctgcagcactccggcggggngttcngcgaaaaaatcttctngggttncngggantcntggacggccgccgacgccgtgaanctgttgggtggtngacaagcaacactaccatcttgttagcaacaactgntacgncggcaaag

SEQ ID NO: 93859 - DNA, 433 bp, Triticum aestivum
  unsure (1)..(433): unsure at all n locations
  Clone ID: PAT_TA_93859
atcatttcattattgctcctacgtctgtatcaagtcagatcttcctacgtcttattctagcctccttattcgaactgaaaagtgttagtgatctcaggtaatacgcttttctaatctccatggattgttcaagctcatatccttttggcgccgtcggactgtcagtttgtcctctgagccaaccagtcaaccttctatcacgatccatcatttgtctatcccattgatcaatagagtgtcttgccctcttgccaccattttgcatatgcctaatttttgacattcccgctccagtaatcccaaacatacaaaattataattccataaggcaagagagcttcaaaacgggaanccccaactttcctgggggttgagccaagatgagcctgaaaaactaattaattttgatggtctgggaggtcgtaccctcctt

SEQ ID NO: 93860 - DNA, 385 bp, Triticum aestivum
  unsure (1)..(385): unsure at all n locations
  Clone ID: PAT_TA_93860
acacanccaacgataaaactaaaaattcaatttttggtttattaaaaaagaacaaacgaaaatagaaacaaaaagcngntggcgggananggaaaatcccaaaaangggaangggaaaaaataaacaatttctccccccngncccaagggaaanaaaaaaggnaaggcttcccccctccccctaatatttttccgggggggatcaancncntttctgccttggggcgggggncttctgannggngcaaggttttcccccccnccgctnctaacccgggggggggcggaatttggccccgccctcgcttcgggccctnccaaggtcaagggaagggtttttctccctaaggagaaaggattaaaatgtccaaatttatcaacnaac

SEQ ID NO: 93861 - DNA, 572 bp, Triticum aestivum
  unsure (1)..(572): unsure at all n locations
  Clone ID: PAT_TA_93861
gggggggggggcggctccaagaantaatggggttccccgggggtgnanggattcgggaacgaagaaanaaatcgggttgagtttagcgggagggagcgtctggactaacaatgcatggggtagcgtccgttaatcaacccttgagtttgggcaagggancgcgggacgggagttgctggtaacaagaaatgagggaggtgacgaaacccaagggcccggtgaccctgggggggaccttccttgggcgccaactgcagcanccccacgggcaacancaacgtccatggccgccttcancaacgccagcanncggtcgtcccgactgnttcatcttccccaaagtaactgctcgtcctcgtattttgtcgggancccggagctccntggggggcttcctcancgccttgggntanccctcttggagctctccaaagctccgactangacttgcaaaagacaaangaaagtcaatccancagtaananggaatatccttgncggaatgcggggcccgttgcgctccttggttctggtaaaatcccccgatttttcctaatccaaaacgaaactgg

SEQ ID NO: 93862 - DNA, 455 bp, Triticum aestivum
  unsure (1)..(455): unsure at all n locations
  Clone ID: PAT_TA_93862
gacacttctcccgtcccgtctccancaaacctcccatctccgtctagcgtcggngggagttccactccctcgccatgggcaagattaagatcggaatcaacggtttcggaaggatngggaggntcgtcgccanggtcgccctccaaagcgacgatgtcgagctcgtcgccgtcaacgaccccttcatcaccaccgagtacatgacctacatgttcaagtncgacaccgttcangggcactgggaagcacaacgacatnaagctcaaggncgacaaagactctgctcnttggngagaagncanttacccgtctttggngtcaggnaccctgaggagattccgttgggtgaagctggtgcccantaccttgtgggantccaacgggtggtcctcactgacaaaggncaaaggncgctggctcaatttnaaagggnggggggcaaaaaaaaggnggnc

SEQ ID NO: 93863 - DNA, 230 bp, Triticum aestivum
  unsure (1)..(230): unsure at all n locations
  Clone ID: PAT_TA_93863
gaccaacaaacgtctgatttttgncggcaagcanctcnaggatggncgcacactggntgnctacaananccaaaaagagtccaccctccacctggtggtcangcaccntggaggnatgcanatntttcttcaanaccctgacnggcaagaccaacancttggttggtggngtcctcggnccaccaatcaacaatgtgnaggnaaagatncatcgataaagggaggggnat

SEQ ID NO: 93864 - DNA, 217 bp, Triticum aestivum
  unsure (1)..(217): unsure at all n locations
  Clone ID: PAT_TA_93864
gccgaattcggcacgagagcgaatgcgccaccaccanaaaccaanatttccgcctcgccggntgggcanccccacccccacaaacaacaancggggcancggnccggccggtnncgccaaggtnacccgggtggggcaaanggtgggtggcccctccgtgccgacccccgggggggaantnccgctctcctngntcnaacgctaacccaacgcaacg

SEQ ID NO: 93865 - DNA, 212 bp, Triticum aestivum
  unsure (1)..(212): unsure at all n locations
  Clone ID: PAT_TA_93865
cacttccaacgcacgcaagaaaatcctccaggttcatccacagcanaagaagcggggagatggaagggagnagcaaccggncgccggngataaacatcgtcccggcgcctatggcggcngcggccggtggcggtggcgccgncgangcggtgaaggnggcgagcaatgagcccatcangaccgggntcgccttccccggncagaaaggagtg

SEQ ID NO: 93866 - DNA, 490 bp, Triticum aestivum
  unsure (1)..(490): unsure at all n locations
  Clone ID: PAT_TA_93866
aaaagccacttgaaggntcagaaatgcatgttgatgcaaaacgtgccaaaacacttgtctctgcgcttttgaatgttactcggcgtatcaataccaaagcagtaggtcgcaatgtacaattagtagctgtttccaaattaaagccagcgtccgacattctggcgctttacgattcagggcatagacatttcggagagaattatgctcaggaactaattgaaaaatcaacggncctacctaaagatataaaatggnactttatagggggcctacaaagtaataaatgcaaatcacttgcttccaagcattccaaatttgagctcagtttcttcctgtcgatagcgccaaaaagggaaatctactcaatcttgggccgcgcttgntttcctggactcnnatccaatggaatatccatatacaagtcaacaactcaacctggaggccccaaaaatcaagggtctccctccccgggtgagggngaactgggcgg

SEQ ID NO: 93867 - DNA, 464 bp, Triticum aestivum
  unsure (1)..(464): unsure at all n locations
  Clone ID: PAT_TA_93867
ctcgtgccgaattcggcacgaggagagaactagtctcgagttttttttttttttttttgaccatgtgaatacatacatttgacatctattaaaaaaatacaacatgagatacattccgtgagttatgaaacaaaattaggttggcactccccgtcaatgcatttttgtgctcccttccttccttcctccctggcaagatggcctctgtgcttttcgatccctggaggactgctcatttttgctagtttgggaggacacaaacgatcgcaaatttgcaatgatgaccctgcgcaagcggggagctacatgcaccggggctgccctttatatacactatgcctgcacatgacgggccaagggccaagaagcggggcgcccaatgttggatggtacaagcaaacaacattgagatctctaacacacttaagtttgaatgggccaataaanacatccatttggtcaat

SEQ ID NO: 93868 - DNA, 483 bp, Triticum aestivum
  unsure (1)..(483): unsure at all n locations
  Clone ID: PAT_TA_93868
ctcgtgccgaattcggcacgaggcctactcgatgaggatgaggcgtttgaaagtgacgtcagcgacgacgaggcttcgccacacaccgcgcccgagagtacacgcccacgattctctcatttcatcaaggcactcagcgctgactttgagcggaatcgaggcaaagataactccgatcggcccatagagtggcaaaagtcgaacaccgcagcgcaagcggtagaatttgnccaagcttgaatttaagcgagccggcgacgagaatatgaatatcacaattaacctcttccgagatgagacgcccgagcgcttcttactccggcccgccctcgccgagatacttgataccgatgtcgcaacgcgcgccgaagccctcatgggcgtttgggactacatcaaggttatggggcctgcaagatgatgacgagaagcggtcttttgagtgcgataaacgtttaaaaagcccttctccaaacgtgataa

SEQ ID NO: 93869 - DNA, 214 bp, Triticum aestivum
  unsure (1)..(214): unsure at all n locations
  Clone ID: PAT_TA_93869
gtcttattgcacatgggagtatgaaatcgttaaccaatccaaccctccatattcaagcaaagtcatagagaaggtctgcattaaaattgtttaaaccgttcaaatcccgaaaattgttccgcatgtaacatctagatagactggaatgggtgtgaaatcaaccttccgttgtttctcaanaaanaaaggggaanacnaacnttantaaaaanan

SEQ ID NO: 93870 - DNA, 463 bp, Triticum aestivum
  unsure (1)..(463): unsure at all n locations
  Clone ID: PAT_TA_93870
tttcagtcagcttcgttggtggacagtgcatttcgctgttggcctgttgctactgagaaaatggcgaggncaaggcatctgatccaagttgtggtgatcctcctagcgacgtggtccctcctcttcctccggagctcgtcggncataatcgtgcctgcactccgaccancgccaacancancagcgccaagcangnaacctctgcatcctccgcgagcgggacgcgcttctcaccttcaaagncggnctcaccgaccccgaagcaactaacctttcgtcatggcggggcgaagtggactgctgncggtgggaccggcntccaatgcaacaaancggancgggnaacgtcatcnagctcaagtcaaaaaagcaaaaacnaactcnggnaaggngaactcctggcccgggggactanccaattggnggggnggggannaagnctccncccttggctcaactccgg

SEQ ID NO: 93871 - DNA, 496 bp, Triticum aestivum
  unsure (1)..(496): unsure at all n locations
  Clone ID: PAT_TA_93871
ctcgtgccgaattcggcacgagccgcctctacaagcgcagcccaaatntcggntccttcccttcctcgaaccaagcatcaacaatggcgaccacggnagccgacgccacggncgcggttcccaaggagcaacaacccgccaacggttccgcggccgccaccaccgggggggagcangtcacgcgccactccgaggtcggacacaagancctgctccaaaagcgacgccctctaccaatacatcctggagacgaagcgtgttcccncgccgagnacgagttgcatgaaaggagctcccgcggagattaaccgccnaccaaccaatggaanctggatgacganctccggcgggacgaaggggcaatttctcaaacattgctggntaaagcttnatcggggggcaangaaagaaccaatgggggnattggggggtctaaaaacggggtaaatcccctgggtngggcaaacggggggtncggccaaatccccccgangga

SEQ ID NO: 93872 - DNA, 476 bp, Triticum aestivum
  unsure (1)..(476): unsure at all n locations
  Clone ID: PAT_TA_93872
ctcgtgccgaattcggcacgagcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcancacggaggccctcctcaagcaggtgggactacctgattcgctccanagtgggtgccttgccttgaagttcancaangtcggggttcatcttccgtgaagcacaatgcgttctccccgggtaatacgaacgggncgcttactnggaccaatgtgggaagctgcctaatgtttcggggtgcaaccgncgcccaacaacaaaggtgnattaaacgg

SEQ ID NO: 93873 - DNA, 336 bp, Triticum aestivum
  Clone ID: PAT_TA_93873
ctcaagggccgtttacaagacatccgtcgggaacaaatctggcagcgagaacgagaagctgagtttcgagatcagagtgagactacaaacgcaagggtcgtacgttggacacttatacagcttctggtattaggtgttacctgtacttggcagctcagtcatttgcgaaacttttttatcaagcagaagttaacgtaagctgttagagggatatttaaatacaaagagtatgaattatataggtaacataagaacacgaagtgcaagagtaaatctttgctacgcagtcatcgtttgtcaatgtagacaatttttctaaaaaaaaaaaaaaaaaaa

SEQ ID NO: 93874 - DNA, 464 bp, Triticum aestivum
  unsure (1)..(464): unsure at all n locations
  Clone ID: PAT_TA_93874
ctcgtgccgaattcggcacgagctcgtgccgaattcggcacgagggattcagcggcgatagtgatagggagaaagcaaggccaagactgtaggcaatagtcttttatcttccattcttatcatcacacattcgctcattctctttcattctttccatcttatccctcgtcgctcgaggaggtaccgttcaagctccacctactaacatcaacaacgccacagctacaagatgcgattcctcggaactctcgcagccgtccccttcgtcttctcggtatacgtggctggggaacatgggtatctctgctctgattcggagggcaatacaaatacaacttacgaccaagccctcgtggaaggaagcgtgaaagataacgtgtctcccaanataagcgaagctgtctgcggggcgaactcgccggnaaaacgtcgggggnggaaanaaagtatcctcggggtctggg

SEQ ID NO: 93875 - DNA, 196 bp, Triticum aestivum
  Clone ID: PAT_TA_93875
gtcctcactacgtacaaaggccgagaaattttgcgtagaaccttgactttctataacctaagcatccatacattgagttcgctgtcaacttgagagcaagttgttttatagcagccttagcaatgaatatacaaatgctttcactcacaaaagttcttaccaacctagctggaaattcatgggctaggacgcttac

SEQ ID NO: 93876 - DNA, 492 bp, Triticum aestivum
  unsure (1)..(492): unsure at all n locations
  Clone ID: PAT_TA_93876
nctcnggccgaattcngcaagagcaaccaaccaagtaccgaaaccaaacaantgncggncaagaaaccattgttgccatcnaccgatnttgnttaantcgaagcaaacggagggtaaagaaaaagtcatctgcaanagaaatgggctccgatgggaactgccgccggggaaancgcacgcngtgtgcctgccgtacccgggcgcaaggggaaaacaaccccgnatgctcaacgtgggcaaanctgntccaaccccgggggntcgacgtcaacttcgttnncaacgaagttnaaacaancgcggcctcgtccgntccccgcgggggctggcnttcntgggtcggggctccccngggcctttcggctttcggcaaacaaaccccccaacggggcctnnccgcncggtccngnttgaacaaacnaangtcnacccaaaagnnaaancccccgccnctcctgncaangtcccaaacaacagnggnaacctggncct

SEQ ID NO: 93877 - DNA, 463 bp, Triticum aestivum
  unsure (1)..(463): unsure at all n locations
  Clone ID: PAT_TA_93877
ctcgtgccgaattcggcacgangtccaagacaggaggggcgcgttcgattcgattcgtttcgagatnaaaatcccatcccgaaccacccaaccagagcgagagcgagcgancgaggtgggcgtcgaagctggccgccgccgcgaggataccggcgcccgtgcgcgcgatgatggcctggtggcgcaagaangtcgtcttccccgcgcgccgcgcgctcgccgccgtctccanccgcgtccgctcccgcaagacaggcagtggaggnagcatactgaagcttcacgangacgtgcaaacctgtggatacaaagacgtgcaagtgatgttcgagatgctgacctcggagctcgaggacccaagaagggcaagcaacaacaagngggctcctgganggccgccctccgcgtgggccctccccgggtcgtcgtnctcnatttccgggccgggggggaaataaaaann

SEQ ID NO: 93878 - DNA, 470 bp, Triticum aestivum
  unsure (1)..(470): unsure at all n locations
  Clone ID: PAT_TA_93878
ctcgtgccgaattcggcacgagagctcacgtcgcttctaacctgatatcaccacctatctgcttgtgcctttggcgcccttttagcacacaagtcgacaagaaggatgacgactcaatatgagattgaccataacatcaagctcgatgagagcatgcgttgccgatcgcgtcgaccgtctatgtcaagcttctttgctcaagctttctcaaattgagacatctccctcccacaacaatccacatgctacgccaacacctgtcgatatggctgctgctgagcgccatctccaagagnaagcttggncntttcctcctaatagnctcatcgggccaacaatgtatcctttttgnacaagtcctatctcctccttacaacacgatattgagcaaactccaacaaacgtggcanggaggtattcgcnaggaggnatctgggntcaatttagaaaaggggcnnccccgtanaaaa

SEQ ID NO: 93879 - DNA, 457 bp, Triticum aestivum
  unsure (1)..(457): unsure at all n locations
  Clone ID: PAT_TA_93879
ctcgtgccgaattcggcacgagcagccgcctaccctccctcaagttttgagctccattagagcaaaagcctcccataagccaggacccaggctttgaaaatttcgacttgatttcctcgcgggtataaatagcatcgtaaatatataatcggagatggctggtaatgaatgaggcaaacgcttctatgcaatcggagaaacgcctttatcggacattgacgcaaggtggtgtgcgataagattaaggtagaggactagtgtgaaaatgacgaggccgaccatgatttgatgtcaccgattaaagatgtgttttcatttgctctctacattgattcggatgcgattcttcttggctatgacagatatgcaaagcaaactgagcaattaaattaacggcactggaaagtaaaagaattcgtcctttgccgggcgataaaaatgaggagagactgcatan

SEQ ID NO: 93880 - DNA, 406 bp, Triticum aestivum
  unsure (1)..(406): unsure at all n locations
  Clone ID: PAT_TA_93880
tccttgcacgccatcctcccccctctcgtggcctancacgtcttccccgagatgaactgctccttcctcagggcancggcggtcgccgtggtcgtggccgtcctggtggccacggcgggcgcagnctccttcgtctccgtcgcacctctcccctccgttctcctcttctcccgtccctgcgtcctgtggatngccgccaacgtcatcgtcgtctcgctctgggtcctttgccaccgcggaaccgccgtcgcggncggactcccgtccgcggccaagcgaagtatccgctgccatgggcggnaagctctttccttcctccgggacannaaatctttgctggcgctcctgaagccgttgntcccgcccgccnggggcccggtttntaanaaancccggccncgggaaa

SEQ ID NO: 93881 - DNA, 459 bp, Triticum aestivum
  unsure (1)..(459): unsure at all n locations
  Clone ID: PAT_TA_93881
ctcgtgccgaattcggcacgaggtacaggtgccggtatgggtacattattaatttcaaaaatccgggaagaatttcctgatcgaatgatggcaaccttctcggttgtgccatcccccaaggtttcaagacactgttgttgagccatacaacgcaactctttcagtccatcanctggttgaaaactccnacgagacgttctgtatcgacaatgaggctctatacgatatctgtatgaggacgttaaagctttctaacccttcatacggggatctcaatcacttggtgtctgccgtaatgtcaggtgtaactacctgtcttcgattcccctggtcaagctaaactctgatttgcgcanattggcagttaacaaggntcctttcccgcgtcctcaattcttcaagggtgggattttgcgccccttactaaccgcggggcgcactccttccgtgncgtaaccg

SEQ ID NO: 93882 - DNA, 442 bp, Triticum aestivum
  Clone ID: PAT_TA_93882
ctccaattcccccacacatattaatcagtcctgcctcaaacaatcttagccgttcgacgcaagtgtacgtttcccatttcatagaacaagtaaaataaagctcaacctctgaccacgatggccgaagtcgaccagttcgatagtgcgctcgacctactacgtcgcctcgaccccaagcacacggcgagccatctcaacgctcttattgaccttgtgccggcattaacagaggacctcctctcagctgtcgaccaagccgctgagcatcgcgcgctgtcagactaccggccgcgactacctgctatgtgactacaaccgcgatggcgatagctaccgctcgccttggtccggagcatttgagagtccgcgcggcggcaagtggggcctggtggtgtcgacgaagctaagcaacaacgattggcgccggcgagggcgccgttcc

SEQ ID NO: 93883 - DNA, 449 bp, Triticum aestivum
  unsure (1)..(449): unsure at all n locations
  Clone ID: PAT_TA_93883
ctcgtgccgaattcggcacgagcacccaccaccaccacctcgcgctcagtctcggcagatcactctgcacaagatcgcatctctagcgcgcagagtgcactgcacttactgtggtctggcctcctcttaatagttctcacctgcacgcgtaccctctcttttctcttggcagcagttaagcctaaagggatggcggacaaggtcgtggccacctactactacccgccgatggaggtagccgccgccgagctcggccacaccgccggctccaaagctcgacgacgatggccgcaacaagcgcaccggcacgaatgtggacggngagctcgcacatcatcaagggggtgattggctcccngggtgctgtcgcctgggctggggcatcgcgcaanctcgggctgggtgggtggggccccgctgtcaangctcctcttctcccctccgtcaan

SEQ ID NO: 93884 - DNA, 457 bp, Triticum aestivum
  unsure (1)..(457): unsure at all n locations
  Clone ID: PAT_TA_93884
ctcgtgccgaattcggcacgaggtttttggcaggaaaaggcgatggaaacattcgatattttgaatatgaaaacgacaagtttgagtttctttctgagtacaaatctccggagccccaaanaggtattgcttttgttccaaggcgcggtattaatgttcatgagaacgaaatcatgcgagcttacaagaccgtcaatgatacatatattgaacctatatccttcacagttccaagacgagccgaagtattccaagcaagatatttatccacctgcgataggtctaaaaccaagcactctctgcctcagaatggttggggggaaatgacggcattcccgcaaaaattgatttggaaagcatatacgaaggaaatgctccggttgaaatctcaacacagtatgtaccaccgactgtagtgtcggtcccagctacacgagcgatttccgtggggcgcaaa

SEQ ID NO: 93885 - DNA, 471 bp, Triticum aestivum
  unsure (1)..(471): unsure at all n locations
  Clone ID: PAT_TA_93885
agtgccgacgaagagagcgagatgaggtcgaggaagccttaccgcatcnagctggtcggtgtcgtctgtgatgcctacctcnctgttgtgagaggaatcangagagcggtgatnaccgggagagcggtgagggtcaagtcccaaactgcagtcgcacaaacgattcgccaccgcgttccgcggatactgcggcgtcntcgacaacgcgagggntctacancaccaactccatgggtgccccaaagttttatggtggaangacggcgaagaagcaacctgctggtggaccccggagggagatnttggtgcccntggaagcgggtgagcgggccttgaacgacaaangccaactgngtgggncganctctatcccgggacnggggcaaaccgtcctcccgntcggcggtggnaaagacctccgttcnccgtcaccgtctaangggggtcccgtntcaaacncgaggctcaang

SEQ ID NO: 93886 - DNA, 498 bp, Triticum aestivum
  unsure (1)..(498): unsure at all n locations
  Clone ID: PAT_TA_93886
cgcaccgcagctgggcaaccaggaggggcagccaccggccatggcctgatgcatcctctgcccaaccccgcattgcaatcaaagtggcgacgcgagccatgccactggtgcatcctcgccacagaccacagccgccatggctgcaaaaggagaagatcgtanttgttccaaggctaggggagggcgactccggctaccgcggtcgcaagggttccgtgcgccaccgtggcacgtgctgcaaccccgtgtatgcaacagcaccactactgcgagtctgcgacggcggccatggcgggcggcgatggtgtttcgatggctgacgatgcgtggtggcaaggggtnttgcggggctctgccgcactgatgcccgattgttgctccccgccgggccctgtctcgccccttgngcctagggtgctgcantgcaacgcgcttgggtggtgntgtgccttggnaaataagtcgtttggngggntttggnactgccaacggtcccgt

SEQ ID NO: 93887 - DNA, 483 bp, Triticum aestivum
  unsure (1)..(483): unsure at all n locations
  Clone ID: PAT_TA_93887
ctcgtgccgaattcggcaccacaccactactcgctgcactcttactttcgcttcatcgtttcgtcgcacgcaatttcaaaccttattaactcttatcccattactatcccgccgtaacaatgagtaacgatgccgaacacgatacaaccttcgaatctgcagatgctggcgcatccctcacttatcctatgcaatgttctgctcttcgtaaaaatgggtttgtcgtaattaaaggtcgcccctgcaagattgcagaaatgtctacttctaagactgggcaagcatggtcatgccaaggntcatcttgtcgccatcgacatttttactggcaaganacttgaagaactatgcccttcaacccaataacaatggacgttccctaacgttttcacgccgttgagtacnaagctgcttgacattgaatgacgggttcccnatcctttganggggcgagggacgggatccaacaaaagatgantgcat

SEQ ID NO: 93888 - DNA, 317 bp, Triticum aestivum
  unsure (1)..(317): unsure at all n locations
  Clone ID: PAT_TA_93888
ctcgtgccgaattcggcacgagatttagattgatcagttgccgactgagagggtgtttgtttacagggacttattggcttagggacttaaaaaagtccctataagtcccatctaaaccaaacagaagggacttataaggacttaaagtggtcgtttgggacttatgaaataagactttcaaggagggacttatagggacttatagttgtaatatggtcttactccctccggtcctttttactctgcatattaggtttgtctgaagtcaatctcatccaactttgaccaagtttatataaaaaattattgacatntac

SEQ ID NO: 93889 - DNA, 468 bp, Triticum aestivum
  unsure (1)..(468): unsure at all n locations
  Clone ID: PAT_TA_93889
cctcgattataacggaacccccaaactttcgctgttccagttgactcctactgtttccacagaaatgaagctctctttcagggatctgaagcagaataaattcataatcgaggccgagccatcagatctgatttcaacacttaaggcgaaaatagcggaggaaaaaggatgggatgcttcaacccagaagttgatctactctggaaaaatacttcaggatgctaataccgtcgagtcctataatatcgaggagagaggctttatagtctgcatgactgctaagcccaaggcgattccacctataccagcatctaccgccaaggctccctcgacctccaatacccaataacacgttatcaacgccaagcaagccccatctcaagccgactgcatcaaggaaatgaaaatattcaangctgcaacatcatctcccaccgcaaaacacacaaaatgccggactccaattcc

SEQ ID NO: 93890 - DNA, 474 bp, Triticum aestivum
  unsure (1)..(474): unsure at all n locations
  Clone ID: PAT_TA_93890
gctagtttgccactccaaatacatacaggaaggaagcaaaccaggtccatcttgtcaaataacaacaatggcaaagaaaaactactcggcctcctcagttcaagctgatgttgatcctcctcgttctgctagttttcgttggcggcatcctcgcgcgtggaccatccacctgtgttaacaaccctgcggttcaagccagactgcccaccgatccatggtggtgggtgaggacacacgggccatttattcgtgaaccaaataaaatgttcttgaggcgtccgattggcatgtgtatgttcgtactgattggcgtttgtatttgtgacctggtttataaantcaataaaagtntttgtgtcccaaaactaataaanaaaattntaccccnagggggggggcccggnaaccaaatnccnccctaatagntgagtccgtnttaaggcgngctcanntgggccggtcggttttaaaaac

SEQ ID NO: 93891 - DNA, 473 bp, Triticum aestivum
  unsure (1)..(473): unsure at all n locations
  Clone ID: PAT_TA_93891
ggcacacatgcttcggcgtcttaatgaccgcgcttttggctgggcagaaatatagtttagaacctaacaattagctatggagggcctagtcaacagggtagagggcggggagctagatacaatgaaaccggtgacaagtagcgcactggtagggaatgttggtgtgggccaggagattcaatatgcaatgttcccttgggagccgattttcattatgaccttggcatatgctgcaggttatctggcagaagggggccaagcaaagctacaacgatttggttcggtgaaatcccctccccggtgaggatccccttgaatacactctctcagcattcagccgagacacctccgnctttggattccaaggtacgcaatagatngtcaaatttttcgcgcaattacatttgagcgggggcaaaaaancccccgggccaaggnaaancnacaacggnggaccgnttccnaccgggccn

SEQ ID NO: 93892 - DNA, 469 bp, Triticum aestivum
  unsure (1)..(469): unsure at all n locations
  Clone ID: PAT_TA_93892
ttccaacaccttccggccggggccgggggccgctcgccancgcgccggggtttctgttcacgttgcgggagccacgttcctgaccgagggnctgggccgccggcgccaacggcatggcgtcgctnaaccgcgcccgcttcgcgctcccgacgcagctccgccgccgccttccgcttctcccngcaaagtttcgcgctctgcctcacttcgacctcccgcggnccgggggccgtccgtcttcggcgnacgcgccctacgcgttccaancccgggggtggacctctccaaagtcgctcctctacaacccccgctggtccgtcaaanaaacgtgaagcaaccgccggncgtctcccgggcganaaaggaacaaagtcnaaacgagtacntnaatcgggnngtgaacngggcaatcaanggtgaaacggggntncgcccggtgcccgcttgaaacgcccctcncttggctggg

SEQ ID NO: 93893 - DNA, 423 bp, Triticum aestivum
  unsure (1)..(423): unsure at all n locations
  Clone ID: PAT_TA_93893
ctcgtgcccgaattcggcacgaggaaactaagcagaggtccgaaccgactgatgttgaagaatcagcggatgagttgtggttaggggtgaaatgccactcgaacccaagagctagctggttctccccgaaatgcgttgaggcgcagcagttgactggacatctaagggtaaagcactgtttcggtgcgggctgcgcgagcggtaccaaatcgaggcaaactctgaatactagatatgacccaaaaataccangggtcaaaggtcgngcaagtnnaaacgatnggggggataaagcttcatccnnccgacangggaanacaanncccggctncaccaaccnaagggcccnanattgaaccnggctcaagtgaataaaacaggangtgggggggtgcaaaagnaaaaggcnaaggaagggctttg

SEQ ID NO: 93894 - DNA, 488 bp, Triticum aestivum
  unsure (1)..(488): unsure at all n locations
  Clone ID: PAT_TA_93894
tcgaatctctcccttcaaaacatcaataaattatactaatttacgatgtctaattcagctattgcagcaatcacaggctctggttcctctaaaaccagaatggatactagttccattgagtctaactcaaaaactaggcaaattacagaagaccgtgaattcgtttacggtgccacttctgctgacgcctcgggtactggaggcgataagcgaacacgactgccgtttgtcggagaggaggaatcctcaactagacatggcggtatagctagaagtcgaggtgaatccgaggctataccganggaagtgataggtcaagtggacaagtcacagggtgttgttagaagcataagtangccaaagagaacttgcgggtagatncatggtgatggtgggccccccgtaagttcaagctacaaatgcttttgccgtgcntccgtcctccgggntcaataaccggatncgaaaggtaacctccgcnatgatcn

SEQ ID NO: 93895 - DNA, 546 bp, Triticum aestivum
  unsure (1)..(546): unsure at all n locations
  Clone ID: PAT_TA_93895
gctgcaangtcctgaattgagctctcccgtccaaggaaactcacgggnccggttngcnggttggtcnaaggaccgttctttgacgancggccgcgagaagctttcgggcaagcnggacaactcctattctcaaaagaagtggggaggccgagggaaaacgtcaaaggacatggtgggcggggtgcccaagaagcaacaaagaggcggcggtccccaccccaaggtgggaagcccgnggcgaaggtgncgggcaaacggaccgacccgaagacaaaagtgcccgatattgcaagcatcaaagggccactggggccccgttgagttgcccgcaaaagaaggatggctggaccgagggatgcccgcgggcccgccgggcgnaacctccgtcnnaagggctgaaannaaagacnggtggggccaagncaaatgattgaatgggctttgcgttcccaagaaccaattccaagggangggncgggagccgcccttccggccgaaccaattgggtccctnacaaangcattccaaantcccctttcaaataaa

SEQ ID NO: 93896 - DNA, 235 bp, Triticum aestivum
  unsure (1)..(235): unsure at all n locations
  Clone ID: PAT_TA_93896
gagccatcccaaaattcagagataaaatacatcagccagcaggagtgtgtagcggtcgtcgaatctggcaacaggcgctcttggaatggagtctactggttgtcaaatgatactcaatatgtgacacaactagagaaaaagaatggtgaaatttcaccatttatagtacagatagaggagccaaattttcactgctctattaattactagttcaaaaannaancccaaaacanaa

SEQ ID NO: 93897 - DNA, 469 bp, Triticum aestivum
  unsure (1)..(469): unsure at all n locations
  Clone ID: PAT_TA_93897
ctaggaaggtcggtgttaccggaaaatacggaacangatatggtgcatctctacgtaagcaggtcaagaagatggaaatcacacagcacgcaaaatatgtgtgtacattttgcgggaaaacttctgtgaggaggcattcagtaggtatctgggactgcagatcttgtcacaagactgtagctggtggagcgtatactgtatcgacacctgctgcagctgctatgcgatcgacacttagacgattaagggaaattgctgaagtttaagaaattgtgactccaacgacnagtaattgttagtgtaaaggttacgaccggttgatttggggcgctgtgtacccgacattctaaggccaaatatgggcactacagaacttacgacctttccccaatcactcatcatgactggcngctgaacttanttctttctgaaangtccnaanctatccnggtaaangaatccnagtcaa

SEQ ID NO: 93898 - DNA, 457 bp, Triticum aestivum
  unsure (1)..(457): unsure at all n locations
  Clone ID: PAT_TA_93898
tttcaaagggcctcatctgcaggaatagtccataactgcgacgaaattgatcttgattcaaatgatgaagaaaataaatctacagacattgtacagaactccgacgaaatcgatttgaacatacagagcgacgatgataaacctgtggactccaccatgaaccacataattgcagcccatgttgatcagggcaaagattctttaaaaggtaaagaaaagcaaactgtatctgttgttcctccaaatattcgttcgcaacttccaagtcgcatttgaacgaccttctctaacaacttttcctatccagagacgaccgagccaagcacctcccccacagattaccaataagactgtccgcttcctggcattagacaaatgtttacctgggacgaangttcttacaattgctaaatattanccngggnggggggnggncttcatcaaaaanagtcaccaa

SEQ ID NO: 93899 - DNA, 474 bp, Triticum aestivum
  unsure (1)..(474): unsure at all n locations
  Clone ID: PAT_TA_93899
gggaactgcaagaacaactgttgggaagtacatttgccgattgtctccttgcanntttatcgaaggctcaacaaggggaacgacacttctgaatttgcctttgggctttacattttcttatccagctacacagaactacattaatcacgggatactccaagagatggaccaanggattcnacatcgatcacgttgaaggacatgacgtcgtccccatgatcgaaagcagctcttgaaaaaangcatgttcccattaaacttacagctctaatcaacgatacaacaggtactcttatagcctcaagcttacactgatacnaaaatgaaaatangatgcatcttcggcactggntgtaatgcggcatatatggaggactgtggctctattcctaaagcctagctcaactaaaatcctcccccctgacccccctattnnccaattnggggggggggngngggggaanccttttgaat

SEQ ID NO: 93900 - DNA, 482 bp, Triticum aestivum
  unsure (1)..(482): unsure at all n locations
  Clone ID: PAT_TA_93900
gcggtactggcggcggcagatgggggcggcggctggatcaggactgtgagggcagcagattaaagggagagaaagaagccccggtctaggtggcaatggagagcatgctggtgaactttcaacctcatctgctttcgtgttgaagatatatagacaaaagagcaacacattgagtagttactttaaagtgatgactttgtaagtacaatattttatagttctanatatgcaagagacgttcatgttttcttatatgtttgtaccttaatagttttctcacttctattttatttttctctcaagacaaaagggctcgganacacgtggctattccttccatgtggcactattaaaatatgaaacatcgtnatttttgtacgtagctggtaaccttttaagtgcttatgaagattgaanttaantctnncccccancgnagntccctggncctcnngtcagcccccncctaaacacnccccatg

SEQ ID NO: 93901 - DNA, 254 bp, Triticum aestivum
  unsure (1)..(254): unsure at all n locations
  Clone ID: PAT_TA_93901
ccgcctaccccacnaacctgccccgacccactcccgacctccnaagcaatcaccgtcccnccgcngccgccatggcnttccacaanatcaaggtccccaaccctatcctcnanatggacnncgatgacatgaccaacantattctggcaatctatcaacgacaagcttatcttcccatttttggacttgcacattaactactttnacttgggagttctacaccctgatgcaactgatnacaaggttacattgga

SEQ ID NO: 93902 - DNA, 484 bp, Triticum aestivum
  unsure (1)..(484): unsure at all n locations
  Clone ID: PAT_TA_93902
gaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcaatgtaccaacatgggctcgagaaagcaatgctccgtatgtgaaatgctancgggtggctatgttatatgcacgggccncaataatattatacaanatgtcaactatcattacgtttttantgggnaaccaaatgggaaaaaaaaaaaaaaaaaaaaaactccnanggggggggc

SEQ ID NO: 93903 - DNA, 465 bp, Triticum aestivum
  unsure (1)..(465): unsure at all n locations
  Clone ID: PAT_TA_93903
gcggacatcaatcaaaagcatacctacgggaacggaagtccccacttgcacagaggcagcaaatgccccaagacctcagccacccccggcctcgattccagggacggctgagtgccacaaccactcttctggtggtgctcccaccggcaccacgccaattcacccgccggaaattgaggctttactcgaagccgaaagaaagcgggctgcaaacacctcaagccaggctcgagatagggtcaacggtgctaaaaacattggnaagtgttatcctgtccatgaaaacgacagataacaaagaatacttggacgccgataaacgtgtgtctgaggggcgccctcgcccacttcctgcgcactggaaccacaccaagtgccgacaagcctccctcccccgccccatcggncatcaagttaacaacaacnggacactctcaaccntccaangggggggggggggggggg

SEQ ID NO: 93904 - DNA, 395 bp, Triticum aestivum
  unsure (1)..(395): unsure at all n locations
  Clone ID: PAT_TA_93904
ctcgtgccgaattcggcacgaggagaaggggaatttttctanctagggttttagacaagcgcgggtcggacagaggcgatngntgcngcggtcnacgagacggcggcggcggccgcggcgcgctgtggcggaggagggcggccccncctgcngtcgcggccgnaggccgactccaaggacctgcagcancacagcaaggcnctcgacaaanctcaccgaccacgtcgaggatngcnagntcgactcctctcgcgtccaaatccggcatgngnanctcctggctntcatccaacagagncntgactngcgcaatgccaatgnngacttgaaggggcncaaannattactgttnctcgncanaaatcanactctttacccagtnnttgtnacaatca

SEQ ID NO: 93905 - DNA, 421 bp, Triticum aestivum
  Clone ID: PAT_TA_93905
gaaatatcctgcacgcgtcaagggaatgtatctacgaaccgagttgacaaactactcagtatatttgtcctaatattcgcagtcgtttgcagtctctgggccaacacgcgatccgaccaaacatgccggagatatgggatgctcttcggtgttttaattctatgcgcacaacacgaacgtcatcttttgaaggcaagggctgagcacccattctcattgtccacaataaacctcgggatggagtattctctcaaagccgagctcagtcaaaatcggttctctgtcttagaaaaaaagaatctatagcaagcataaaaaatatgctcattatatccagtctctttcaagttgattccatgagtccctcattaatagactcaagatagggacaagtaatataaatctaatcagtctgcacgtt

SEQ ID NO: 93906 - DNA, 428 bp, Triticum aestivum
  unsure (1)..(428): unsure at all n locations
  Clone ID: PAT_TA_93906
ctcgtgccgaattcggcacgagaaagtattgccctcgttaactgtgcctttgatgtcggaaatttgactggagatgatcccttagtagagctagccacagagctacttgcagttcttacagagaatggatcagagcctctgccctcgggatacgttgcagcttccctgccgaagttaanccgactcctaatggcaacttcagaagggggagttcttcgtgctggtgccgaagccgtcaaatttatgcttatgcacgatcatcaacaggtctttgcatggagggatgaggaaggnagatctggcctcgaggtctgtttggtacttattgacaaactccctcaacccttcagtccgaaagataatgcagcccncaagaaggntggaggcttaancaacccgatcctaatctgagaaanggctgggtcaaa

SEQ ID NO: 93907 - DNA, 417 bp, Triticum aestivum
  unsure (1)..(417): unsure at all n locations
  Clone ID: PAT_TA_93907
ctgcgcctacaccaaaggaggccaccatgtactacgacccctgcttcctccactactccgacgccgacctgcgcgcctccgacgacaccgcgttgggcttcggcgttcagcaccgcctacagcgctaacgccacggcggaaccggcccgcttcgaccgcgtcgtggccgcgctcctcaacgccaccgcggactatgccgcctacaactcctccaggatgaggttgtatgcgtccggggtggtccccttcgaccgggagatcccggaggtgtacagctgggcgcagtgcacgccggacctcacgccggcgcgctgccgggattgcctcgccaacatgatccaggagttggggacgccgctgtacagcgtcggggcgagggctcttgggatcaggtgcancntccggtaccaaaaacat

SEQ ID NO: 93908 - DNA, 400 bp, Triticum aestivum
  unsure (1)..(400): unsure at all n locations
  Clone ID: PAT_TA_93908
caatggatagcatcagtctttaattctcaaacatccgcatanaattattcaatttatacacgttaatcctcagactgtctgaaagctgtttgcggtttggacagattgatttcccagttttgacccttgtccataggattcataataaggctaccttccacagtatacctacacgtctcatgtttccaatacgttacaatcgttgccaaagataatacaattattcaccacttactatggcgaccgttcaacccgggcaaagatctctggccatccaaattccaatgggacttgagagaaccgtcctcccacgcatctcagctctcttcctcatatatttcgatataaaggcaggatatacaattgcatggaaacnatcactatctaatgtccaactcca

SEQ ID NO: 93909 - DNA, 178 bp, Triticum aestivum
  unsure (1)..(178): unsure at all n locations
  Clone ID: PAT_TA_93909
taacaaattnatcattaanccctacctaccnccttaacttcaatcatcattttcttttaattctatccattcctacctctttttntctttattntatataatctcatncactttctctccataaanaacaaatatnttatcttcaanacatataattctctttcantactacctaact

SEQ ID NO: 93910 - DNA, 488 bp, Triticum aestivum
  unsure (1)..(488): unsure at all n locations
  Clone ID: PAT_TA_93910
ctcgtgccgaattcggcacgagctcttccggttcgccgtcgattcgaacctcccccaaatcagcagcagtcgaccggaggcgccgccatggcccgtaccaagcaagaccgcccgcaagtcccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccaagaagagcacggagctgctgatccgcaagctgcctttccaagcgcctggtccgcgagatcgcgcaggacttcaagacggacctccgcttccagtcccacgccgtgctggccctccaggaggcggccgagggcgtacctcgtcgggctgttcgaggacaccancctttcgcatccacgggaaaccgcgtcaccannaatncccaaggacatncaactcgcccgccgnattccg

SEQ ID NO: 93911 - DNA, 577 bp, Triticum aestivum
  unsure (1)..(577): unsure at all n locations
  Clone ID: PAT_TA_93911
aagttattttgtatactgcaggnggttcatttttttcttaancggagttctgggtatgggccttatatggttccaacgaaccagggattacgatttggaaaagattaattaatcaatcataccctgcaaccttgggaaatacttttantattttgggcttccttattggcttatgcctgtccaaattgccggattattcccctacattacgtgggttaccaagataccccatgggggaaaggcacattatncgtacatggtatgcctttttangcgggggaaatattaattaaaangattggggacgcattatggggatntgaattcgggntcaaacattgggaantttgttnccctcaagccaaacaaaggggncaagtttcccctcaagcaagcaaagggnaattccctattgaaaccccaaaattggcccctaacctggcatgggnggggtggtaccctcccancaagaggccaaagggcttctttccctttnancaacccacnaaggggccttttcaaaccctttcnttcctccctaacttcgggttcgcnaaaggggggggggggggggggg

SEQ ID NO: 93912 - DNA, 428 bp, Triticum aestivum
  unsure (1)..(428): unsure at all n locations
  Clone ID: PAT_TA_93912
ctaacacttcaagcaagtcccccactgcccatatgtagcttggacaaagccaacgtactggccagtagtcgcttatggagaaaggttgtcagcgaagttatggccaatgagtttcctcaaatcaagctcacccatcaattagttgacagcgccgccatgctcattgtaaaaaccccaacagctctgaacggtgtcatcttaacgagtaacctctttggtgatattattagtgacgaagctagtgtgattcctgngtagcattggtctattaccatctgccagcctcagcggattgcccgatggtacaggccgatgtaatggaatatacgaacctatccatggttctgcacctgacatttcctgtcaagggattgtcaacccaattgggactatactatctgctgcaattatcnngggggggggggggg

SEQ ID NO: 93913 - DNA, 464 bp, Triticum aestivum
  unsure (1)..(464): unsure at all n locations
  Clone ID: PAT_TA_93913
gcaaaactatgcaaacccgtctcttagcttaaacatcatgacgattcccagttttcggtctctagcttctcagaaaagtccaagaaactgcagcggtggnacaaacatcagaaccagaaatcaatcaagatgccgagatatctgcagtccacgctactgaagatgcagcaaataagaatacaatggaagaaaaggtagcttccaataatgacactcagactccctctggcgtcaatgttaaaatggcgacggtgatgcgcaaaaattggataagcggcatctagtattctctttgccctttctgtcatttttttgattcttacgatcatcggcaacaccaaaaataaaccagttatacgctctacctactttttaaaactcaacttggggcaatataattcccgcgtctactccggcagatattatactcgttaactctctcccncgctcnctagggacttcac

SEQ ID NO: 93914 - DNA, 534 bp, Triticum aestivum
  unsure (1)..(534): unsure at all n locations
  Clone ID: PAT_TA_93914
agcactcnaagangctgagtnaagcaagcgctctggttctggccgcccggagacttcaaacccatcacttcttcnntcgcatccctcgcaccccacttcccanttcggatgcacgaaaatactangtactaattcgagnagccagtgagtctagggtccagacccggctggggatgacnagccctcgccggcgatggacttgccgctagccctcgcancgctactcctcatcctcctcgtgntcctcgccgccccgccggcggtgctcctcattgccctccaanctgantcgccgccaccgccctccggagggnccccgnggctaacgcccgccncgagccngggcggnccccgggcggctcganccngagnggcgnccgggccggaggnagggannaanggtgggancaaggacaancgaggcggncgggcacgcacaggcntatatcatcnatcnancaattccccggaaacccgggcccccccccccccgggggggggccccncccaggggggggacgcccggggggggnn

SEQ ID NO: 93915 - DNA, 428 bp, Triticum aestivum
  unsure (1)..(428): unsure at all n locations
  Clone ID: PAT_TA_93915
ccattacattnncccatatttccaacacattatnaccaccaatctnactctaactaacttaatacantcntctattttctcnttccnattcaattctttcnattccncaccatctcccataccatntaacantccatcnatccatccattctccaaaaccctcacctctactttctttntccattatcncctatcnaaatctttcacacttttcctccccaattttccctccatacnttcccaacttttcccctatttataccttctttctnttataaaaaaaacactttcttntnctctaacnnatatttttcctttnaanacccctnccactttnctccaccatctttcttcctccaaaatcttccccnaaattttcaacccatgntncccccctcctgtcctgggtttanggagaangngntttc

SEQ ID NO: 93916 - DNA, 278 bp, Triticum aestivum
  unsure (1)..(278): unsure at all n locations
  Clone ID: PAT_TA_93916
tcttcaatctccttccaaattcttcaccanctcaacaaatcacccnatctcaactcactactcacataccaannccactcctcctttnctattcctaacccctccaccaccctcctctaatctcaattncaactcncnctncatctccncccaaccaccccattacttctaaccccctttcccaactaccaatccacctcacnctcccatntcaatctctcccccnacaactctccattcaattccctcaacaccctatctcccccctcctctccctt

SEQ ID NO: 93917 - DNA, 387 bp, Triticum aestivum
  unsure (1)..(387): unsure at all n locations
  Clone ID: PAT_TA_93917
aacctcctanttcnaaagaactaagtccttcntggaggtgngtttgcttcngcnttcgcaattgagatangctttgtcaaatcaattgataaaatttgggatangactaacgccgggcnccaatggnaggntatccnatcaagatatgttcaaaagcgcgggggaggatgatgagtgattaagcttcaattggnagatggnaacacaatggggagacctccatggagaccttccgaatacaaagattggggntttaaaaactggtaggnattcaantatcctatncaagaaatccgtanganaaancgaaaagnaaaaaaaactcccagggggggggcccgggggacccaaantccnccccnnaattgaggtccgtaattatgccgc

SEQ ID NO: 93918 - DNA, 208 bp, Triticum aestivum
  unsure (1)..(208): unsure at all n locations
  Clone ID: PAT_TA_93918
acgaagcngcaacaanctttctccttcctcctccccgcaagggcctcctccgaaatcaaagaagattaaagtccgctgtttgtttgtgncaaatcccccctcccaancccggncggtcaatgcaagaaaacgaagggtggggtggacaatgggtggggacctcctacctcccccaaggaaaagtggntccggggcaaccaacaaggat

SEQ ID NO: 93919 - DNA, 390 bp, Triticum aestivum
  unsure (1)..(390): unsure at all n locations
  Clone ID: PAT_TA_93919
gcaaggtccgggcgaattncggaagagttggaagcggcctccaaaacaacaaatttggcgggnatcccaagtaaaaaagggcaatttncnaaacngcngcctnaatccaaatngtgcaaaaagggtncccgccgtncgattttcctggaaacccaacccctggctggctgggagcaacgggaagcaaaaaactcaangaaattnggttnccngnggcgngggncctttcctttnatgggatggtaaaaaagtcctgggctggcntcaacaaaataactaaaccggtccttttccccaatgcngcaagacaaggtgggtaatcttgcngctgggggtggctcgaaccgttcctatggtcaaaccaaaccgggaaggggnaaaagggnnccg

SEQ ID NO: 93920 - DNA, 208 bp, Triticum aestivum
  unsure (1)..(208): unsure at all n locations
  Clone ID: PAT_TA_93920
agctcgtggccgaattcggcacgaggagagaaatagtctccagtttttttttttgttactttagcacgatggagatgaccgannacggtctggagggcgaaanggcgaantatttttgggattantggggttctcgaaaccaacaaatgtttgttgcacaaaatanantgatgtagctgtcaagatgatntccctttngnagccatgg

SEQ ID NO: 93921 - DNA, 289 bp, Triticum aestivum
  unsure (1)..(289): unsure at all n locations
  Clone ID: PAT_TA_93921
gcaaggtccgggccaattnccggaacgaagaacntaattcctaatnactttcaaaacaaaaaatttctnaaggggtggcaacgaactngggcaaacaatgttggatggagattngtggccctaaattnacctggggaaggttttcgnaaatggtcngcaaaaggcgggcanattggtnnaacaaagtttcaactggnccggnccaacaaacaacgtttaaaatatttggcnnggggtnaagcaaacaaactggntggttgcnaattgggtttcaaacnaaaccctgggg

SEQ ID NO: 93922 - DNA, 452 bp, Triticum aestivum
  unsure (1)..(452): unsure at all n locations
  Clone ID: PAT_TA_93922
gtgcctcctcctagcaagctatatacctacatagcacagccatggcccccaccgtgatggnctcgtcggccacctccgtcgctcctttccaggggctcaagtccaccgccggnctccccgtcagccgccgctccaacggggctagcctcggcagcgtcagcaacggtggaaggatcaggtgcatgcaggtgtggcccatcgagggcatcaagaagttcgagaccctgtcctacctgccaccgctcancacggaggncctcctcaagcaggtcgactacctgatccgctccaaatgggtgncttgcctcnagttcaacaaggntgggttcaacttccgtgagcanaacgcatcccctgggtantacnaaggncggtactggncaatgtggaaagctgcctatgttcgggtgnaacgncgccacacaagtggatnaaccagggtgggaanaggt

SEQ ID NO: 93923 - DNA, 460 bp, Triticum aestivum
  unsure (1)..(460): unsure at all n locations
  Clone ID: PAT_TA_93923
gntgctccgacgggcgcgtcatcgtcgacttcctcaacancaagtangggctccccttcctggcgncctccaagtncaactccgccgacttnaagaagggngncaacatgggcatcaacggggccancgccatggncgcccccttcttccggtccctcgggctctccgacaagatttggnacaacgggnccatcancttccanctccagtggntncagaacatcanctcctccgtctgcgggaagcagctgcaagagctaactgggngaactcgctcttcatcttccngggagttcggggggaaagactacaacgccgatgctgttcggnaactacaacacgggccaagggagnacgtacgcgccgcanatngtgggggaccaaccggnggcgggngtggggaaactggtcnccnaanggggggcggggggacctgggtggtgncccggggggnccccnn

SEQ ID NO: 93924 - DNA, 301 bp, Triticum aestivum
  unsure (1)..(301): unsure at all n locations
  Clone ID: PAT_TA_93924
ntatgattgtgtcttcaagttcaacnaggnctgaaaaactctgaagcccctgcatggnaccaaccacattgcattcatttttatcattgattactgaggcaanccnacactgaacgtatgcgtccacgatgatagcaagtgggagaaantacaantcncttgttgtnnngtgagggagaacaanttttatggcanatgtgtnaaaanaaccccttctatgcttcanggtaanaataataagtggngaaaaaaaaaaaaaaaaactccnggggggggncggnggccaantcgccctatagtg

SEQ ID NO: 93925 - DNA, 492 bp, Triticum aestivum
  unsure (1)..(492): unsure at all n locations
  Clone ID: PAT_TA_93925
ctcgtgccgaattcggcacgaggttgcatactggtcttcgttcctcctttgccaccttaagccctgaccctcggctttgtttaaaaggatacatgcttcgttgctanancgcttgctgttgttggatttgggctcgggatcatggctcctgctcgggttggccggttccagatgtctaatctctcanagccctcaaaagaagatggntcaatcgagaaaactggagcttggnataacacatggngcantcttctgcgccatgcttcggtctatggtgtggctgctggntattgtctgncaaacaactcctgctctccaatatcaaacaaaatgggcaaacaangaagtttccctancctggagcaaatgacaagntttacaagtacctcacaaatgttgctggaggntctcccgggtggggcagctaaaagcttaattgngcccnnatanggggtggaattnngggnccaangttgggaaggtccctaaccc

SEQ ID NO: 93926 - DNA, 479 bp, Triticum aestivum
  unsure (1)..(479): unsure at all n locations
  Clone ID: PAT_TA_93926
tttcgaaatttggccgatccacttattagccttgaaacattagggaagcatcccgtaagcgagctattagagtttggccaaaagactggtcgaacagtggntatctctaaagatgggtgggttaaggatacgaaggttgatgtttttgttgacggcgtgctggttgcaagcgcgacttatgctcaaaagaaggagatagcttcgaaccgcgccgcgaaggntgctctagacaaattaaaggagatgtcggggnaanctgatgttcaatcaagccccancanaagctcctganccgttggncgaattggntcattctggagctttagaagctccagtgaaatgttgagacantgncgtttgtaagttccattgnatttttccattacatgtgtgttgttaaagccgccttatgagccngtaaatatttatatgcaaatcatatgattattgtgccccccntggggcggatctgactgaag

SEQ ID NO: 93927 - DNA, 419 bp, Triticum aestivum
  unsure (1)..(419): unsure at all n locations
  Clone ID: PAT_TA_93927
gaagatcaattttgactcntatatanctgttggnatgtactttcttacgtctcaaaatgtaggacttttttaacatttgtagagtgtcaaaaaacatcttaaattgttatgagacggngggagnacttttgnccgtacgtnggcgcatccatctatgtctacaaatttgtccagnagnatccnaacncacaaantatgaanattcaactagctattgaagcatttgggngaccgctnaatagtactctactgnaggtancgcatacagtgttgactcactactggagtncacaactccgtgggcttggcaatgnccatggggcgtcttccttctccacgccatnnncaacaaccgnaggagngttctccgggnggncctccaagggcccgggnccctcgntctccgggcaggggaaggc

SEQ ID NO: 93928 - DNA, 470 bp, Triticum aestivum
  unsure (1)..(470): unsure at all n locations
  Clone ID: PAT_TA_93928
ntcttgatttcattccctctatttttctatgtcgaaagttttgccgcccgccctataatggctctcanaattatcanaaaaaatcctcgcgcgggnttaattttcgctaatgnaacaagcgctgtcgttctgagcgctgtcaactttaacatccctcccttttttcaaagctgtcatgttgcaatcagcgactaactcaaggattaaacttactggcacccaagcatctcaacaagttttgctggggttggngtcgggattcctggatcacgtggncaaaaacaacctgaaattgnttcttgtgctcggtgnnactaatcctcgggcaatggggatgtttcgggggtgtcattcattcaaganggggcctaacccgacctggggtataacctanccaatttctgatgaaaatggtgaagtataagggacaanggggncctaaaaatttttccaaacaaacgncccaaggg

SEQ ID NO: 93929 - DNA, 537 bp, Triticum aestivum
  unsure (1)..(537): unsure at all n locations
  Clone ID: PAT_TA_93929
ttcggaacaanccgttggcngccctttcctttctttctttcngggggcccngggggccggaagaagaanggtgtagngggccgngccctcctngtcaaaataaaggccaaggttaagttnaagtccctcnggnnaaatggcaannccttnggtnaaangccgggcaaacnggctccnaatgtccngggaaggggaagaatgccaaaggtcctaaaggggncccngggtctnggggaanttggcttttgtcctcctcctgccccccttgnttgnggggggcctccccaaatnggacgggaggccaaaaangggggatnnanggaggggagaaggcaaccttgaaaacctnccaaatnaataaaaaaaagggttgtttgtngggggganggccttgggggtttctgggggtngnctctcccgncgaatnttcggtccnaccnccgggnggggggggnaaaaatgggaanaaanggggggtggggccgcaaactattaaggtttgngggaattnacccaanaatttanaaaccancnatt

SEQ ID NO: 93930 - DNA, 274 bp, Triticum aestivum
  unsure (1)..(274): unsure at all n locations
  Clone ID: PAT_TA_93930
agtcatttgttacgtttttaccaaaattcgaaacaacattagcgactgctggatggtcggtttgtggggacatccagaagatctcattacaaaagaacgctctctttaaggaaatgagaaccgcgctaatcggcaaaaaacttcctaagacctggagtgactgcacttcagaattgctaattattagtagcgaaattatagctattaaccaacaatttaatccgcatttcactggtacatcgctaatgtcaaaactggtaagaaaagggggggn

SEQ ID NO: 93931 - DNA, 202 bp, Triticum aestivum
  unsure (1)..(202): unsure at all n locations
  Clone ID: PAT_TA_93931
ctcgtgccgaattcggcacgagctgcaccctcctggcgggctgggaacctctccaaggggccaaccccactttcgacnaagccgccgggcctaaccaataactggcaaaatcccgcaaacaaaggagtttcccctnggggaaccaaaggggcctggttggaggncnaagcaacaacaatgnatnntggataanggaacaaaa

SEQ ID NO: 93932 - DNA, 471 bp, Triticum aestivum
  unsure (1)..(471): unsure at all n locations
  Clone ID: PAT_TA_93932
ccaacgaccaccaagcgcctcctactgtcagcctcagctcactcgaagttagcaatggnggncgcgaccatggcgctctcctccccggcgatggncggcaccccggtgaaggcctccagggcggcgcccttcggtgagggccgcatcaccatgcgcaagacggcgggcaagcccaaggtggcggcgtccaancaaaccgtggtacggntccgaccgcgtgctctacctcgggccgctctccggggancccccgagctacctcaccggcgagttccccggcgactacggggtgggacaccgcgggggctctccgccgaccccgaagaccttcnccaagaaccgggagctggaggtgatcactgccgctgggccatgctgggcgcgctcggntgcgtcttcnccggagcttgntcgcccgcancggngtcaanttcngngaagccgtgtgngttaaanggggggctcccanaa

SEQ ID NO: 93933 - DNA, 370 bp, Triticum aestivum
  unsure (1)..(370): unsure at all n locations
  Clone ID: PAT_TA_93933
ctcgtgccgaattcggcacgaggcaacttcaacggngagcgcccgttcgcgttcctcacccttgacgccgaagcctaaatacgtgcgagtgagtgtgatcatacatgcatacgtacgtgcgtgtgtttangtttgtgtgggttgnatanttatacgtcnacaaatgntacgtacgtacgtaaataagcacacantccggcctgcatgtatccangcgggtctgtgtgngcgtgtaaatgtatgcaaacancnttacntttgntttggtgntcaaaacttggncccaaccaaaaaaaaaaaaaaaaaaactccngggggggnccgggacccaattcnccctanaatgngtcntattaagcgcgctcaaatg

SEQ ID NO: 93934 - DNA, 318 bp, Triticum aestivum
  unsure (1)..(318): unsure at all n locations
  Clone ID: PAT_TA_93934
caagggaagcantnagcaatggnagaacanntagcatccatggggtgcatcaanaccttgnaaagctgctccatgttcaaangggncaangntgagggcaanagggggananacaacgggggggggagcttccgggtgccgggcgnccaaattnatggatggaagcggggtccgggtcgggctccaccagaaaccccacgncatcanctccggggagaggnccgggganttntcccttctcanctaccatcaaactccgcgcgnanctccaagtcncaagcacgaagcagnaacaagagttcgcctttccaacnctgg

SEQ ID NO: 93935 - DNA, 245 bp, Triticum aestivum
  unsure (1)..(245): unsure at all n locations
  Clone ID: PAT_TA_93935
ctcgtgccgaattcggnangagcgtccgtcgtcgccancgccatcgccgttccgccgccgccgccgcgccgtattccaaagcgtccccgcccccggnctctccgccannngtcgccgtccccccgttcttccccccncgnggagagtcncncccntgttgtctccgtcgncgacccctncccnccccgattnttnggggtcgtcnnggcgncctcttnctttganttttggncactgagttttgg

SEQ ID NO: 93936 - DNA, 339 bp, Triticum aestivum
  unsure (1)..(339): unsure at all n locations
  Clone ID: PAT_TA_93936
ttttttttttagataaacagggcgcgcccccagttttattaatcggtgaaaccaaacacaaggttcaagtaacagtagggtttagtaggtcgcgcgttggcggnaggtaaatgatagtaggttactgaaatggagaaggataactaaaggcaaaacgtacagtactaaccaaccangatgggataaactagctaagctagangcaggcgtggtcagcgtgtgaagctgagtcccgatcctcnaaacttgnccctcaaccaatggnanccangcggggggggncanctcccggggtcatatggngtgggccaaanccccccacaaacccctttcctgaaa

SEQ ID NO: 93937 - DNA, 468 bp, Triticum aestivum
  unsure (1)..(468): unsure at all n locations
  Clone ID: PAT_TA_93937
gtgatatcaatcgattttgatgagcaaaaagttcatcatctcaaggtaacgagcacgcttaactttgtatcctaaatgctgctcccaactctcactcaattacattgatcaaaaggcaatatgaggtcccataattagttactcaggtaccactcctaatatagacaggtgttcgaaatgggtggctacaaaaatatcaatagaactagctcggaggctaattggattcaatttggnctatctcattctcggtttcttcaacttccgcagtgatantgccttcatcttccgttcccagttcttctaaaagttgaactgtggnaagtgaactagccttgctaatgatactatcaatacnagatctttgctgaaatcctgccctgggtcgcctcggcgaagcncgctcgaatagttcgctcaaantccttaaacgaatttcaaatgaatttcaacttanggataaacgcg

SEQ ID NO: 93938 - DNA, 320 bp, Triticum aestivum
  unsure (1)..(320): unsure at all n locations
  Clone ID: PAT_TA_93938
ctcgtgccgaattcggcacgagcctcctcctagcaagctatatacctacatagtacagccatggcccccaccgtgatgggctcgtcggccanctccgtcgctcctttccaggggctcaagtccancgccggnctccccgtcagccgccgctccaacggngctngcctcggnagcgtcagcaacngtggnaggatcaggngcatgnangtgtgggccattgagggcatcaatgaagttcgangaacctgtcctacttgccaacgntcancaaggnggncctcctcaaagcangtcgactancctgatccggcccaaatggg

SEQ ID NO: 93939 - DNA, 354 bp, Triticum aestivum
  unsure (1)..(354): unsure at all n locations
  Clone ID: PAT_TA_93939
cgcgggtgggngggcgctcctaagaaataantgggattcccccggggctggcanaggaaatccnggaacgagggaaaaaanaaatcaacgggggctnganctncccagaacnaaaagggtnctatccaaaaaagntccaanggcccgagatnaaaagnatgcnaagggnnattcctcaaaatggtgggggcntggcttttggncgacccaaaaagaggggtgtggatnaaacaaaatgggtttcaacctgttctncctcaaacaattcanccnaaaggggncctccanggctaaacccacccggnagtnncccggggctgntgggaaaccccttttcgggcaaaaattacnttc

SEQ ID NO: 93940 - DNA, 575 bp, Triticum aestivum
  unsure (1)..(575): unsure at all n locations
  Clone ID: PAT_TA_93940
gcaacgaaggggnaattnctgggccaanaaccggggnggacttaaagggncccaaacaaacccgagaaatttgtgggtttggcccaaaggttgctcaaaggggggtngggnaaaatcccngaaatccggtcaaacaaatggggttgctngttccccctttaaaangggggggganaaaaaaccaccgggaacttggaaaaatttgcgaaagttaaaattgtctccgcaaagggngggttaatccccanntccgggggaacnttttggaaggggggaaaagcaaaccgnaaagtagacaaccttttaagtgncctgcaccaatttgctggcaaacnttgggccaaaagctttaactttttacaaaaattttggttccncaaaccncaaaggttttccaanaagggnggtngntcaaaatnaaacccgaccnttaaaagcccgggntttgtntaaananttcaaaaangggtnccccgcctaaagcgcccaaacttttttggaatctaacnttaagggggntggaaacccncccccctanaactggngggggcccctaangggttctcccanccaan

SEQ ID NO: 93941 - DNA, 151 bp, Triticum aestivum
  unsure (1)..(151): unsure at all n locations
  Clone ID: PAT_TA_93941
tccctcttcctcccgggctggacacgcanaagcagcgaggcttcctcctccaancctcatctttctgccatgaaggcccctcacttnaccggggaggccgccgccggcggctcctgggctcaggaagtnaacgaaagggnttccngaaaaa

SEQ ID NO: 93942 - DNA, 452 bp, Triticum aestivum
  unsure (1)..(452): unsure at all n locations
  Clone ID: PAT_TA_93942
ctcgagttcagcaaggntgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagnttcatcgccttcaagccaccgggctgcgaggagtccggcaaggcctaaacagctcactcacgacaggncatatataaagtggcattgcagttttgtcaactctgncattgctttgggttttccttccccaattanccttcttatttggtcctaagaanatgtgtatgtccatgntcaagtnccaacatgggntcgagaaagcaatgntccccntgagaaatgntatcgggggggtt

SEQ ID NO: 93943 - DNA, 475 bp, Triticum aestivum
  unsure (1)..(475): unsure at all n locations
  Clone ID: PAT_TA_93943
tacaagtacagcgccattctcccgaaatttaaccgcataatagctaaaatgaccgaaatatccaaccatcagcgtgggaatatcgtctctatcaatgctctaggcattggcagacttcatggtaaaaatgctatagtgacgggcgcagcaggtggcatagggcttgaaacatgtatcttatttgccaaggagggtgcaaatatcttaatggctgatatttcaagagccgaatctaaaaaaggngtattcaaagatcacaaagttggtgccttctgctatccgagttgagacaaagatttgtgatgtatccaaagaggctaatgtcaaggctattgttgaccatgtntgactcatgggggcggccnttgggtattaagtttaaataaatgctgggattatgcacgctgatgataagcgacgccatttgatacnccaanagaataatttggggatctgacacaaagctatcaaacgg

SEQ ID NO: 93944 - DNA, 220 bp, Triticum aestivum
  unsure (1)..(220): unsure at all n locations
  Clone ID: PAT_TA_93944
ctcgtgccgaattcggcacgagcaaataccctgttcatcttgactaanttcctttcactacncaaaatgtcgaccgcagaactcgctgtttccnatgctgccctgantctttccnncgatgggctcgngatcactgccgntaaattanagacactcantaaagcngctgggantgttgatgtanagcctatatgggccaaactcttcncgaaagcgcttg

SEQ ID NO: 93945 - DNA, 199 bp, Triticum aestivum
  unsure (1)..(199): unsure at all n locations
  Clone ID: PAT_TA_93945
ttctcccancccaacgctcaacangggcgctntcnacgangnctctggncgccgggcgggcaactgcttnttccanggcnggcaacgngagatngggtcaaccaactcccgccgaatcaacgggtccgagggncnaattttgcgggtnaaccaatanggaaagntngcanggcaaaaagggtggtgttaaaactaaaag

SEQ ID NO: 93946 - DNA, 235 bp, Triticum aestivum
  unsure (1)..(235): unsure at all n locations
  Clone ID: PAT_TA_93946
ctcgtgccgaattcggcacgaggttcttgcggcggcggcgcgacttccttccccctcttgcgaaggtctagggtttggccgagtagaggagagaggctttccccctcntccanccgggagccgccatgaaccgatcggggnanncgccggatctgaagaagtacatggacaaaaaagctccaaatcaagctgaacgcgaaccgcngttgcaattggaaccctccgnggatttgtt

SEQ ID NO: 93947 - DNA, 291 bp, Triticum aestivum
  unsure (1)..(291): unsure at all n locations
  Clone ID: PAT_TA_93947
gatacactaaatatgctgcgcgcgatgcctttttaatatgcgcgctgcagtagttatagcgcacaggctttttatgcggctgtcggagattttaaatcaggtccgtgcataataaaagcagattttataccacgcgtcgcttatatagcgcttgtgttgaagaacgcaaagtaacttttaccggcaccgggagctaccggcaacgcacacccaatggggtgcagccacatggtgtgtatcccaatacagttgcacgtatttgacatctttttctggcttttaaaanaaaaa

SEQ ID NO: 93948 - DNA, 476 bp, Triticum aestivum
  unsure (1)..(476): unsure at all n locations
  Clone ID: PAT_TA_93948
tttttttctctcaaaataaaacaatctttaaatcttcantgaagtccantctcangctatatcantctctgattttctgcgcttcttctggggagtgcttcgcttcggaagcttcaacctaggagtaatatatatatttcctatcctctattcctggagcgtccgaagcacctggtgcancgttggagcaaatctggtgacgttgagcctgatgtcctgntccaaccantagtanttcatgcccanctgccaacctgnttatgtatcgactccgggncantcaancgccgggtggnccttgncgtanttctcntagagcgtgctctcctccgcggngnngctgtactcnanngtcccgcaaacctcanctccttgggctgnangccgtaaaataacangggcgagtggntccangtgggnccacnggaacaanctgnagcancgccgcgttggngcgggaggaaaaaaaaattgtg

SEQ ID NO: 93949 - DNA, 537 bp, Triticum aestivum
  unsure (1)..(537): unsure at all n locations
  Clone ID: PAT_TA_93949
gcatcctcctctcctccagataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcangtgtggccaattgagggcatcaagaagttcgagaccctgtcttacctgccacccctatccacggnggncctcctgaaacaggtcgactacctgatccgctcaaagtgggtgccctgcctcgagttcancaaggntggnttcgtcttccgtgagcacaacanctcccccgggtactacgacgggcgatactggncaatgtgggaaagctgcctatgttcgggtgcactgacgccacacangtgntgaaccaagtggnggaggncaaaaangagtaacctgacncctatgttcgtgtnaacgggtttcganaaactnggncaagtggagtgcgtcancttcancncccttnaggcnaacgggg

SEQ ID NO: 93950 - DNA, 326 bp, Triticum aestivum
  unsure (1)..(326): unsure at all n locations
  Clone ID: PAT_TA_93950
gggtcacatnagaccanataanaagccactggtgactgtancgtccataaccaaggccggtttatcaaaacctcctataattataacaaaataaatatcatacctgtgatacttatgtgtattgccggcttaccaggccatatgcaataanagcantagtnccaananagaangcancaccctgtgnaacttattcatacngccggcttacaacnccttagatatgcaaagggtaacagcccccannatttgagagtataggactccaaacatatgatcataatcacactgggcgancntaatgtccaangcnangccggggttaa

SEQ ID NO: 93951 - DNA, 515 bp, Triticum aestivum
  unsure (1)..(515): unsure at all n locations
  Clone ID: PAT_TA_93951
atttctttaagctttgatcagatcaaggcagacttgatctacactatactggtccatcctattacatagaggatttacatattaccaatctcctgttggaaatcgtctaattctttttgcgctgcggcatatttcttggacatttcctcaaacttctgctcccactggtcacgatcgttctcaagagcttgaaccttacgctcgaaatgtccagctttcacatctgtctgacgtagtttttcgtttgtttctcttaagttcttgtcaagcctcttcagcctcttcttctaaaagttgtagtcggcgttgtaaagcttcgttctgtgatactgcgccagagncttcccggcaactggcttgggctcttttacctggggctcaagcttctcaacatcggggttcaaagctggattanttttggtgtgcgagcggaaagggatctcaangatccttttggaagaantccccggccaaagcctcctaaattccnttttgggggncnctcngaccctctg

SEQ ID NO: 93952 - DNA, 563 bp, Triticum aestivum
  unsure (1)..(563): unsure at all n locations
  Clone ID: PAT_TA_93952
ctcgtgccgaattcggcacgagacaagaagctcatagccaatcaaagcctctccatctccgaagctccaaccgaaccgaggatgtcttgctgcggaggaaactgcggntgcggnaccgcctgcaagtgcggnaacggctgcggcggntgcaacatgtacccggaggccgaggccgccggggccancctcctcgtctccgccancgncacccacaangngagctccggcggnatggagatggcggncganaacggcggctgcggctgcacccantgcaagtgcggnaccaactgcggntgntcctgctgcaagctgctagatcattgatcatcgatcatgcatgcaccgcgcgtgcagcatcgatcatatcgatctantantaccatancaagtaaccgctacctgatcgagggncttatctatgcacctgacctgcatcancaatcaggtgccatgccaatgcttgttgtaaacaagcccccctaaataaaatctcccngggnttaactaaaaaaaaaaaaaaaaaantccangggggggncggnaccaattcgncctatntt

SEQ ID NO: 93953 - DNA, 224 bp, Triticum aestivum
  unsure (1)..(224): unsure at all n locations
  Clone ID: PAT_TA_93953
agcggnacgagtctatcacaaagctgttttgatgttaggagctatatactagtgcgacaaaccacaagtatataaaaagggncggtcgtctccatctgtgntcancangcaacataaaatggnttgggattgaaaattataggngggagggcnaccanttccnanatcaacaaacaatggntgtttggtgtcngngaaaacgtcnncccaaggggctccgtgta

SEQ ID NO: 93954 - DNA, 572 bp, Triticum aestivum
  unsure (1)..(572): unsure at all n locations
  Clone ID: PAT_TA_93954
gcggtaatggtcaatgctaaacaaggccaagtccggggttgcagacctgtctgaaaagtcataaagcagctgggncaaggtcgaacggtacagagtggattcaaaaagtagagtctagatggncaaggcccctgttctcatgggagtangggattggngcttcggagtcagcaagggccagacacctcccttgcgctgacatgtaaggntacgagaagcacacttgaccaagcgacgggcaanatgaggccgtcgagaatacacatgcacgcatgtttccaaagcacctccgcagaggaatccaacaacggaggctcgggtggattaactgtttgtagttgactgggtgttaactcaagccggtaaaggggcaaggtcccncgggncgcgcaagaaattcgtccntctgggacaatgggaagggggatgccgtggtgctcaaccaatcgactttgatctcatgaataaagggacnttgatgggccacgtcaagatacctccaatccaacctgggaaaaacaacaaaggnccggtaaccgggtaaaaancaaaatggcctcctttgngcaatn

SEQ ID NO: 93955 - DNA, 251 bp, Triticum aestivum
  unsure (1)..(251): unsure at all n locations
  Clone ID: PAT_TA_93955
gacgatgtcggcgatgacggcggnggtgcccttctggcgcgcggcggggatgacctacatcggaatantccaaagtctgcgcgggnctggtgngganctgcctcaaagancccttcaanaccgaggtctcctcccgcgaaaaagnccacttctccctctccaantgggncgacnagaaacagcangaaggccactgggcgcacagatgatgaatgaagnttcggtgncaagggcgatgtttttagaagttg

SEQ ID NO: 93956 - DNA, 509 bp, Triticum aestivum
  unsure (1)..(509): unsure at all n locations
  Clone ID: PAT_TA_93956
ctcgtgccgaattcggcacgagcttcattctatccagggattgttttctttatcgtcgacttcatccaatcacctagcgaggcctcctcagttacccttgattcctccatcgtagcttctttttaacctttcacttattatcgcaatgtgttggaaattcagactctatgtgtctgaagtttcccatgattggaacaactaagattctcacacatgaatcacgaacaagatgatttatatctccttaattgagcatgtttgntgcttgagactcgactagtgcatggtatggnctgatacacgtgtaggctttcatccaccgaccctgnccccanacttatgttgnatactgtcgtgcgnttcantggcantgntagagtatgggaacgaagtgatggatggnatctaagtccnagatttggtctatcaaagagtacatgtatataaagctgtctaaggggatcaaccggggacaggtnaatccaaacaaatcaaattcaattcaaccc

SEQ ID NO: 93957 - DNA, 380 bp, Triticum aestivum
  unsure (1)..(380): unsure at all n locations
  Clone ID: PAT_TA_93957
ctcgcccttgggggccttgccggcgtanaanacgagcgccttcttgatggcgancggcttgggggtgcccacgggcttgtcggccccggtggncttccaataaccggacccggcgggccggttgggcctgganccgttggggtaattgcggncccgcggggagaanaantancaaatccttctcgccgtacaacgccanctttgggagctgncaagggncnaacttntagangtcnatctcngngatgatggggaccgcgatgggcgcgccggcgcaacggcggcaaaagtantgcgtcanctcntgncgaattntgnaaaagggggggncccgntnccaaanctcccnaaaaatgnngcctaataaancncgntcaaag

SEQ ID NO: 93958 - DNA, 198 bp, Triticum aestivum
  unsure (1)..(198): unsure at all n locations
  Clone ID: PAT_TA_93958
aaaacangggagcgagcatggngtcgtccactgctgtgagcaagcgcggggacgcgggcggngtcctggctgcgatntcncggtcctcggtggcggcgcacggncgcgangccgcggcggtggcggggaanctgctgcggagcacggggaangnggcgtggatngccgggacgaccttcctggtgctggncgtgccgc

SEQ ID NO: 93959 - DNA, 522 bp, Triticum aestivum
  unsure (1)..(522): unsure at all n locations
  Clone ID: PAT_TA_93959
ctcntggcgaattcggnacgaggggtcaaaaagacccatataacaagccactggngggctgtnacgtccataancagggncggtttatcaaaacctcctataattattacaaaataaatatcatacctgtganacttatgtgtattgccggcttaccangccatatgcaataagagcaataatcccancacagagcgcaacactctgtgtgacttattcatactggcgggtttaaagccttatatagcaaagggnaacagcccccaaaatttgtgagtatatgnctccaaacatatgatcataatacactggngacttaactccaaagctagggcgggntaacaaaaaacccgggtgttntgaaataaagattcanagcatcaatgggttgngtcanaattttttccaatatntacggtatggngnaaancagaaatcaccaaaaaactcncanggnacgtatnnaatttangncccaagggantcaaanggtggcaagnccccacancanagggtttttca

SEQ ID NO: 93960 - DNA, 488 bp, Triticum aestivum
  unsure (1)..(488): unsure at all n locations
  Clone ID: PAT_TA_93960
tacctacatagtacagccatggcccccaccgtgatggnctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcaagcaaggttgggntcatcttccgtgagcaaaaangcatcccctgggtactacgatggncgggtactggacaatgtggaaagctgcctatgttcggntgcaccgacngccacgcaagtgatcaacgaggtgggagggaggtcaaaaaaggagtaacctgnccccctatgttccgcnatcaaccgggatttcnacaaa

SEQ ID NO: 93961 - DNA, 577 bp, Triticum aestivum
  unsure (1)..(577): unsure at all n locations
  Clone ID: PAT_TA_93961
ctcgtgccgaattcggcacgagtgaatgtttcgtatttggcccgtaagccatgaagctagagaatctacttctctacagctaaagcgtaaaaacgtgatctctcttccaaccagtccccaagtattttctacactatttcttcaaccaattcttttaaatccttttcgacttgttgacgacaaattggatggtaaaagtccttattcttttcgaatgtctctagcgctaagttggcggtcgacttgatttagcttacgataaagtggccgcacgaacttcatgcgacctacctgtcctagcaaatcggtgggtgggcttatagacctcttcatcatgcgcagcgagggncgatacccanggtagcgtgaagtcaattcgacattacgagagacagtaaggggagtatgcctgacccatggagcgtggattgtgacacggtcaaaaggcttgggaaaaaaagctggtatggcgtttccagggaanannaacaatttgattttgcacncnagccctcaataatccgcngggtggatggggntgaaattcccanattccaatttcccnagcaaggggana

SEQ ID NO: 93962 - DNA, 566 bp, Triticum aestivum
  unsure (1)..(566): unsure at all n locations
  Clone ID: PAT_TA_93962
ttttttttaaattgacgataccctgtattaatagaaaatcaagtgacatctagtctgaagctctactatacatattggtagtttagagccacgagacacgcgtaccccacaccatcataaagccaagtttatctaaagtttcacctactctaatccaccaagaacctcaacagcgtgaattaaagaaaatggcgaaaactcagaaaaatacatcaacgcgactactatatctccttacactcgtaaaaatcttgtctaacattgtattccactctcaatatattcctttgttcgtcggtaactacagagtaaatattcatccttggacttccataatcatttgcaaaatatttaattggaaaacgcctgtatagtacaccatcttcgatgacatcttgggcgaaaaaataatcccagcgtattttaagtgnttcttcgattctttcggggggaacagtgtantcattgggacaagagggnatgggctcacggnataaattggttcagcgtataantaaggggtgggcgaatnaaggggtggccaatgantttcaattggtgaacng

SEQ ID NO: 93963 - DNA, 506 bp, Triticum aestivum
  unsure (1)..(506): unsure at all n locations
  Clone ID: PAT_TA_93963
ctcctcctagcaagctatatacctacatagcacagccatggcccccaccgtgatggcctcgtcggncacctccgtcgctcctttccaggggntcaagtccancgccggnctccccgtcagccgccgntccaacggcgctagnctcgggagcgtcagcaacggnggaaggatcaggngcatgnaggtgtggnccatcgagggcatcaagaagttcgagaccctgtcctatctgccaccggtcaagcanggaagggcctcctcaagcaggtcgnactacctgattcgctccaaatgggtgccttgcctcgagttcagcaaggttgggggtcaatcttccntgtgnanaangcatcccctgggtactacgatggncgggtactggggcaantgtgggaaggctgccttatngttccnnggtgcaccggacncccacancaagggtgattaatcgtacgttggaaagngggncaaggaanggngntaacccctgtncgccttncntnccc

SEQ ID NO: 93964 - DNA, 212 bp, Triticum aestivum
  unsure (1)..(212): unsure at all n locations
  Clone ID: PAT_TA_93964
cttgatcatgtgaagaagctacaaagagaagggaatctagacgccatcgtggatcgcaacctgaacaacagnttcgacaggcaggaggtggagatgatgatgcagatcgcgctgctgtgcacccaggggtcncccgaggaccggncctccatgtcngaggtggnaaggntgctgggaaggggaaagccctggcggctcggtcgggaggagtg

SEQ ID NO: 93965 - DNA, 299 bp, Triticum aestivum
  Clone ID: PAT_TA_93965
agatgtattaaaaaatgttaaatccatataggaaaaatgttaaacatatattaaaaaatgttgttgacatgtacaaaaaatgtaaaatgaaaacaaaaagaaacaaagaagataaaaaaataaaaaccaaaaataaataaagaaaccatagaaaaaagataattaaaaaacaaagaaaaaatacaaaaagaatgaaaaaatggagaaaaaaagaaaagaaacccggtttgactcgcttcaagtaggtcgcacccatttaattatcacaaacagtaggttgacgcggtctagctatcctt

SEQ ID NO: 93966 - DNA, 214 bp, Triticum aestivum
  unsure (1)..(214): unsure at all n locations
  Clone ID: PAT_TA_93966
ctcgtgccgaattcggcacgagctgctgcagtccataaaaaaggagctctgcgcangaaangnggtcncgggcaacganaatggcgtgntctccctctccccgggtggtccancgggngtcctcctcttctccgttgctctcggtcgggcatgtgngctcggntncgtcctccangttcngntggnccaaccaatgnaagcaatccggncatat

SEQ ID NO: 93967 - DNA, 204 bp, Triticum aestivum
  unsure (1)..(204): unsure at all n locations
  Clone ID: PAT_TA_93967
agccaaatcctatataaccagatgggaataaattataatgnttcanttaagncgggggactttcttttcttncacgaccaagggcagnctttcaacttntctgtcgggtcgnagactanaactangaccacnttacgcttttttnatnaaagntcccggagcaactatcaaaaancctttcctaatggctganattggggaagg

SEQ ID NO: 93968 - DNA, 489 bp, Triticum aestivum
  unsure (1)..(489): unsure at all n locations
  Clone ID: PAT_TA_93968
gagatgtcgaatggatgaggagctcggncagccttgcttgcttgtagagattctcggtcaacgaccatactaatcatctaatttcccatcattaatttttcgacacatatcagcatggnttcggcaaatccgtataatcacaatgactcttcccaaacagagcacgatgatttaatagaccctgacgatgctggcattgatgaccttgatgatccactccacccgacttcttctcgtgcacctctggctgggaatatttcccaagccttcctcaaaccaagccgataactactttacttcccgcattccaggcgaagaccgtcgagctccacaaaatacaattggatgaatcagtatgggaaacgctgtccccgtgggcctacggtgcctatttgggcaaaagatgcgcgaaggntcctttacccaaaaaaaacttttcggngggggagnaagnccaacttcttttgtgnaaaggacaatacgatttct

SEQ ID NO: 93969 - DNA, 191 bp, Triticum aestivum
  unsure (1)..(191): unsure at all n locations
  Clone ID: PAT_TA_93969
caagcctcaaggcaaacaccttctccactctccangggcatggacgccgacgccgacacggtggtgttcgaggcaccggggcacttccgcttctatacgagcggtaggatagagggccttaaccggnctnccatcctccccgccggcgtcgacgagggcaccgggcgtcacctccaagtgnngtcgtcctc

SEQ ID NO: 93970 - DNA, 500 bp, Triticum aestivum
  unsure (1)..(500): unsure at all n locations
  Clone ID: PAT_TA_93970
ctcgtgccgaattcggcacgagcccagttagtcgaccaaccttcctttcaccgcatttacagaaacattggnactgaatactatcaacacatttccatcagtacactttgttatcttatcatcaatcatcaattgagnctctccaataacacctagcggcttgctattttgagtccagagcccaggcctgcgagacgatattttctaaatgaaagttccttggngccgcttccacgttgggattttctggncntgtattgncaagcgtcaagcttttttaccggggtgcaaactttttatgcaagtgaggacccgaaaaatatttttatcaagcaattgnntcatcaagaaaaatccccgaattttatttggatgcggnacatgatggatcctctgggggccnggatggggaggcgatgctcggcaataccgctacttcagtgggtagggaaaatgaatgggangcaccaaatatgaccttgntttaaagcaaacntctg

SEQ ID NO: 93971 - DNA, 204 bp, Triticum aestivum
  unsure (1)..(204): unsure at all n locations
  Clone ID: PAT_TA_93971
ctcgtgccgaattcggcacgagcncanttngtcgcccaaccttcctttcaccgcatttanagaaacattgggactgaaatantatcaacacatttccagtcagtacagctttgntatcttagtcancaatcancaattnaggtctctccaaataacaccatagacnggcattgcntatttntgagtccangaancccagggccc

SEQ ID NO: 93972 - DNA, 180 bp, Triticum aestivum
  unsure (1)..(180): unsure at all n locations
  Clone ID: PAT_TA_93972
ctcantctcacagacccccaagctaagctagtgncctctgcatctcgngctcnggggaacttagatnaagcacanagcgagggncgattagcaagctgatcggnaagattantgggcggtgggggggnntgctgcnacaaaaaagtgttgggtgggccgcctttccnctctttcaanacc

SEQ ID NO: 93973 - DNA, 331 bp, Triticum aestivum
  unsure (1)..(331): unsure at all n locations
  Clone ID: PAT_TA_93973
ctnccgattccgagcanatncgactggaaaggcgccntggggaaattccccncgggnaagggctccatgggaccgccgccgtccaagctggccctggtgggcgccctcntcccgggnggggctgctccccggngcgggcgcgggganggnggagggctaangtcaacgctgctctangggngacgaanntngtcctcggggtggcgggtcctcgggaagnncatccgcgaaacnggnangcggggcnaacaatngtcggggtcctctccgaacggggggtctnccgagtaatcgcggggaaattcctcccaangnttgatggggttggatt

SEQ ID NO: 93974 - DNA, 436 bp, Triticum aestivum
  unsure (1)..(436): unsure at all n locations
  Clone ID: PAT_TA_93974
gcaacttcaaagcttaatggagactaagtaaggctggacaaagacgctggggacaactccgaggcctttctggattaagacaatggggggagaaaagaaatggnccgattgacaaggnccgccataactgggacnaanaagacatcccccttgtcaagngaaatgggggaaaaatcaagggntctggnggcaggganaagttctcnnccgggtccgggnaaaatcaattggancccggcntagacttgtggcngngncctttggntagncccccgaattccgggggacaaaaaagacttaatgnaccttttgttttgggaactcgcatcactcaangtatgaaaagggaaggggggaaacaacnggaaaatattccccgaatggggaatacgggggcctaccaaaggggggttcntacgggcccaaaaataaaagg

SEQ ID NO: 93975 - DNA, 475 bp, Triticum aestivum
  unsure (1)..(475): unsure at all n locations
  Clone ID: PAT_TA_93975
ctcgtgccgaattcggcacgagatccaatccagtccccctccgatctcaccgggaaacctccgatcgaagcaaagccaaggctctctcgtcctcctcctcaaggtatgcgatgccagcgtctgatccccccgttttgcctcttgttcatagattatattattgttgattcccctcgattgctgttagtctttgtctcctgttcatatattatcaatctctgtagattgttgttgattcccttcgattgctgttagtagtttggtgtagatctgtgcgtcgattgctgctgattcaattagtcgaggttgtagataaatcttgcctggattatggagtagaactgccgattgggatgcggttgctattggttggattatgtatataattaagctagttctgctcgactgttgctaaatcttcgnanattgtttgngggatttaagattctgtaccgctcaagacacgcctaagcct

SEQ ID NO: 93976 - DNA, 279 bp, Triticum aestivum
  unsure (1)..(279): unsure at all n locations
  Clone ID: PAT_TA_93976
ctcgtgccgaattcggcaagannttcgttcccctttctcctcttctccaaaangggaaaagggangggactggngntcttccggtgncngncggggannctggggggtctntcttnctccgtccggcgntncggggaagggangangggggaagcctnanggggcccanccggtctggaaaaaagggtanttttaagtggtcnangggcgccgccgtggtggngggtgaaggggcttnntccaagtaaaggngggcgcaaaatttccccccaatttgga

SEQ ID NO: 93977 - DNA, 192 bp, Triticum aestivum
  unsure (1)..(192): unsure at all n locations
  Clone ID: PAT_TA_93977
tcctctgtaattgagcggagcgcacacaactatcttttctgttcatctttctatcttccaacacattatagagtgcaaagcatctttactagtatctataatcagttatctacaaacgcagtatctttagaccatanaaaaaaaaaaaaaaaaananaaaanaaanaanaaaaaannaaaaaaaanaaaaaa

SEQ ID NO: 93978 - DNA, 488 bp, Triticum aestivum
  unsure (1)..(488): unsure at all n locations
  Clone ID: PAT_TA_93978
ctcgtgccggtttttttattagaaacagaaaggaaaactgtataacaaaaacaaaaataaaattgtacataggcatattatatatcaaaattttcagaaaaagatttcctacagcgtgagcatttttgtagaattaaataaaatccgcaaaaattcaaataaatcaaagagtgctactgctctactaaaatccaataaaaatcattttcaaaatacgaaaattaattcaaatttatttctatctaattttctgttgtagggaatcatgttaccctattttccatatatttttattttggagaaaaataatttgaataaaacccaaatactccaaattgaaaataatttccaaaaggactttaaattangatccttttaaacttccaactcatatttcatatgttttgaagaagtcattttatccttctctcaagaaaatcattgagttgcttgaagtttctgaattggaaatattttcaaaatggang

SEQ ID NO: 93979 - DNA, 418 bp, Triticum aestivum
  unsure (1)..(418): unsure at all n locations
  Clone ID: PAT_TA_93979
ctattctccctcccttacccgcgtggntccgctccaaaatccaancaatcccgcaattcccttcgagggtgttttttncgctcgacaagtcgacgagatcatggncggaaaaggngangggccggcgatcggcatcgatctcggnangacctactcctgcgtcggggnctggnagcatgaacgtgtgggngattatcgccaacgaccaggggaaacggaacacgccgtcctatgncgncttnaccganaacgaagcggggtcatcgggcgacgcgcgaanaaccaagncnccatgaacccgatnaacaanngtcttcgttgttgaancgggtcaacngggcngggggnttctcggttctcnntcggggcccannaggcgangcccaanctgntggggccgtttaaaaggggaattccc

SEQ ID NO: 93980 - DNA, 502 bp, Triticum aestivum
  unsure (1)..(502): unsure at all n locations
  Clone ID: PAT_TA_93980
tttcgattatttgacaagtcaaacatgggaggtttacagaagcagtccaagcaatagctgcagacaagagggccaaggaggcgattatcgcctcaaacaaggacgtctccatggcggaagaagggcttcggagttctggagtccgaagataaatctgaggagactgcaacctcaatatcgttcaacagactatcattaaccaatagcaggataccggccgtatcgatggtactcgctaacccatgtcttgctctcaacagatatcggnaaatttgtcatctgtcagctgtgacgggcgaatgaatgttgttttatactactttgtcccaatttataattcctgctttcaagttatcatgatctgcnacaattttggntacgattcaaaagtttggnatggggtggggatgaaacaaaaaagggaatctggggatctctgcaaggctccaatccgtccctcctatccccnttanatggggccctggggtctttcnacnttaaa

SEQ ID NO: 93981 - DNA, 422 bp, Triticum aestivum
  unsure (1)..(422): unsure at all n locations
  Clone ID: PAT_TA_93981
ctagaggagaaggtgcaagaggaggaactggaagaggaaatggtggaagaggaactctatatgacaatggaggaaggactggaccaggggctggattttggaacttgatgtttgcacctgattcagataagtcacatgtcgcagcagaggaagagccaatcacacaaaatgcaccacaaggggatgagtgggatgatgacttcgtccacatgtagatatacaaactgatgcagaagttcatgactgaactttatggaatgcaactaagttcaccaatgaacttcatttgtctatttagaggcctcttttcatgtaaacatgtaatgcacttaaagtatgttgacatgaagcacattgggnaagtatcctttcattgttcaagtgttttgtgaacctgctttcaaaatttattattcaagagg

SEQ ID NO: 93982 - DNA, 336 bp, Triticum aestivum
  unsure (1)..(336): unsure at all n locations
  Clone ID: PAT_TA_93982
ctcgtgccgaattcggcacgagaaataaagcaacaaagaaaacaaaaaaacaaaaaagtgttttcaaatttgaaaactaatggcattaacaaaaagtttataatttttctaaaactaaaagcataaagaattaaaaaataaagcaaaaaacaaaagaaaataaataaagcaacaaaaaacaaaaaaatgccacctactgggcccccacggnctgaatacgactagaaacccatccaagggccaggattcaggcccgcaggaggcccactaggcccacaggcatagcagtgacaattaggcccgtnangcctgcaatggagaggagctcccaggagg

SEQ ID NO: 93983 - DNA, 474 bp, Triticum aestivum
  unsure (1)..(474): unsure at all n locations
  Clone ID: PAT_TA_93983
tctatccgcattatagcgatgcatgcttcgactgcgctcttcaattgacgaattttgctcatgctaggttccagaacgcccatttttatctcatcaactactttcccctctgctagatccaatccgtagtttttatagttctttttctttgcaatggntttttcatcttcactagcatctccatcctggattcgttgtgaaagtgcatgccgggaacgaagctgtgccacaagttcagaggaatccttggccgcgttgatcgccaatgtcttaggaatgacgagtagggcttgggcgaattcgcctatggctagctgctcccgggaccctactgtgccaagcgaattcctcgagatatatgtgggngngnagtctccacagnaccaccaccaagggacaatactggccactttcctaaggntcgcttggcggnacaaaaggggaancggtggtaccggntcggntccatttcgg

SEQ ID NO: 93984 - DNA, 425 bp, Triticum aestivum
  unsure (1)..(425): unsure at all n locations
  Clone ID: PAT_TA_93984
ctccgtcgcacccttccagggtctcaagtccaccgcgggcctgcccgtcagccgccgctccagcagcgccgggctcggcagcgtcagcaacggcggaaggatcaggtgcatgcaggtgtggccgattgagggcatcaagaagttcgagaccctgtcttacttgccacccctctccacggagggcctcctgaagcaggtcgactacttgatccgctccaagtgggtggcctgcctcgagttnagcaaggatgggttcggtttccgtgngcacaacaagctcccccgggtactacgatggtcgatactggnnaatgtgganagntgcctatnttcgggtgtacccgactcccacacangtgntnaacgagggtggtggnggncaaagaaggagntacccctggacgcctatgtccgccggcancggg

SEQ ID NO: 93985 - DNA, 348 bp, Triticum aestivum
  unsure (1)..(348): unsure at all n locations
  Clone ID: PAT_TA_93985
ggcgtaaagcagctattcgctcatcaggtggagcatggcgtagacggttgcggtcgaggaatcgtgcgagagggtaacgatgacgatttgctacgtcatagtcagatgagtgactattattctcgatagctgacaatggcggtgggagttcatagccttcggaggctcgtgccgaattcggcacgagctcgtgccgaattcggcacgagnctcggaaggntatgnactcncaccgccattgnncagctatcgagantagtanacactcatctgactatgacgtancanatcgtcatcgttaccctctcgcacgattcntcgaccgtaaccgnctacgccatgctccac

SEQ ID NO: 93986 - DNA, 311 bp, Triticum aestivum
  unsure (1)..(311): unsure at all n locations
  Clone ID: PAT_TA_93986
ctggataggtgtcttgacttggacacccagcatcgaatttggacgatggaaaaagatgaatggtggtatgagcaaggcatttaaatttccggccataaaagctactggggctagcaaagcctaaaccattaagctagtgctcggctctggtggagagaagtactaactcatgcctcctgaggaatgggcattctaacgctctagcctatcaaagcctctcattgtcttcgtgccaattattgaagaacttcgagacagctcgctagtgagaaatacacgtcattttgaggaaaaaaaaaaanaaaaaaant

SEQ ID NO: 93987 - DNA, 509 bp, Triticum aestivum
  unsure (1)..(509): unsure at all n locations
  Clone ID: PAT_TA_93987
agcgtcatcttcgtaaacctctgctcgtcctcctcttcctcgcaggaagaagcaagcagnaagcgtcggnagcccccgccgtccagatngccatggcggccgagccggagcaagcgcccgcggcgcaagaggcggncgtgcacatcgtctacgtcgaccgccccgaggacgccgaccccgaggagttccacatccgnaccctcgcccccgtcctcgggagggaggagaagggcaagggcgcggtcctctaccactacaancacgcccgccagcggnttctcccgcaaagctcaccaacgaagcaagtcgagggacctcaagagtgaagcggcccctttcnttttattangctaatggagtttccagttntacttgcttcccctgggaagattttttattattccncaataatggtgggaatttagcctcatgcanaatgcgggggtttactttgcatacncataatgcngggaatttagttncnattgaggtcaaatggntggcccacc

SEQ ID NO: 93988 - DNA, 519 bp, Triticum aestivum
  unsure (1)..(519): unsure at all n locations
  Clone ID: PAT_TA_93988
gactacggctgggacaccgccgggctgtctgccgaccccgaagacgttcgccaaaaaccgggagctggaggtgatccactcgcggtgggcgatgctcggcgccctggggtgcgtgttcccggagattctgtccaagaacggnatcaagttcggcgaggccgtgtggttcaaggccggcgcccagatcttctccgagggcggcctcgactacctgggcaaccccaacctggtgcacgcgcagagcattctcgccatctgggcggntcangtggtgctcatggggcttcatcganggttaccgcgttggtggcngcccccctcggcgaggggcctcgnacatcatctacccggggcggggcctttcgaaccccgnctttgggctcgcccgaacnaaccccnganacccgccggccgaagctcaaagggcaaangaagctcaaagaaacgggccgcctcgccatgttctncaatggttcnggttcttccttgcaagggcnatccgncaaccggggaaagggg

SEQ ID NO: 93989 - DNA, 496 bp, Triticum aestivum
  unsure (1)..(496): unsure at all n locations
  Clone ID: PAT_TA_93989
ctcaagtactaattctgtgattactgtaccgttatctgcgcggataaatattaatatttctgcactcagcattgtcttctcttcgcctctaatcttcattgctgagtaagtcagaatacgtatcggaaaatggcttacaagaaaaatccgtcgccaatacctcgctcattattaagaaagattttacctcttatagccctttttatcttggtctctgccctatcattcatttgctaccaaatttatcgtaccattctaaagatctcgtctgcaacgtcaagaaaaaatgcaaaaacgaaacatgagcatttcgaagggcggagccaaacttagcatcagggaaatcaaaaatgaaggctatgttgatacnacacaaagtttcgtccggtaaggcctgggaacttgagcaacttttctgggcagacaggtcgcattaagatggggcaagcataacttcaagcaagtaggagggaattancgagggtgaagacgtcnc

SEQ ID NO: 93990 - DNA, 323 bp, Triticum aestivum
  unsure (1)..(323): unsure at all n locations
  Clone ID: PAT_TA_93990
cctgcctactataccaagtaagagacaccggtgtaaaggaggcggagtgggaatgcgaggtatagtatcgactctcgcaatgtcatccacagaaggttatatgctagccgcaggaacatggactcgatgggtcggcttatacgacgcgggtgggcttggagggacaattgcaacttggagtgtagctgatgctgctgataacgttgcaggaatccttggnagtggtgtgagtgaggttatttggagcgcttgtggtcggtatctgtgtgttgtagagcgtatganccgtggtattttggtttatgaatcgtngcgcncagcac

SEQ ID NO: 93991 - DNA, 486 bp, Triticum aestivum
  unsure (1)..(486): unsure at all n locations
  Clone ID: PAT_TA_93991
atgaatcaacgttcaactgaagtgcaccctggatcgtgaagattgtacaagtttgcgtttccccttcatcctaccctacgcttgaatctcgagacgagattcttgtttagtgggggtgagttgtcacatccctagcttctggcantgcnctagcctagcttcatgtgtgcatcatgtctatatttttgaaacttgacttgaggaatattggcagcctcaaaaccctaaataaaagaggggcaaaaaccctagaaatctcattcattgctccaaaaggctcttcttaaatgtttgataatttttggnaagggttctggtcccaaccaananattgaacatttttaaggatttatttttgggacnttgaatttaactcattanctatttgaanttgaantatattcatataattangaatanaattncaaatacccctgaaatattttatnacgcttttgggnaaagtccatctagccaanntaaaat

SEQ ID NO: 93992 - DNA, 491 bp, Triticum aestivum
  unsure (1)..(491): unsure at all n locations
  Clone ID: PAT_TA_93992
gtgnttctttcggtctaacccanctcttctctttcaaaattctcactttggagacacaaaaaaaattganaacctataaaaccaagtttctcaaaaatttcgattcgatctataatcttcttcgcaagaaaagatttctacctcgtcctttaaagaattttattgtnaaaattctagctttctctagttccttgnttccgtgngaaactcaacatcaaatttcaaacaagganagaatttccaaagaaagccagaatgtcnaacgccacagntgatcagattacttcagagctcaacgagacctccttggncaccaatgaaactaatgatgttcctgcaattaacaccaccgtctccaatactgcatctgaggntctcgacaatgcntggcaaactccncaaagnaccgtagncccctcatcctcangnaactgnaatccctcnatgttggtgagcttgagccctcggnaaaccgngggnaatgnctattn

SEQ ID NO: 93993 - DNA, 499 bp, Triticum aestivum
  unsure (1)..(499): unsure at all n locations
  Clone ID: PAT_TA_93993
ctcgtgccgaattcggcacgagctcgtgccgaattcggcacgagtctccgccggggcgccatggatccggacgaggaggtcgaattcgatctctccccgttcgccatcgtgtacaagagcggccgcgtccaacgctctggtctaacgtcgcggaagagccccggcaccgacgccaccaccggcgtcacctccaaggacgtggtcatcgacgccggcacaggcctcgccgcgcggctctttctccccaagagcgtcccggagtcccanaagctccccgtcctcgtctacttccacggcggcgcttacgtcgccgagtcggccttctccgccaggtacaccaagntangtcaacgcccttgtcgccgccgcccgcgtcgtggacgtgtcggtggagtaccgcctcgccccgggagnanccgctccccgnccngggtacgangnacgcgtgggccacgctccgctgggacaancggcgaaactgcggctcggcggggctggg

SEQ ID NO: 93994 - DNA, 513 bp, Triticum aestivum
  unsure (1)..(513): unsure at all n locations
  Clone ID: PAT_TA_93994
tcctagcaagctatatacctacatagtacagccatggcccccaccgtgatggcctcgtcggccacctccgtcgctcctttccaaggggctcaagtccaccgccggcctccccgtcatgccgccgctccaacggcgctagcctcggcagcgtcagcaacggtggaaggatcaggtgcatgcaggtgtggcccatcgagggcatcaagaagttcgagaccctgtcntacctgccaccgctcagcacggaggccctcctcaagcaggtcgactacctgatccgctccaagtgggtgccttgcctcgagttcagcaaggttgggttcatcttccgtgaggcacaacgcatctcctgggtactacgatggccggtattggacaaatgtggaagctgcctatgttcggggtgcactgacgccacacaggtgatcaacgaangtggaaggaggtcaaagaagggagtacccttgacgccgtatgttccgcaatcatccgggattccgacaaccattgctg

SEQ ID NO: 93995 - DNA, 509 bp, Triticum aestivum
  unsure (1)..(509): unsure at all n locations
  Clone ID: PAT_TA_93995
ctcgtgccgaattcggcacgagggcaactgtcacgcacacggcggcggtgccacggcgtgcgcggcaaaagcgccctcgtcagcgatcacccgggcccggccgtccaaaaccccaagaccgagagccgctccggccgccggntagggtttccctcatggcgcggcgcggcggcggcgggaggcggagcaaggtgatgccgaacctgggggcggaccgggagggcacgcggntgctcaacctcaccgttctgcggngcctcgaccccgccgtcgccgacatcctcgtcaccgccgccaagcgtcaccgcctacaagcttcgancaaggacacggtccgatggagccacaagggcgtggaggggtcgctcttcntcgttaagaggaacacccaacccacattccagtttctcatcatgaatcgtccaaattacagaaaaatttggtcgaggatctcctgngcggtttttgatttacaanggtgtcnanttccttacattaatatacaccnc

SEQ ID NO: 93996 - DNA, 489 bp, Triticum aestivum
  unsure (1)..(489): unsure at all n locations
  Clone ID: PAT_TA_93996
gaagggttagggcggatgagaatttacaatcacgtcaagactctactcatacctgcactcactccaacaatcataactattcttacacctacgccaacatgagcggagagaaacaattaggcttttcgtaccaattcgccgcaggtctttaacgtcccatgtagtaattgaacagtcttgctaacaggagcaggcgctattgctggtatctctgagatattggtaatgttagtttctccatattctactaaatgcatatttttaactacactgtaggtatccgctggatattgtcaagactaagaatacaagttacagtcctctaaaggcactgaagtagattcatataatggcatggcgggctgcttcaaaaaaataatccggaatgagggatttaatcgactatatcgtgggatnggngcacctatcatcatggaagcccaaaaacgagcaaccaaaatttgcccgccaatgaattctgggggagct

SEQ ID NO: 93997 - DNA, 718 bp, Triticum aestivum
  unsure (1)..(718): unsure at all n locations
  Clone ID: PAT_TA_93997
atgggagctccanccgccggtgggcgggccgctctanaactantgggattcccccgggcttgcaagggctccgttgcccgaatttcggcaacgaggggtattgcnaancctccggggggaagaacgctgggggcgacgcaagcaactttgttcaaagaaagtttgcttgggataacggtgggccgggattcgccctccttcccccgtccgtccgccgggcaatccgaagcagttccaacgacgtgaacgaaccaattggcgttccgaccgaaagccgctccggggccgggcttgccgttgcgttccgacgaagcggggttcggcgcccgtgggacaaagaacgggttgggcgaagcgcgggggggttgaagcaaccttgctcatgaaccggcgggngcaagttgggcaagcgccggggaagccgtccnacacggcgggttgctccgggaacgaacgacnnaacggggcgcaagcgtgggccgtccgggggaagcgggcgggcaaacaaggcgcaanggcggcttgctacaaagttgccggggggaagcaacgggggcaactttcccggccgccgaagtngtcccgcaagctgcgggaaaagggaccgggcggggcggggaacaaanggctcctctttggcccggtgccaaacgttccaaccgaacgaacgggactcctcctaagggccgttggctttaaggggggtgttgtgttttgt

SEQ ID NO: 93998 - DNA, 513 bp, Triticum aestivum
  unsure (1)..(513): unsure at all n locations
  Clone ID: PAT_TA_93998
ctcgtgccgaattcggcacgagaaggtggggaagaagcgggggaggncnaagaagtacgggccggacgggagcctgatccaagccgttgaacgccacnccgatntccgcctcgggtccgatgtcggccgccgtcgcggcggggcagtacacgcctgcgggcgcggttggngccgccatnaagcgcgggaggggncggnccctcgacttcgccgccgcgggggccaagccgtaccancaccaagctgcancaagccgccgcancaagcagcaagttcggtttccacttcannctccattgggtgacatggnggcttgttctgctggtgggaatttcactcctcanancancactgntgntcctggagaagatgtgacgatnaaaggttattcattttctcaacaagggacccncnagcnaattgtattctctccgctaacggngtgntatcaanatgttacacttcggtcaaaancgacncctctngggggaangttnacttattaggggaang

SEQ ID NO: 93999 - DNA, 528 bp, Triticum aestivum
  unsure (1)..(528): unsure at all n locations
  Clone ID: PAT_TA_93999
ctccgtgccgaattcggcacgaggtaaacccgtagctcatatccaagcaaacttacttttaaacttcattcttaaattacgtcanatcttttgngtanacaaaatatagatttacccaatcaagtctttttaagtccccaaatccttgccgggtttaggaaagtggcccgggagtttaagcgctggtaaacgcgaacttgacgatgaggaaatctcactaccaactttgactacaactccgtagttgaaaatacatcggggcagcgttgttagtcgattaatccaaattgatgcaggtcatactcatatcatcttttgataatgaggaaaaattttaacatgtccgggnccaaagcaaaggaaggatctttggcactcaccaagcaagacnacatatccgccgaagcaagtcaaaattgatttgacaccctngggaaataacttggcgctatctacaccangccnggncacgccactttgtcgggtcacgccgaaaatatcanggtttaatggagggncctttctcag

SEQ ID NO: 94000 - DNA, 327 bp, Triticum aestivum
  unsure (1)..(327): unsure at all n locations
  Clone ID: PAT_TA_94000
ccccgcggctgcaagctcgngccgaattcngcacganacacaaacgaagcgagctcaancttatcctaacccaancagtcgcgagcttgtacgtatactcaactgttgcgcggcgcgattggnatggggctcnagggggaaaaaacngcggnggnggcggtgcannggcaccggctgtnnacggtggtgccganctcngtganggaggtggaggggtacnanctgggggacncggacctggngttncggctgcactacctgcgcggggtgtnntaccaccccgcngggggaagnggtnccngggtggccaccnanggtggtcaaggg

SEQ ID NO: 94001 - DNA, 370 bp, Triticum aestivum
  unsure (1)..(370): unsure at all n locations
  Clone ID: PAT_TA_94001
tcaaacgcaacaaaataaangggcgtctgtctancttgcttttcantgctccgagccctacgcggtgnagctcggnctaatcaaaaaaccctgatgtccctccggntngagggnccaacctccttatcctcaaacccgtccatgtctccgaatgacaagctcaagctcaaaaagntgggcccaangtcaagtgggagctctcctcccgtgcgattcctgctgtcactgacgatgaaggatgaatcccccnnncccgggattgtgggcccttttttgtcattggatgcaacanatnggcagcctgcaaggggcntgangaaactactgggcgaaanggttttgggtaaagaaaggccgggtggagaaaggg

SEQ ID NO: 94002 - DNA, 607 bp, Triticum aestivum
  unsure (1)..(607): unsure at all n locations
  Clone ID: PAT_TA_94002
ncttgtgccgaaattcggcaacnagcttgaagggtgctgtgtattgactatgagggacaaagattnaacttttgcggtggttcccatccgctccangggtgggtccccacaaaccaaccaaaattgctgccctttgcagtttgcccctgaagcaaaactttgactcctggattcaagggcctatgcaaaagcaaggtcaaagggccaaacgctgttgcccgttgggaaaaataatcctcatgaagcaaaggggnttacaaagatgggtaaaccgnatgggaactgacaaaccatcttggttctatggggatctcccgccctctttgggcttggactgggnaaacaaagggtcngaaaaagaatgtggtgnaccttttgcangcnatttacaatttgaaacnaaagaatggctgtcctttcgggtgaacaagnaagtggcatttgtccccccggggtgggtggtcccgcnatttggtgctnccccgccgattgactttccaagggggtcctgggtcgannaaaggactttcnaagncaagatcgcccgaagtttcctnccaancaaaggctggtggaaccaatctgcccttgaacaatccaanaaagg

SEQ ID NO: 94003 - DNA, 244 bp, Triticum aestivum
  unsure (1)..(244): unsure at all n locations
  Clone ID: PAT_TA_94003
aaaaagctggccnctccacngcgggggggcggccgctcntagaactaatggggntcccccngggctgcaaggctccntgccgnaattcggnacgaagccnaaacnggntgaactgctttccnccgcgctccccgantttcttcccttcncncccccgaaaaaaaggggaangggttgtggncgtnggcggngcctgaatnccggtccttcctnatcncccttcggtcaaaaggcggatccccta

SEQ ID NO: 94004 - DNA, 462 bp, Triticum aestivum
  unsure (1)..(462): unsure at all n locations
  Clone ID: PAT_TA_94004
gccgaattcngcacgagatgataccattanacancttcaatgcnatcccctctcanttgagggaagaatggntancaaggattcatgtnncgcgcaacgctatgtacccatcgatcttgctcctagcttancacaagaagaaaggagatgatnatgatgatgatacgtagagctagcctgcccnactgttgcacgggcggggttccctttcttgttcaaaagaatcaatacacccggggaggggnctcaatgganggggaatttagaagctacaggtnangacactgccaaggttgaatctcaaaagtgcttccatggggnggattcgatgggcaaagctttgcccngggctggactggctttnncttcnccccnangtaaaaanangggaggtccntcntcgcccntcnnaggganttccggggtccggatngaaagcttnttcccccgggggggtgantg

SEQ ID NO: 94005 - DNA, 701 bp, Triticum aestivum
  unsure (1)..(701): unsure at all n locations
  Clone ID: PAT_TA_94005
gctccccccgcnggcggggcgggcccgctctagaactaagtgggnttcccccgggggctgcaaaggctcgtgnccgaaattcgnggnacgaagcccaccaagattacaatagcnattggcaagcttcttgccaagtttcaaagaaatgggnaatggggggggagcatcnacgggngttcctcatgaatacantangtcctactacaaacatttacatttccagggttaagaagtttatatacacgtcttccctcccaaaggccgggggaccaaaaccctccccccccacgaagggcaacaccgcggttcgccgggaatcaaagaaggcaacgcgcaatccctccaagtaccgcattgggntggtgggccctgcaaggggcgctttcngggcggcgggtgggtggctgngngggncgcaaggcacaagtggggaccgttaagtcaagggctgaagggcagcccgcttgatgaattgaagggaggtggncctcctcccgggcaaggttgtnggaggcctacgggggaaaaggaggtccgccaacacccgccctgaaaccgcnggggggggnngtccaaggggcngtgcaacttggggttgatgtttcaaggtttggncaagccccatcngacgtnctttccgaggcntgcntggctgctggctcccgccggggggtggccccaaccctcccctcngnttgntg

SEQ ID NO: 94006 - DNA, 395 bp, Triticum aestivum
  unsure (1)..(395): unsure at all n locations
  Clone ID: PAT_TA_94006
ctcgtgccgaattcngncacgaanctcntgccgaattcngnacgnggtccngcacatgaaaaatcaaanatgatttancccaacaanccgnaaaacanttaccctgtctaaactcgaagcttcattacaaccgtcttcccttctctttcgttccncaccagttcctttaagcttgctcaccactttcttttcgccaatctaccaatccgcncgttcaagtttactcgatcaggtaaagncntgttancccccacccaagtatcaaattttctgcctgnagctgtagtttcgncnaacnactttgnctcagggggagaaagaccantaattcntcctgnaggcatttagccntggnnaacttcacaganancccctcacggatgnnagaancctta

SEQ ID NO: 94007 - DNA, 683 bp, Triticum aestivum
  unsure (1)..(683): unsure at all n locations
  Clone ID: PAT_TA_94007
gctccaccgcggggggggggcccccctagaactaagtgggttcccccggggctgcaaggctcctggccgaattccggcaacgaagccaaaagntggggnctttgacccgaggggggttcctcctaccaatgggccgcatcaaaagctcctaagcccgatgctgctaagagaagaaacggggcttggaggttcctggaattttcctgttggataattttcaagggatnctcaangtaaatattcctccttttccttttccccggtttaatggaacgaaagttccttttctggtaggtcaatttgggggttgttcctgcaagacaatggggcccctccccctctttaaaaggttatcctngatctttggtatcaaacaattgaaatcaagcccttgcaaaatgggnaagaattcaantttcctgtcctaaaaaaaaaaaaaaaaaaaaaaaactccnagggggggggggcccggggtacccaaantcngcccctaaaaaggnggaggtcggtantaacgccgcngctcaacnggggncggtcggttttaanaaacgtccgngaactnggggaaaaanccttgggnggttaancccancttaaaatccccctttgcnangaaaaacccccctttcccccaaactgggnggtaaaaancgaaaannggcccgcaaccggattgcncc

SEQ ID NO: 94008 - DNA, 620 bp, Triticum aestivum
  unsure (1)..(620): unsure at all n locations
  Clone ID: PAT_TA_94008
aattccnggaacnaagctcgtggccggaattccgggaacgaagaatgggaaaggnaagccccctggctcctgggcaaactggggctgtacaagcctggtactgaaaacaatcntgaattaagctttccgtngacttggcntaanaagccttgggngatgtgtgtaaaagaaaatttgggtcttccancaanggtgtcttaaaacattgtggacctgggatttaggtaaatgaangctgggggctcccttttntcctcacacccctggacggtccgacaaagggntgcatttaaccnggggagctantgcaaacccgggtcaaaaagattatggggttgctgcaagntccctaaaagtcaaanncctgttacaattgggaacttgggtggggaaaaaagtccctanttnggtaggnaattttggntgaatgtccngacaattgacaaaagcctggtttaaggngggnctcctaactttggggtngccnttttggggnccaaaccggncaanaaatttgnaagtgcggaaaatnctncctccttcttaatccaaaanaaaatatcgcctaaaannaattccccccaacaaggaatngggttgcnttgggnccaaaaaaaaat

SEQ ID NO: 94009 - DNA, 269 bp, Triticum aestivum
  unsure (1)..(269): unsure at all n locations
  Clone ID: PAT_TA_94009
gaactaagtgggttccccggggctgganggtcctngccgaattccggaacgaagcntttttgtgcattttgccaaaacatgaatggtaagggggtaaatgggntttataaanggtaccnatattttgncctaagnttttttttggtcgggttggggtcactatgcatcaatttgatgggggntggccttaagcaattggantgaaaccctatcngaacaagcctgaaacttgttaaatgttattcctactttacccgggtaanagaaaa

SEQ ID NO: 94010 - DNA, 684 bp, Triticum aestivum
  unsure (1)..(684): unsure at all n locations
  Clone ID: PAT_TA_94010
ccccgccgggggggggccgctcctagaancaagngggttccccgggcctgcanggaattcggcaacggaggatcttcattccccaatcctcctacggatacctcgnntccgcaaacaactccgangaacaggcaacggatctctttcctccttcaacaaaccttatctccncaacgccaatcccanctttganaaaaaattcatactaagggctcctccgccgggggttaaactggacctttaaantcaaagnatgaaaaactttccaaattggctcatttttggttggcaagcacttaagttttttgaangcccgacaagctggttggatgggtcgttttttttaagcctgtggggattacaanntaattgaagaccgaancaatgttggctggacgttgcccgggaaaatcctcctngggacttataaactccgggccaaattttcaaggtccgggaccaagtcnaagggttctttttccctcaaaaaaggtcgggnaagttctggaatatgggaggaattacgggnaaatttccaattggcttttatgggggggggnaatcactggggatcaatggattcttttatggtngttantgggggacaatcaaaacaanaaaatgggnggattacaataaaaggctctattaacnactaaggaccnaatgggggggacnggaggg

SEQ ID NO: 94011 - DNA, 519 bp, Triticum aestivum
  unsure (1)..(519): unsure at all n locations
  Clone ID: PAT_TA_94011
cgcccctccacntcaagctcatattacactcaanatgggcaacgcangtagtgcgatgctgggagaacatcgnacaaggctcaaattttgntcgcgatgaagtagacaggatacggaagagattcgtcaagttggacaaggataattccggtactatagagcgcgatgnatttctcaagtcttcctcagatttcctcgaacccacttgcgaccaaggttgatcgccattttcgatcaangacggaggtggcgacgttgacctttaagggagtttgtatcgggcttgagtgccttttccaagtaanggggaataaagaacaaaaagcttcgattccncatttaaagtatatgatatgggatcgtgntggctatattggaaacggcgnacctctttantgtgcntaaaaatgantggngggnagtaatnctcaaanngtcancaanctacagcaaaattgtgggacaaaacaattgatgggnagcanaccttgggttcgcnacggganaggataagcttcg

SEQ ID NO: 94012 - DNA, 233 bp, Triticum aestivum
  unsure (1)..(233): unsure at all n locations
  Clone ID: PAT_TA_94012
ctcgtgccgaattcgggacgaagctcgtgccgaattcggnacgaggtttgctggattnatcancagcagttcncgtttttctcnnctttttcccttttttttttgttgntttcgcatgccaatggctgtttcctccggcngggagtttggatcattcctgggttgggtgnagatactcgagacccgggccctgctccnaatctttgggagcggcgggatncattcngaccctg

SEQ ID NO: 94013 - DNA, 528 bp, Triticum aestivum
  unsure (1)..(528): unsure at all n locations
  Clone ID: PAT_TA_94013
gcaagaagcacagaagaagctcctagccaacaccaatcaaagcttccatccaatcccaagcaacctcgacgatgtcttgctgcggaggaaactgcggctgcggtagcgcctgcaagtgcggcaacggctgcggcggctgcaacatgtacccggaggccgaggccgccggggccaccctcctcgtctccgctaccgccacccacaaggcgagctccggcggcatggagatggcggcggagaacggcggctgcggctgcaccaattgcaaagtgcggcaacaactgcggntgctcctgctgcagttgctagattcatcatcggtcatgcatggcaaccgcggtgcaatcaaaatccttttgntcgattcaatccaatctaccttaccaatgttaacgcctaccctggatncgaggggtccttttgttttgttatgtnacgccaccttggcctggcaatgaggcaanancnaaggtggccaatnnccatgnaatgttaaacccccctaaaataaaaatctncccgtgggnt

SEQ ID NO: 94014 - DNA, 590 bp, Triticum aestivum
  unsure (1)..(590): unsure at all n locations
  Clone ID: PAT_TA_94014
ttcaaagttccaaancaaacaagcaacaaaagagctggcttcatgaaggcctccccggcgggatacttgctccaggagaaaacnatcatagctacaagtgttcaaagtttgtgggagcatccttgagaacaacgaagaagcctttagattaagaagtgcaaaggtcaagttcaaagattgttagcctgaaaggttaaaggggcctgtggagtatgttccaaaattgttcgatgagcaggaagacaaggtttgcnagttgaagcaaattctggcggggttantttnttggggggctgagcgtcctaagcggcacaactggggcaaggctcaaagcgtcaggctccgctngaagctgaaagcaagctctttgagggcacgccaangaaagcctccaagnangacaacnantnccccctaatcgttgggtggaagggntttgtgnattcgattgaatggggaagggaacganaagaagaagagaatatcttggctccgtcaagcaagggttgnaaangggttgnttccggtataaaacnccgggggccaaaaaactctngcnaaaaaaatccgggttcctgttcaatggggtt

SEQ ID NO: 94015 - DNA, 587 bp, Triticum aestivum
  unsure (1)..(587): unsure at all n locations
  Clone ID: PAT_TA_94015
aacgagctccgtgccgcaaatccaacgaccgtngagaaaacggcggtcaagagctcaaagcgancaacaaacaaagcccatagcccgccgccgccgccgccaggggacccctccccccttcctttcncccaaggagncctccgcgacgccgggnagggtcgctgttgngcctgactactccccgtagcggacatgggattcgaccggcgctcggtggtgcgggctccggcgcgcgcccggattgggcccccaaggagtgggagtcccttgggntntactttcaagncaatgtgggtgggttttcaaaggctcaaaaacaanctacttaaagggttggggccgcctcttcannttttgtgtgnggggnaatcccaatttggctttcttcaacaacaaaaaaacaagtanctctccttaaggacatcaggcaagnttaaaatcnaagggggaagggaaggtgcgncattgnggtggctaagggaacccaaccggggntanaaccgggggcctgaanaattgtttcgggnttttctnggnaaaaaccaaccctcaagtntccggttttcaacaaggggntgtgaccggca

SEQ ID NO: 94016 - DNA, 520 bp, Triticum aestivum
  unsure (1)..(520): unsure at all n locations
  Clone ID: PAT_TA_94016
ctcgtgcccgaattcggcacgagagcatattgaatttatactgactccacccaacgatatcaggccgtgagttactgagggtttgatctgggaatatctaggctttattatgtctcaaaccaatggtctcacgaagcttgcttactcgcgcacctggcaccacatttcggccaccaagccgcattatcaagctcaagcaccattcgtccacgcgtcgcgcccacctcgcccgagattacaccaccttcgctcggncgcctcggcctcccgtatagctgttttacttatggggtaagcacaaacccatttgggacccaagctaccgactgtggggactacgtgatcgtggacaaattgcgcgcatttacatacgacaggcaaaaaagcggtgggcagnaattgtattatcgtcataacacagacccggnaggtctcaaagcaaatnagcaatgggtggcctggattgggnaaagnctggggtggggcgggagggtcctaacgcaagggcagtcaggngggg

SEQ ID NO: 94017 - DNA, 548 bp, Triticum aestivum
  unsure (1)..(548): unsure at all n locations
  Clone ID: PAT_TA_94017
cccggggtggcaaggaatttcngcaacaagcaaggattctctgcaaagggccgggcgagggaaancttcanccctcnccgccangggaacgggnaangtntgcctcgtccgcaccgattngcgaagaccgacacgcagcactgggnttaaaggganaatgaagtacancaccaagggtgaagggntganggaaaggcttacccctgccatggggaactcgtcaaacaaaaggcaagcgggagagggtctcnaagcaactcccctccgggcaatcccacccttgttctttctggacccaaggtaacaaatccaaaaacaacccttgggnngaaatncgggtcccttttggtcccgaagaagcaaaggaacgttcggggggcanagnctaaccggcttgcaatcaaggatggtgggnaccaancaatcctaacnttngaacnttgtttggcgctccaatgggnggacaagggaccnaatgggngggtgtggcgcaaatggggaaccnacccctcaantcttgttggggangtgggacttgagggggcgaa

SEQ ID NO: 94018 - DNA, 340 bp, Triticum aestivum
  unsure (1)..(340): unsure at all n locations
  Clone ID: PAT_TA_94018
cccctggcaagatacncaaaantttgnaatcnttcaataaccanaanaacaatctgnaggnggttgcgccanacanggaaaanggcgggctgnctgaatcncgggccttatacaacgnggntgnggtnacctcaaattggtaagaaatccaaggagnaattctcaacgcaagtgaanaaagtgtttgtggggaaaacanggggggacgcaatgnactggggcaaaaaagttcttccngggtggaaaacggcctcccnatgttgggggggntcaantaccnaagtcccgttttttattttcangaacanccccntggggntnaaaaaaaattggngtgggc

SEQ ID NO: 94019 - DNA, 261 bp, Triticum aestivum
  unsure (1)..(261): unsure at all n locations
  Clone ID: PAT_TA_94019
tccctccttcctcctcgntcggcaacangggctccgncctaaaangctcgctgntgnttgntcccctcctccancggacctttgnttcttctccaacccgacttccttctcttgggtgnttatccggncgtcggcggcgactggntccaagatctggcgcaaagttaggcgagccctgtggtggcgtgaaagggcangggaggcgggcgacgaagacaagcaactgtccngcccgtcgngggtgagggtacaagggaaaaa

SEQ ID NO: 94020 - DNA, 267 bp, Triticum aestivum
  unsure (1)..(267): unsure at all n locations
  Clone ID: PAT_TA_94020
aacgagggaaacacanagcaaagaaagagaagagagaagcaangcttgtgatngggcaaaccatggngtccatgaccggnctgtcgcaanggtggtgggtctcccangcccggccggcangcgcgccaanaagttcaatctctgagggcgtcctcggcggnggcggagggcgccgggcgccggcgcggtccttggtnctcaatgggcagnnggangtcttcgggaagcnngttcgcttcanggtggggggnacgcncgggaaccgtc

SEQ ID NO: 94021 - DNA, 643 bp, Triticum aestivum
  unsure (1)..(643): unsure at all n locations
  Clone ID: PAT_TA_94021
ggccgctctaaaaactaagtgggttcccccggggctgcaaggctccgttgccgaanttcggnaacgaggcccagtccggaccggngggcgaaacgcaaancggcgggccgaccgcatcataatatacgtcgcctccggcntcaacccaacnggggtccggccgcccccgctccgtcatcgtcggtcgtcgtcgttcgggaaccgtcaccctcccgcctgctgctcaagggaagcggcgctctaatggggcaacaacgcaagccggcaagtccccgcgctagggnctcactaaagcccaaccgtcgtccgaggccactccaaggtctctttcgccggccatagggcattccaagccatccggatttggggangggaagatntgctgggccgttcgcgggtcaacgggagaaaaggacgtgttgcaagaagncccaagggctccaagctttcgaggaaacgccggtcnttgnaagcgggntgggacangccaagctcgggggggccttgctnttcggtagggcctccgncggtaggaaggaactttctccngggnaaaagcccgggtcaaatttgggngggnccttccgcctnccaagggggnaaggggctttnaaagcggtctggggncctnatttggccttgg

SEQ ID NO: 94022 - DNA, 560 bp, Triticum aestivum
  unsure (1)..(560): unsure at all n locations
  Clone ID: PAT_TA_94022
gggcgcctaaacagggtccccgggctgnaagccgtgccgaattcggcacgagcaacaaatggggttcctctatgttcagttcagagcgacagcatactactttatacttcccacccttggntatattgttatcaaaggaatgttcattgcattcggtcaaaactcagccaccgttcaggccgttggattgctgctgattgaggccatcactttgntagcagcaagtgttatccgaccatggatggataagagcattaatagttttaatgttgctatcgccgcagtaaactttttgaatacgatcttcttattgatcttcactgatattttcaaccagcccggtatagtgactggagtcatgggggntattttcttcatttataaaggntggnttttctctcgccctactgatcttaagttctgantgcaactggggtacgcgntttctcgcangaatccaagatagtcngataccaagccaatgagtgacgnccgagcatcctttcgttaagtcaaaaactcaagttgaccgacgggattgggtggcccctggnggggaa

SEQ ID NO: 94023 - DNA, 166 bp, Triticum aestivum
  unsure (1)..(166): unsure at all n locations
  Clone ID: PAT_TA_94023
cctccaacttaaccgcangctggtncaactncggcccgggggtcctcctccgnggctttccccggctccggctncggcggcccctcccctngccggcccggangttctnctcctccgncggcggctntnccgggccgggaaaaaacgcgggaggggangaaggcta

SEQ ID NO: 94024 - DNA, 567 bp, Triticum aestivum
  unsure (1)..(567): unsure at all n locations
  Clone ID: PAT_TA_94024
gctgnaagaattcgggacgagggaagtccaggacaaggagggcatccccccggaccaagcaagcgtctcatcttcgctgggtaagcaagcttgaggatggccgcaccctggcggactataacatccagaaggagtccaccccttcanctggtgctcaggctcaggggtgggatgcacatttttgtgaagacctcaccggcaagaccatcacacttgaggtcgaggtcctcgggacacaattgncantgtgaagggctaagntccaaggacaaggaangcatccctccggaccaagcaaacgtctcatctttgctggcaagcaagcctggagggatggccgcacccctgggctgactacaacatccaagaaggagtncaccctccacctggtggctccgccttcgtgggggnatgcaaaatcctttgtcaagaccctcaccgggcaagaccatcacccttggnggttggggncctctgnccaccatcgnaaatgttgnagggcgaaaattccaagcgacaagggnggggnnttccccccgggccaagcangncgccctgntctttctg

SEQ ID NO: 94025 - DNA, 477 bp, Triticum aestivum
  unsure (1)..(477): unsure at all n locations
  Clone ID: PAT_TA_94025
cancgctccccatctcgatctaaagccgagggnttcgtccanctccgtcgccgcgacccaagccagagncagncccaccccagccagccagccatgccgnagaacaanggtaagggaggnaagaaccgcaagaggggnaagaacgaggncggcgacganaagcgcgagctggtgttcaangagggcgggcaggagtacgcncangtgacgcggatgctnggcaacgggcgntgcgagggcatctgcgtccacgggancaaangcctctnnccanatccgggggaagatncacaanaaggtcttggtttgcccgncggggncatcntctnntcggnctccgcgnctancaagaaagacaagggccggcgtcntcctcaagtnaatgaacgaacnaggggncgccctggcntaaagnnctangggggnggtntcccgcnaaagcttccnncttcaatnaaggggggnctancctccaac

SEQ ID NO: 94026 - DNA, 574 bp, Triticum aestivum
  unsure (1)..(574): unsure at all n locations
  Clone ID: PAT_TA_94026
ttgttntattggcacatcacctgaggaagnaacngaaatgccacgcccacaacgatatacatcgacangagatacattaatagaaattgcacgcacgtcggccccggtagcggtggccggcccttgatgccctccctctaaccgtgcggctgacaaagttacgacagtagcttgtcgtcgcggacggngacgaccctgcgggacacggtgttgatggaggcacgaggggagatgttgagcttgggcctantcctctcgatggcaaactgctccncaccgttggcgtcctggttcctcaagcttccctttgcactgactttccggattaancttgtggctctgaaaagagntgggaatgggctccggnggaagctttaaagacaaccgacttgctccgttgaaggatagaanaacttgcttcccgggttcttctttttctgcaaagggacttttccctcaagnctaaataanttggtaacacccgggcntaatattttaatttcaagttctctaaaaaaaaancttggggagggnaataggnanaaaaatncaangnaatnataaaggntnatgg

SEQ ID NO: 94027 - DNA, 260 bp, Triticum aestivum
  unsure (1)..(260): unsure at all n locations
  Clone ID: PAT_TA_94027
cttngattaacgggtttgggcctggttaatcaatcctagtgntcctgagttctttgccgaccggaccaaaacaatgggcgggggngccgtcntgaacaacgtccggcggnaagggactancctggcaggntcancctcttcgtcctcttcanctgcgtcngcnccgccancgggcggggctcancttccgggtatgnnatcggnatctcanggggggggggangnccaatgaaacctttccctgnaaaaagttcttcccc

SEQ ID NO: 94028 - DNA, 281 bp, Triticum aestivum
  unsure (1)..(281): unsure at all n locations
  Clone ID: PAT_TA_94028
ggnttgtcttancgagacgnccgtccccancccgtctcgtcgggggggatggattcggngtccgccncggggggggggtcggnttnctcccccgcgggggggcgggccgggggngggaaagangaaaaactggncgatttgntggggggcatcgatcangnnctctcccgctaanccgatnggctccccttcganctcnnaacggcagaaagttcnctcgcttancaaacntggtggaantgncaancaaaaaatntttttgtctggggaaatgtntggta

SEQ ID NO: 94029 - DNA, 564 bp, Triticum aestivum
  unsure (1)..(564): unsure at all n locations
  Clone ID: PAT_TA_94029
gtcntggccgctcctggcgaattcgggaaganggcgccggcggcgcctcctcttnggattggcggtgctgggagancaaaanagcgcggntnccgagcaaaccctancctcccacnatggtgctgcaaaaagacatcgacctgctgaacccgccggcggngctcgagaagctcaagcacaagaagaagcgcctcgtccaancccccaattccttcttcatggacgncaagtggcangggntggttcaacatcactactgtgntcanccantcaaanactgntgnggngtggccaagctgggcaaanantgggtctnncaaacaaacngggtggggaagggcaagctnanacnagggggtggntccttcccnccgcaaaggggggactanaaaccgaangggtnntttaaaaaannaaagntggnttggtnaaacncccgttnggtttttnnaagggggggtggggccngggaaaattttngaaatgtncggggaaatttgnanccnaacctttgggaaaatttgggnacccancccccgggaanattttnttntaaatgggtct

SEQ ID NO: 94030 - DNA, 516 bp, Triticum aestivum
  unsure (1)..(516): unsure at all n locations
  Clone ID: PAT_TA_94030
ctcgtgccgaattcggcacgagccgatgcctcctaaaccatttaacccgccgcgtccgagtaactcggtcgcatctaccccagtcagagttggcgattcggggaaggaacgcgcttctagaatcaataaactgacgcctgctagtggcagctcgaggagccagaagatgaaggcaagctccagtaaaggcattaagaagaaacctcgaataagtgcagccagtcttgctcggctacctagtcttagtccgggaacgagcgatgatggagattctggccctgacctgaatccggaagaggaactcggngaggaagaaggcgacgacatctttancgaagttatcgagacgtcaacgcgatctaggattcatgatagtagtcgctcgacacgcacacgtgtgacaagttacaacgaacgcgacttnccgcgggaaaggattggacaagaagtttgtcattccaaagcgatntcacgtcagtaatggctgnatgaaatgtttaaaaaaaggnggtgtgg

SEQ ID NO: 94031 - DNA, 582 bp, Triticum aestivum
  unsure (1)..(582): unsure at all n locations
  Clone ID: PAT_TA_94031
ggcgcctaaacagggtccccgggctgcaggaatcggcacgagccgtgccgaatcggcacgaggagagaactaatctcgagtttttttttgtactttggcttgctcttccaagtcactgggaggcgctcaggtagtcttcaagatccttcattcaaccggtcttttcccgttatttctccggaactgggcgctactgctgcaaatcttaagattcaaggctgaagcggtaatcgacaagacaaactaatctacaggtcttttctgcaaccccgtaccccatataatctagggactaaaaaaaatcagattaatggnatagctatggtacggatactctaagtcttaaatgagggacaatgaagcgctacgaaaatcatgtatcgcacgcaacgggattgattctctaaaaattgtacaaatcaggtagtgctaaaacgaaatgttaagtgactccgtggggaagcctcgtgagaatgccgtgaacgggagctggattaaananaaaaaacaatgtatcctggatatgggttataagaacgaaaaggacttatgcaatactggtatcccttcacaatatggttt

SEQ ID NO: 94032 - DNA, 337 bp, Triticum aestivum
  unsure (1)..(337): unsure at all n locations
  Clone ID: PAT_TA_94032
ntttttttttttttttttcgaggganattgntttaactatgaatgtattttcgatgcgtaatgtacggntccttgaacccgatttctacagngngtacttttctccntcgggattactcagcagtaaccgttcacaaaactgnntctcacattacacccgtgtctgtgggntcaagngttgcactaccaaaaaataattaacanccttgantccattccgtccagctctgccagagagttgnttattcccactcgnnaacatanganacntggtgnangaantacatataaaacngnttttgggnngcaaanttgggnngggtnccantaaaaatcc

SEQ ID NO: 94033 - DNA, 443 bp, Triticum aestivum
  unsure (1)..(443): unsure at all n locations
  Clone ID: PAT_TA_94033
agtgggtttccccgggntggcaaggtccgnggccaattccgcaacgaaggtggnaggaacaaaactngaggcaaaagttacgntagctngataannttggtgnggtcaaggggttccaaactccaanctgtnagggcaatgggaatggcttgggttggcctccttnctccctctcctcgggcgcgtatggggcaaatggtcggccgtcaatctntnncgagggngntgcccgacgntgcaagctgntcgtgcgcgccaccangatcaangggtctcctcccctgagcgnccgaatggggggnggtccctcctcaggntccacttccaagaactgggtttgttcaagggtgtgacgggggccaatctctntggggtgncgtggggtaagnntcctgggcggagaaaaaagggncggcccnnaacaaaaaantcnttgtgggggg

SEQ ID NO: 94034 - DNA, 284 bp, Triticum aestivum
  Clone ID: PAT_TA_94034
ctcgtgccgaattcggcacgagtggcaatccattttaatgacttttatcaagaattctaatttcaagccaactactagctgtgcccaaaatgtaagcacctgaaatttttactttaacgcgattcaccaagttgtgaaacgcaatactctatgcttcgttcagtaagcatactcgagagctttagcgccaaattcctacgacccaaggctggggaaggcgctcgtatcattggtgttgatagaagcattggtttccggattaccttggccatttccgggggggg

SEQ ID NO: 94035 - DNA, 454 bp, Triticum aestivum
  unsure (1)..(454): unsure at all n locations
  Clone ID: PAT_TA_94035
gtacgttctccccaagcanctggacgagaaggncgcgggcctccacttgggcaagctcggcgncaggctgaccaagctcancaagtcccantctgactacattaanancccaattgagggnccttacaaacctgcgggttancggtactaatgtgtccancaatgaactaacgggtggcctgagcctgagtcngggcaacnggaccaacgggaactctatcaactaacctggttcccttctattancttanangcagnctcntaagcggnggatttgttattaagggtatgttttgagccntcttaaggttgggaaaagcgggcttttgtttttntcncacaaataanggnaaataataattgggttaagtgaggaggggggggnttttcaanaaanaantttgttcncgttgnttcctcncgccggaantctncaacgaancgggacgaaaag

SEQ ID NO: 94036 - DNA, 229 bp, Triticum aestivum
  unsure (1)..(229): unsure at all n locations
  Clone ID: PAT_TA_94036
cggcgctccngtnaccaccaaaacaacacnagctcttgtgnggaggaggagatgtctcgcaacttctccgccgcgnggcgcctctcnataacgtatagcgcgggaagagaggngggggattagacgggcgctccgcgcaatggcagaaaaatttaanccgggcgggtgngtttcctcctgtgccgccgccgcgntctgggnccacantctnncaaaagncnanactgtg

SEQ ID NO: 94037 - DNA, 485 bp, Triticum aestivum
  unsure (1)..(485): unsure at all n locations
  Clone ID: PAT_TA_94037
ctcntgccgaattcngcacgaggggaaatacaagggncnaccttcatatgataggnaaagttcacaataacatttgcaatttttgtggnaaaaatagacagaatgtgcagcacttgttattacactgtccaaaattcaaagatcaaaggaacaaatgcttcaagggcatanagccaaggncacttccnaccttgttttgttcaaaaagagggaaggnagcattattaacatatttgggtacatccaagtgcatggcancacataaagggaggtaaattaggncaaataattgggaaatgcnaaatttggnatgagagggnagtgntttataaggaggggaagggcnngatccatgtattttaaatttgncncagccngatanctgnatacaccatgacnttaaaaaaaaanaaaaaaaaacanggnccattgggacaaattcttatcngaaaggggatgccaaantcantanttaaggnaatggg

SEQ ID NO: 94038 - DNA, 335 bp, Triticum aestivum
  unsure (1)..(335): unsure at all n locations
  Clone ID: PAT_TA_94038
gtcccctccaaattggaatcctcaanaacatgcactccaatcgcttggtcaactctcttggnctttggntcgtanctaacaananctgtggnggaatgttatcnaagactacaactggtgcccaagatatgggcaatatcancggccgggtgttagagcancccaccaaaggggcatctcccgcataaataatccgagtacanataacaaattttccgattnatattcaatacagnggnaatattanccccacagctnatcccgcctattattgggatgtgncgcaattgncaaantcccaaggggccggnggggatgaaagtaannanttggtg

SEQ ID NO: 94039 - DNA, 320 bp, Triticum aestivum
  unsure (1)..(320): unsure at all n locations
  Clone ID: PAT_TA_94039
gntcgtgccgctcgtgccgaattcggnacgagtgaaaaaacatcnatctaataaaggnccgaagaaagttataaaaaacaaagtatggntgcggnttatttggcgtgcctttgtgggtaccttgggagaagcanacataaaggtgnttcanggngactctatctcggaaaagaataatcnaaatccgtatgaagatgaattatgactttggntatanatataaaattgatccataaagaaacggggcgcaangcgcacgcattaagttgattatactattgtntttaaaataaagaataaaacgtcacgattcantatcc

SEQ ID NO: 94040 - DNA, 462 bp, Triticum aestivum
  unsure (1)..(462): unsure at all n locations
  Clone ID: PAT_TA_94040
ctcgtgccgaanttcggcacgagaacggcgtcgcttaatcnggaagccgccgncagggagggaagagaacggagcgaggaggcatgggcgcccggaacttcttcggtccgattccccaaggaggaggaatccaagcggcgccatccgagaggctgtcctgttgggagggaaaaacgccgccattgctggcancgtggtcgcgggtcccacnttcggntgcttgccgtgtccttccttgggctaaagcacaanctggactancaccgcggcaaagcgntcancatatcganaagcctggtgtcgcccgggttcttcancaancgccggataaaaccattcngngaaacgnaaaggcaaaaacaacaancngngagggatcgncggagccactttnntcaaggantgnncaaaaatccncagggccccctggttccaactatnantccaaggggngggngctgg

SEQ ID NO: 94041 - DNA, 611 bp, Triticum aestivum
  unsure (1)..(611): unsure at all n locations
  Clone ID: PAT_TA_94041
ggccgctcctaanaactaatngggttccccgggggctgcaaaggaattcnggcaacnagggccgtccgttaccttgaatgccgcccgctgggaagcaacgggcgacaaaggagggatgacaaaggatgcaaccgcgcccgaaaggtccgcgaagagacgcataaaactaactcctgggngncttcacattttggaaggactcggttataacctttttgagaagtgtataatccgaaacccctcctgctgctaagtancaaacctcctagttttaagtcgcttgacattacgaagccgggcgaaagctccgtggttgttcgggttggttttgtggtgctgtcctgaaatcaanctanaaaanaaantgtccttttttccctttccttttgttttttaatttccttttgggtttaaaaccaaaatgaaaacaatggaaagcttgtgtttcaaaaaaaaaaaaaaaaaaaaaaaactcngaggggggggggcccgggtaccccaaanttcgcccctaaaagnggagtccgtaattancccgcgcctcantngggccgtcggttttaaaaacggtcgtggactggggaaaaaccctgggnggtttaacccnaacc

SEQ ID NO: 94042 - DNA, 199 bp, Triticum aestivum
  unsure (1)..(199): unsure at all n locations
  Clone ID: PAT_TA_94042
gtaggntgccagctctcaaagactcgctcgaatcaacanctaagcaagctcnnatcaacancaatggggtctgncggncgccntcccacggagntcangcanatngctctcttcttcctnggcngcgggggtcatcaaaaaaanatccgtctgccttggttgccccgccggcgacgccacttgcaggntctgggggttt

SEQ ID NO: 94043 - DNA, 528 bp, Triticum aestivum
  unsure (1)..(528): unsure at all n locations
  Clone ID: PAT_TA_94043
gggnggnggggcgctcctaanaactaagtgggatcccccggggctggcaggaattccggnacgaaggatttatttcaancaaggctggtaagctacnaaggttatatngggcaagnaaaggcctcccaattgggggcggctttaaaatnatncccccanccttgctcgcccggggcaatcaaaaatggggntaaatgtccccgcaaaggganctggctggatgctantccnggggcatcaccgaaagcaatttagattgggcaattcaaaaagagaaaaataaaacctccggnggtcgggngcgtacccgtggtggnttaatgggnaaggccnaatccgtccttaattcccgttccgangcaagcaanaaaaatcncaaatggnggnnctcctggncntcaaataaaagaaanactccaggggagtcacaagggnctacccgcgtttttcccaaaancaacaagcctaactttttgcctttttgggggnaaaaantctnaatggtccaancaggggttnaaaggggga

SEQ ID NO: 94044 - DNA, 513 bp, Triticum aestivum
  unsure (1)..(513): unsure at all n locations
  Clone ID: PAT_TA_94044
ntcctatggaaagctggcagcacaacanggacaattaatgttcanatgaagcanatggnagaagatgatgaaaaagatgctgtattctttcgtttggaagcgctgggatatcgtgtcggtcaggggcttgtcnagagattctcgagggaaaggcagcgttttattgacactcttgatgttataaaatttatctgcaaagacctgtggcaactacttttcaagaaacaacttgacaatctcaagaccaaccatcgaggngtntacgtccttacagaccactcntttagaccatttgcgcgtatgagtacanaagctggggggcaggctggtatacgcgctcanccaaaactatggggttcccngcgggnaatatacgcggngnattancaaatatggggtatccgatgnaaaccgttcaagcaaagaccaagcggagctaccccggggnaaatatttcnnattaaaangtnancaccaaanttttagaaacncaaaacctaaaccccgccttta

SEQ ID NO: 94045 - DNA, 570 bp, Triticum aestivum
  unsure (1)..(570): unsure at all n locations
  Clone ID: PAT_TA_94045
tggccgaattncggaaagagggcccgtccgtccctccaaggggtcaactcctctcaatccaaaaaaaatcggntggggggagcancantagcanncgggagaaagcagttcccctccccaagnaagctaagcaacanncgggcggggcccggcgcttntncaacctcctnccctctccccgntccgtcattaacaagggagggagatgtgctcnttggaggcgaancgggcggagctggggctgggcggtggctgttcctnnacaaggggggggntcgnggacaagatttgcangggcatccaagtacggggtccaagttcatcaagcaaacggggcangcccgggnaaccgcgcaaaaaangtcnaacaaagtccaacanctttgggtncgcnaaggggcttnaaaggctcctcaaagtggggtgggancgaccntggatgggtctcnatcaagncccaggcccccaaaagggggaacccctccnccccggntgggcccntggctntggggaaaggccaaagaaaaggnggntgggtggtcgnaactttcctnggtncctggngccaaa

SEQ ID NO: 94046 - DNA, 523 bp, Triticum aestivum
  unsure (1)..(523): unsure at all n locations
  Clone ID: PAT_TA_94046
ccgacaacccaaatattttattaaattataatcaattgactaatgcctcataaacataaacgcagagaggaattagataaatcgctcacggatctacctccaacacagttcgccaaccctttancagcctataatcctacaagagggannactaccaccacatcagctgttgntaagtcaaggaaacctagcaagaaacgaaaacgaaaccataacaatcaagatgatacgccaaaacttttcgtctcgctcctanaatttcatgaaaggaaagaaattaccgcttggcctcnnccatggttttataacgaagaagaacgctaaagcttcttcacaggganaagcgaagcctgantccaaagtcacaanaaagctctgaaggtccngtcantcgatccgggganaagctatcgggcanttattgctcgngtagatgccgcantacctgtgaggcgggntnnttaaacaaatcantcaaggaggaggggagnggcccccccngggntgnagggctaaacntang

SEQ ID NO: 94047 - DNA, 464 bp, Triticum aestivum
  unsure (1)..(464): unsure at all n locations
  Clone ID: PAT_TA_94047
ccctccctttttgcaagctgtcaccggcggcggntactctactctccccgcatggcgtcgcctcctccgccgggtcccgccgccgcggncgcccacagcgtgttcgtctacggcaccctgatggcggaggaggtcgtgcgcgtcctcctcggncgcgtcccgccgtcctcccccgcgctcctccccaaccaccagaggctcagcatcaggggccgcgtctacccggcgatcctgcccgtcgacggcagcaaagtccccgggaangtttggaaggggatnactgacagggagctcgatgtgctggacatctttgaggatgaggagtatgtcagggaaactgttggnatcttgctgaacgattcggcgggacacgatggtcgccctacgcatacatatgggggaatgtggatgatcctgacctctatggtgaatgggattttgangaatgggnagaaagtgcatct

SEQ ID NO: 94048 - DNA, 469 bp, Triticum aestivum
  unsure (1)..(469): unsure at all n locations
  Clone ID: PAT_TA_94048
ctcggaactaattgagtcattatttggacttagttcctcaccgtcttctgaaattttttctttgtcatctaaacggataaagtagagtccagtaatttgatccttgtgacttctgagtttgtataggnctacttcagcgatcacgtcccaaacaatcacatctgtatcttttgagccgcttgcaagtcgaaatcccgaactgtcaaactgtaatgaggtgatagcagagcggtggncattaaagacgacaatcactttcgagattttagagtcccaaattctgatacttccgtcttcgtaaccaacagcaaatacatcttggggcgcttttactcgaagcgattacagtaanccntgagttattaacttcaactttccaacgactcaagagctctcctttcttaatggcccaagcagaaaacttcttcaattgcaagcaagttatangcggcggncaaatccccgtagg

SEQ ID NO: 94049 - DNA, 482 bp, Triticum aestivum
  unsure (1)..(482): unsure at all n locations
  Clone ID: PAT_TA_94049
ctcgtgccgaattcggcacgaggctagctgccgcctccttctttgtgtggggtcggcgtcnatttgctgaggtgcgcgaagattgggaggatgagttcggcccacaccggttcgcatataaagatctatttcgtgccactgatggattcaagaatggaaatttactcggtgccggagggtttggcaaagtatacaaaggggtacttcctggatccaatttggaaatcgcggggaagagagtatcacatgactcaagacaaggtataagagagttcattgctgaagtggtgaccattggtcgtctccgccacaggaatctggcacagttacaaggctattgccggcgcantggtgaaacntctcttggggcatgactacatggaaaaatgnggangccctgacaaagtacntgtnnaataacaaatggggcccaactttgggattnggccccaaangataattggntnantcaaaggggntgt

SEQ ID NO: 94050 - DNA, 333 bp, Triticum aestivum
  unsure (1)..(333): unsure at all n locations
  Clone ID: PAT_TA_94050
ctcgtgccgaattcngtacgaactcgtgccgaattcgntacganttgttgggaancancggtgtctgccgtttnncganaaggcacgctatngggngcagaaacccctggtgctggttcannnggacctctgcggcccaatnacccccgcaangccaggagggcgncgctacatcntgctgctcntcgacgactaaaacaggntcatnagggtgctgctcctcncctccaacgacgangcggngcaagncattgtnaatgcaagcaagcggcancaaaaagtccantgcggccacaaanatgggtggtggttgncnaaccncccattggtcgg

SEQ ID NO: 94051 - DNA, 202 bp, Triticum aestivum
  unsure (1)..(202): unsure at all n locations
  Clone ID: PAT_TA_94051
agcaagantactgcaacccgtatcaagctggnttaacttttgtgatgatggncttctggggacaaaggctgtgntgcggccaaggggnattgatttntaanatgggccccnatttgntgctcnatgtgnaaaantccaangaaaaaatgttggtattcctntctgtgaanggggtgcaacntcaaaatcaccttgntatgca

SEQ ID NO: 94052 - DNA, 403 bp, Triticum aestivum
  unsure (1)..(403): unsure at all n locations
  Clone ID: PAT_TA_94052
atcttgtcgacacaacncattcttggagtatgtcgntctttgctccttcgntnttcttctacnttaacaggnactgccgnctggttgnnatttgccagcacacangccccaangatttcaacaagttgagcagcngcagtcgttagcaganagtaatcattatccaaaggaccantcagaacngaaaatccgttgggagtttanctcancctgcccagcaaatttggngctcctgggcactggntagacctggtaggaacatcatanacagtgtacagtancatgccgcatngcgcatccatatacggtacgagatctctgnncattgcttatnttgtaaaacgccatttctggaggnggnctgtatnggttaagtggggannatgtttgtgggnacaaattt

SEQ ID NO: 94053 - DNA, 478 bp, Triticum aestivum
  unsure (1)..(478): unsure at all n locations
  Clone ID: PAT_TA_94053
tgtagttgttattgtagcgacagttcgtgcgctcaaggttcatggaggcggccccccgattgtaccgggtgcggccctcaataaagtctatgctcaagagaatgtcgaaattcttcgcacaggttgtgtcaatctcagaaaacacattagtaacgccaaaatctacggtgtcccagtagttgtcgctattaacaaattcgagactgataccgatgccgaaatccaggttattaagagaggaatcaatancaagccggtgccgaggatgcaattcctgctaaccactgggctgagggtgggaaaaggcgcgattgaattgtccaaaggcataattgcccgcatgtgagaaagaaaaagactttaaattactgtacaagtcctgatggcaagtgttcaatcccncatttgaaagctataaggcaaaaaaatgttacgggcggccgcngagcggttgaattcaatgagattgctcaaaaaa

SEQ ID NO: 94054 - DNA, 462 bp, Triticum aestivum
  unsure (1)..(462): unsure at all n locations
  Clone ID: PAT_TA_94054
cgttcccaccgggctctccatccagaacctcaccgaaatactctctgtcaagacatcacggncggaaacagatctccgtctatcctacgccgggaaacacctatcanccctacactctttgtccacctacaatattagacgggaaagcttacttcaccttacatctcctatccggggcgggatgncgcccaaaaagatccgctgttcctttaaagattgcagagatggcgtgcagcggattgttggtgactgcgggttttgctccggccatttctgtggtaaacaccgtctattanaggaccacaaatgcnaaggacttgaagattgttnaaaacaatctcacgaacgggacgctgcacaagcttcatgcagagagaactcacgctatcaaggggggatngcaatctaatattaagtcgaatatcgttgaaattaatggggcaaatcngcgttgggtgggca

SEQ ID NO: 94055 - DNA, 214 bp, Triticum aestivum
  unsure (1)..(214): unsure at all n locations
  Clone ID: PAT_TA_94055
nctcgtgccgaattcggcacgagtcgacgtgaacggngacggccggatnancaaggncgagctccggcaggccatccgccgccggggctgctggttcgccaccgttagggccggccgcgccgtccgccgcgccgacagggaccacaacggntatgtcgacgacgccgagctcgagaacctcgtcgctttcgcgcgggaacacctcggcatgaac

SEQ ID NO: 94056 - DNA, 463 bp, Triticum aestivum
  unsure (1)..(463): unsure at all n locations
  Clone ID: PAT_TA_94056
cttggatcaaggcacatcaaatgatattcaagtcgccagccgatattttgagcttgcaacaagatatggacatatcgaagcattctacttcttagctgaacttatggagaaaggaattggacgagataggaactgtgggctagcagctgcatactataagagtgttgccgagaaggtggagcctcttctctcctctttcactgaagcaaattctgcatatgataatggccatgtcgaacttgccttgatcgactacttgcatgcggcagaacaaggatgggaaaaagcacaagctaatgttgcgtatcttctcgatgaacaaaggncacttcttaagttaccaacatggntctcaattaccaacccacggcctgaagtaatgaaaaatggaggcctagcactgacacattgggncgagatcagccaggcaatccaacatcgactccttagtaaaaatgggagn

SEQ ID NO: 94057 - DNA, 347 bp, Triticum aestivum
  unsure (1)..(347): unsure at all n locations
  Clone ID: PAT_TA_94057
gggctgcangcaacaatgcaacgaaaaaatactctgctttgtgtcaangaattcatggntacgttcgcgacgtcgtcttcngnggtgatgtggtcggctccccctgggcaagtggcaagggctcngccgtgcgtggtggcgcgtgcctccncggcgatggcggnaacngggggggtggccacaagnaagacgcactaccangtgctccggctgggcgccngggccancaanggcgnanattaaggccgcctaccggggccttgccaaggaagtgnaccctgacgccntccggangtggcggggaaaanggggtnatccggctggaaactggntaaaccaaactcgcc

SEQ ID NO: 94058 - DNA, 506 bp, Triticum aestivum
  unsure (1)..(506): unsure at all n locations
  Clone ID: PAT_TA_94058
cccgttggttctacttggcgtcagcacggnacctaccttccaagttcatccaccatgggcgactcctcatcctcggnttcctacatcanaatggtacaccatctgatagagaagtgcatttgcttcaacctcaacaaggaggggtgcatggaggccctggagaagcatgccaagatcaacccggtcgtcactgccactgtgtggaaagagctggngaaggagaacaaggagttcttcgagtcttacaacagggaccgcgtggagcggaacatccaggcggngacgatggagcggatccagaanatgctctccgacgcgggtgcctccaaagacctccgacnacgacgaggggctagacgaaggntggcngcttatgtccaaagctcatgcgncatgnatcacccccngctaaattantttntgnaanatcaangncctccctttaattggggttccaattatgtccaaggnggggtncgnaattttttaattgcaccctnacctca

SEQ ID NO: 94059 - DNA, 403 bp, Triticum aestivum
  unsure (1)..(403): unsure at all n locations
  Clone ID: PAT_TA_94059
caaaaactttggtttcaanacctggggntantgncaaanatnttgacttgggcaagccaatctanttccaaaccgntnagaangggnatttnacaaaacaanccttnnactgggngaagcccaaaacanncanattttataatccctttnaancttaggaggggaagngcaggactcaaacntccccccacagtaggataagtagacgccaaatgttttccntggntcatgaaaaagcgaaacgaataaggagaaaatgtgttgtatcggtctcanccacctannggttcaantggagntaagtgtccgtctcacaacggtagatggggtttatttacaaaaaaaaatcccttttantggtaaatcccttaaataaattaataagtggggngnaagctccctc

SEQ ID NO: 94060 - DNA, 569 bp, Triticum aestivum
  unsure (1)..(569): unsure at all n locations
  Clone ID: PAT_TA_94060
ttttttttttttggttgtagattatgtacatatatattagtcctatctacaggacctagagtatcttggnataattatctttcaacttgtctcaaattcttagtgtccgattatcttattctgctcagtcgctgttatccctagcttatacaccattctatatctgctcatagcctagtcataacaggctatgagcccgggctcttccactgcggcacttcgtaagactcagtaataatcgaaaagaatataggaaatggaagcagacacgtgctaggagaggaggtttcattttccaaatggaaagagcagtcttcaagcaaagcttgcaaagcgaaacctactcggacacgtatttcacaatattgaaagaagattgagctangtcctcactcctgaagcaccaactggctcaagaagtgctgagcntacaactcaacaagtaccgggagtttattggaaaaggggtccgacccaaaaagaagcantgtgggaagatacgtgaaatccaaggccagaaaaacaaatcataataccgaccttagcangangcttgtggcccncggacc

SEQ ID NO: 94061 - DNA, 533 bp, Triticum aestivum
  unsure (1)..(533): unsure at all n locations
  Clone ID: PAT_TA_94061
ctcgtgccgaattcggcacgagagcaagctatatacctacatagtacagccatggcccccaccgtgatggcctcgtcgggcacctccgtcgctcctttccaggggctcaagtccaccgccggnctccccgtcagccgccgctccaacggngctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatgggcggtactgggacaatgtggaagctggctatgttcgggtgcaccgacgccacacaaagtgattaaccaaggtggagggaggtcaaagaangagttaccctgacnccgtnngttccgcatcaatcnggtttcnacaacaatccgccaaggtgga

SEQ ID NO: 94062 - DNA, 580 bp, Triticum aestivum
  unsure (1)..(580): unsure at all n locations
  Clone ID: PAT_TA_94062
aaaaaacttggggatcttgggaaaaacccctttatgagggtngcaatncncccanaaaaanntaanaacgcgggtnctacccttgngatatctgatgantttgttgttctgaaggaccnctatcccaaggccaaaaggcatgtgttgggggatatctaggacagatggncttgnttctctagcanatgtcaagaaagtgcacttaccactgcttaggggnttgcattcanctgggctgaagtgggcacataagttccnanaggaagacgcatctcngnccgttcaagnttggggtaacaatcggttccgtccaagcgggaagttgcacctccatgtcataaagccaaggatttcaactcaccccagccttgaaaaacaaagaagcaactgggaactccctcaccaagtggaaattttccctggnttccngttgaagggcnanggggcgancgtttgaccaaacaangggntntggggactatcaaacccctgganngaggaaagccttccccnccaatggggggcctaaggggggccanaaaaattccanggngngcccaccccaatnttcccaaagcnn

SEQ ID NO: 94063 - DNA, 236 bp, Triticum aestivum
  unsure (1)..(236): unsure at all n locations
  Clone ID: PAT_TA_94063
cttccttccttntccccccctcccctcccgtgcttntctccaacccgcccccgcgccaaanncgaaacctacanccgcgcgcgcgangggncgccccgatntgnnagatgtggtgcaaccgcgtgtcgcggggnctccggganggcaanggcgccgccgccnncgcggtccaagcgcttntccaacaanctcgtcctaaaagggggggggttacacctaacataccngtcctggct

SEQ ID NO: 94064 - DNA, 273 bp, Triticum aestivum
  unsure (1)..(273): unsure at all n locations
  Clone ID: PAT_TA_94064
ctcgtgccgaattcggcacgagcacaaccacaccacggaatgcacacaacacatccatggncggcgcgggtgtggagcggggatgcagcgcgggcanggagcaagaggcagcgcgggcgacgagcatggccgtactcgtgggcnaagaagcagggaggccgcgcaagacaacgagcatggcggncacgcgggctacggcgggacgcgcgggcggngagcatggcggacacgcggggcgacaagcgnaacgcncggngcncgcgnancacccgg

SEQ ID NO: 94065 - DNA, 632 bp, Triticum aestivum
  unsure (1)..(632): unsure at all n locations
  Clone ID: PAT_TA_94065
ctcganccactcctcacgctcaaaggcacaccgcaccaancaagcgcagccatgggntctcaacggnccgcgtcgccaccancgcagcgtgcatcctccgtcctcctcgcgctcgccgacgccgcggggggcggncacccgggcgccggcgcccgcgccgggngcaagactgcacggaggcgttgactaanctccgcaagactggcctcgactatgtgtttgcccgacaagcaangtcgcggccggggctnancaaagggccctgctgcaacgggagggtgaaagaccgccgtcgggtacccnccgccaaccggtgaaagttgcctctgcgcctgccaatgggncgcccaatgaaaaactccggattaaccgattnaacatgagcacgncggtgttccgncccttcnccaaccggnctggnggngcaaatccgcnctctgtcttgaagcaaagttgccacgcaaccgggggggnctttcaagcaatcnaagtgggcggggcgcgaacccgcttcaaccanccgaaaggcaanaatncnggcnggcaagggtctccccgggnggnccccnccaaccaattntcctcncaatccgtggnggactttcnctgctcggccttctaattaanttctg

SEQ ID NO: 94066 - DNA, 570 bp, Triticum aestivum
  unsure (1)..(570): unsure at all n locations
  Clone ID: PAT_TA_94066
gggctgcangntcgtgccgaattnggnacgaggaaaaaccaaagctagatatcgatntaccgatngtcgatnggtatgcatgcgaagctatagttagttagttcggccaactcggncgtcaatatgttggagacgatcctcatcgcggtgaaagccatcnagacggcggtggtattcgtcgccagatcggggaggacggcgagcgagatnaanatcaagtgccanaaactctccgaccgtgtgaaaaccctggnaacaatcttgtcccactaccggagggncaaccgcgacgggccggncatgggcaccgcgctggatagnctcggcgttgccctcaancgangcgctcangntcgtcngagtcccacaagagcgccgcccgtcgngcgatttgtttccanatttcncanagagggacctcgncgagctcgtanacgccggccaagaagatnnaaagctgcatcagggacctcnagctnccccgcnaagatgatgggcatcctgggaaaaccgtgggcccancaccgcngtgcaatcacnatnaaacaactgcnncaaagtgntgggcct

SEQ ID NO: 94067 - DNA, 339 bp, Triticum aestivum
  Clone ID: PAT_TA_94067
ctcgtgccgaattcggcacgaggagagaactagtctcgagttttttgggtaatatttttctcgtaagttttcaacggtttactgtatcgtcgcccccgtacttgtatggtttgtatcatcgaactaaatgatattttattcaaaaagaaaatgtgtttttttttatttcttttttttaacttaacatttttttaacaacgttgttctgaacttctctcattttacgacttgtactgaggtacttactaagcaggattttcatggggtttctttttttgcttgaactttacaatttgattttctgccatttcttttatttcgaaacggaccaaacgtttt

SEQ ID NO: 94068 - DNA, 182 bp, Triticum aestivum
  unsure (1)..(182): unsure at all n locations
  Clone ID: PAT_TA_94068
cccgggctgcaagntcntgcccaattccgcacgagggaaagctcaaatnttcatggggaactattctgaaataacgggttccanctgccgatatgtctggncgcaanctaagtggngggaagatactcnggaataggaantctctggggccccgnacctgttcctggnttnacaccaaaaaa

SEQ ID NO: 94069 - DNA, 566 bp, Triticum aestivum
  unsure (1)..(566): unsure at all n locations
  Clone ID: PAT_TA_94069
ctcgtgccgaattcggcacgagcacacaanaagctcatagccaatcaaagcctctccatctccgaagctccaaccgaaccgaggatgtcttgctgcggaggaaactgcggctgcggnaccgcctgcaagtgcggnaacggntgcggnggntgcaacatgtanccggaggncgaggccgccggggccaccctcctcgtctccgccaccgccacccaaaaggcgagctccggnggnatggaaatggcggncgagaacggnggctgcggttgcacccantgcaagtgcgggaccagatgcggntgctcctgctgcagctgctaagatcattgatcatcgatcatgcatgnaacgcgcgtgcagcancgatcatatcgatctactactaccataccatgtanccgctncctgatcgaggggcttatctatgcaactgacctgcatcaaaantcaaggtgncaatgncatgcctttttttatacaaggcccccctaaatnaaaancccctgggnttaantaaaaaaaaaaaaaaaaaaaanccaggggggggccgggncccaattntccnt

SEQ ID NO: 94070 - DNA, 546 bp, Triticum aestivum
  unsure (1)..(546): unsure at all n locations
  Clone ID: PAT_TA_94070
ctcatttaaataaactaataatcgaacgtctaccgctagccttgccgccattctctcaaaatccatccgtctatgccacgggtctgctacattttgccccaatatacattgcctttgaagaattatgggataacattttacatccttctcagtgcagctctagtctaaggagctctttcccgccaatttcatttgngactgggctaccaaatccatatacagggagnaatccctcctcacctatctcagactcancttctcttccggatattccgagaatatgttcgcggnaatcntcgctcctttggnaaagttcgacttccggggactattacgtactggnagactacgctctgatctcaaagaagattaataagnggnaacanaggntgnagttcaagaacaaatcatgttcggttccangacaggagctctagncaaatttctaagagcaaatgaggnagagggggtaccggnnaancccacttgctgcttgcaaaatggcctggggntttttatatgggacaggnttcngggggganaatn

SEQ ID NO: 94071 - DNA, 463 bp, Triticum aestivum
  unsure (1)..(463): unsure at all n locations
  Clone ID: PAT_TA_94071
ctcgtgccgaattcggcacgagctcgtgccgaattcggcacgaggctataaagtcgaggtatactggaattgcctggtgcagcagtcacggctgtagcagaagtggtagctccagcattttgactactctggctgtgccatacagtaatgaagtcctcatacactcgttgttggntagcacacaaatggccagtaggctttggncgaagtgcatccgggacacgtgcaagaccttgagtgtaaggaaaagcatcataatatccagaaccaagcaactccttttgcctccttagctgtgaaaaaggatgcttgatttctccatcgatcatctcaacanccttgcgtgttgcaacagtctcctattatcgcacatccaagatctagattatcattgattcagaatatgaacaatcctgctcantgggttcactgttattgttcaaggntctgaataaagacnttn

SEQ ID NO: 94072 - DNA, 452 bp, Triticum aestivum
  unsure (1)..(452): unsure at all n locations
  Clone ID: PAT_TA_94072
cccaagccaagagataaccattgcccgtgcctcctgttcaggccctgaaatggatggaccttgcaacaaggctctgcgccgtgaggccgccgcctgcgtctgccaaggagaagatgatcaccccgacgctgcttcttgcacctcgccctcaggggcgtccagcgggtcgtcgtcgtgctcattggcgtcggatctgggtgatgggtcgagttactccccgcccgatgatcattcctcggggtcgtcttcagcgtcatcgagcaccttgcagctggactctgaggccgagggacctctctacgagctgtcttcgctgctagcccaacttcctgccaangagagggttgtccaagtactaccaaagggaagtcccaatcattcacatcgatatcttatgctacaatgtcttcaaagaccttgggaaaggnaagttncctacaacaagagggatg

SEQ ID NO: 94073 - DNA, 460 bp, Triticum aestivum
  unsure (1)..(460): unsure at all n locations
  Clone ID: PAT_TA_94073
ctcgtgccgaattcggcacgaggcaatgctcatcgctgcctcagcagtcttcctctattataccgcctggactcttctgatgcctttcgtcgactctgatcatcctcttcaaaacttatttccaccaagggtttgggcaattcgcataccggttattttaatattgcttggttccgctgtggtcggctcttttttgagtgtcgtcatgattcggagtaacagaaagcgttcggcgaaggcaaaaatttcgagcaagaaaaaaatatagtaataccggcctgtgctattggataaaactgagactcaagttaacgttgaaaatcatccggcccgatgctgttaggctctcgggccccgtgaaagatgcgcgattgagacaacgcaggacggcgaatgaagattactaaaaatcggagaaggatcaaagcttcantgcatatctctgttgtcatttcttanc

SEQ ID NO: 94074 - DNA, 470 bp, Triticum aestivum
  unsure (1)..(470): unsure at all n locations
  Clone ID: PAT_TA_94074
tcaaagtacaagagctccttggatgctttccancanatcctgaagaangagggngncaagtccctcttcaagggggntggngncaacatcctccgtgccantgctggtgctggngtgctctccggctatgatcaanctccanatcctcttcttcggcaagaaatacggntcaagcggtgcctaaaggggacgaaatgatgacgaacaanagaagtttgntcccaatcctanccttccaggatctggtgaanttttanctttttaacgttgggagggaataantantgtagagggtggggttttcccaacaatcctttttngtggnggganccaactccaaaaggtgtcctaagttggcggnaacgntctcaaaacanttactaacaaaaaggggtgngtttgagttccagtaaagtgncccgaatccttaacgggcaaaatttccttaaaaaaaaatgtcctccaaaacc

SEQ ID NO: 94075 - DNA, 463 bp, Triticum aestivum
  unsure (1)..(463): unsure at all n locations
  Clone ID: PAT_TA_94075
ttagggcatgggataccacaggtaaaattgatggaggagacagctgcaagagaataattgttgcgcccgccatgaatactgctatgtggaatcatcctatcacagcgaagcaaattaaggttcttgaaattgagtgggggattgtagacggtaactcgactacaaatgaaggtacaacgcatggatggtttgaagtactaaggccaatggaaaagatattggcgtgtggcgatgttggtattggagcaatgagaagttgggaagaaatcgttgttattatagaacagagattgggcctttgaagagatgtaagaacaatccttaagagatctattctactgtagctagtacatcttctaccactttgtaactaattcatactctaattttgcaagggcaactttatctaaaaaaaaaaaaaaaaaactcnnggggggggccggtacccaantcgccctatang

SEQ ID NO: 94076 - DNA, 305 bp, Triticum aestivum
  unsure (1)..(305): unsure at all n locations
  Clone ID: PAT_TA_94076
ctcgtgccgaattnngcacgagcggtacttnacgaagagcggtgccggcccgcctcgncgcnccctccgatcccgttcgtcgcgctccggtgcnctccgcgcncggaacgcgatnctgtcntcnccggcggccactgngccggtganctcngctgangccgaagcancggnatctcgcactcccgtgtcggnactcnngcgccgctggtgaaacctgcggtcctcgtggagngagaaagctggntcgagggncngggctggaagggngctgacgtcagttccacgggancgtggnatgtgtccgc

SEQ ID NO: 94077 - DNA, 461 bp, Triticum aestivum
  unsure (1)..(461): unsure at all n locations
  Clone ID: PAT_TA_94077
gttttttttgtgagagtcaagatgcagaattacgagctagccttgcccaacactcgaacgccattcttaccgccgtcgttcagggtgtaaggaaagaggaaccaaaccctgaggtccgtttggccgccatatacgctctaggcgattcgcttgagttcgtggatagcaactttaaaaatgagggagaacgcaattacatcatgcaggtaatctgcgaggcaactcagtctcctgacatccgaatacaacagggagcgtttggatgtttaaataggatcatggcgctttactacgagttcatgcgcttctacatggagaaggctctctttggccttacaatttctggaatgaanagcgccgaagaggatgtcgccaagcttgccgttgaattctggagcacagtgtgtgaagaagaaaatagcgatcgagggatgacaacgcacagattgaaaatgccgntn

SEQ ID NO: 94078 - DNA, 453 bp, Triticum aestivum
  unsure (1)..(453): unsure at all n locations
  Clone ID: PAT_TA_94078
gcatgatggtgcagccgcagccaccgcacaccacgtacctctcccaaccatcatgcagcaacctccacggccggaatactagacatcggagcctcctctctcccacgcatatcctaagcggtcaacgcgagctcgccacgcaccctcgtcctcgacggtcgcaggcgttgcaacgtancaactcanccccaagaagccgtgctgcgatgcaaccttggcgtcggccactggagttgcaagtcgtgggcggnggngcttcaatggagcgctcgccggggctctcaacgcaacgctcatcaacggntgcaagtgaagttcangcggggttgcaaagcagcttcnacggngccatcgcccgtcgggagctctgccaaggntgggaattaaaatnnnacggggatgcaaagcaacttcgtcgggagccgtccgagctctggccggagctgcaatgaa

SEQ ID NO: 94079 - DNA, 458 bp, Triticum aestivum
  unsure (1)..(458): unsure at all n locations
  Clone ID: PAT_TA_94079
tataggatacgcacgtcagacatctgcgaccatgtcaaagcagtatctgaattctaagacaattgcangatgctcacgccacggatattttcaccctcgctgtaacacgctctcatattctttctgcttcgggcgcatcgtcaatcaaagtttatgacacgacagactctgattacccgctttcccagacactcagcggagcccatccgcttgggtgtcaccatatcgttacgtcccgcaacggcaatcgtgcagtcagtgcaggctttgggggggaggnaaagatctgggactacngcgaatcanaaggatgggtgagcgctggggatatcgttgatggcaacaaagtcggcgaagatatgggcaattgcgttgngcgaggacggacttacgctggcgagtacttcgtatgacgggtcgcattaacgtctgggatctccccaatggccacaagaagg

SEQ ID NO: 94080 - DNA, 456 bp, Triticum aestivum
  unsure (1)..(456): unsure at all n locations
  Clone ID: PAT_TA_94080
ttttttttttttgggcaccttggagacctgctgcggntatgagtacgacctggngtgnaagctnttccgtccagcggattttcaagggacgtcnagagcgcaccggacctgacaaaagtgtcaggntctaccagccgtaaaaccctanctccggacaaancgatttcatggtgctaagactgttantgaagnaaagagangtcttcccagggnccccgccgccgtctccgctttccattacgttgccgtgggngaatccaaatccaggtgccggaaatattaaccggcttccctttcgagggacggngcaaaagtgcncactttaaaacggggtttccctatctcttaggatcgactaaaccaatgtccaaactgctgttcaaatggnnacctttccccacttcagtnccccaaangtcncatttgaggtnttttnctactaccaccaagatntng

SEQ ID NO: 94081 - DNA, 190 bp, Triticum aestivum
  unsure (1)..(190): unsure at all n locations
  Clone ID: PAT_TA_94081
ctttatgcaaaccgtgatcctggtgngggttaccgtgaggaccgactggaacaaaaangtgggcgaancnaggaaaaaattgancaagtgggaaggnaanaagangcctccnattaacaagccaagaatgaaacggngggtcctgtanatgatcaacaaaaatgtggttcgttcgcaagntgatctcccc

SEQ ID NO: 94082 - DNA, 466 bp, Triticum aestivum
  unsure (1)..(466): unsure at all n locations
  Clone ID: PAT_TA_94082
ctcgtgccgaattcggcacgaggacagacagagcttgagagagcgcgcgcgagatggcaagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcnacgccaacggcaggaaggtgggcaagaagggcgtgtaccaagttcgttgacaagtacngcgccaacgtcgacggctacagcccaatctacacgccagaggaatggtctgaatctggtgaccgctacnccggcggaacgaccgggnttcttatctgggccgtcaccctcgccggcctcctcggnggggggcgtcctcctcgtctacaacaccaancgctctcgccggctaagagagcatctacgtgtaacacaagg

SEQ ID NO: 94083 - DNA, 299 bp, Triticum aestivum
  unsure (1)..(299): unsure at all n locations
  Clone ID: PAT_TA_94083
ctatcctctccacctcctcagccacacctagagcatcttagctccggctaggtagctagcaatggncgccgcactgagcctccgcgcgcccttctccctgcgcgccgtggcgccaccggcgccccgcgtggncctcgcgcccgcggccctcagcctcgccgccgccaagcangtgcggggagccaggctccgcgcccaggcgacgtacaaggtgaagctggtgacgccccganggcgaggtggagctggaggtcccccgatgacgtctacatcctcgaccangccgaggaggaggggat

SEQ ID NO: 94084 - DNA, 569 bp, Triticum aestivum
  unsure (1)..(569): unsure at all n locations
  Clone ID: PAT_TA_94084
gcgggtggggggncgctctaagaactaagtgggctccccgggggctgcangctcgtgccgaattcggcacgagggcctatcagcctatcactcattcagctttcaatattattctacccttaatttctaatacaattcgacccagggccataacctatgtcaagaaagactagtcaactcaatatcactgctagatatgacttgggtttctgaccctgattatcaacttctggaactaagactttcctgtgaggcattctatgtggtacatatgtataatgagaagccaacatcgaatcttttgagccagctaacactacagagcttccttgaccttaatccacaaatggataaagccattcttgttccttgggagatgtcaacctacaccattcttcatggaatccaagaggttcagaataacacccttcttgccaataatttaatgagatacctggacagtggtcgagctcaaatcatcatcaactcggncaataaattgaaagaggatgggnggnaacattccaagagggcctaactcaaagaaaaacttcaatcattgnttctng

SEQ ID NO: 94085 - DNA, 344 bp, Triticum aestivum
  unsure (1)..(344): unsure at all n locations
  Clone ID: PAT_TA_94085
ctcgtgccgaattcggcacgagncancctctctccctctcttgntccttcttcttccanctccanaaaatanatacgccgaggnggnggagaaagcgagagaaacacttgtttgttcgcatttgagnagcgggcgncggcgatnnanatgggggnananaaacgggtccangacggnttngancaagaacnccgaccaanccganaagaaanggatggagcggncggtctccttctccacngtgatccgggagggcatggngatgaagcaagtgcaaaantgtgttcctggtgctggaagcctctcctgcncccgngtggngcacgangaagattaaagcgggg

SEQ ID NO: 94086 - DNA, 444 bp, Triticum aestivum
  Clone ID: PAT_TA_94086
ctaatatccatggcaatcattgctggcgccaagactatccatcaggttcacgcgacctggaaagctggctttatgcctgttatgaaagtcagttggatttcatcaccgcttgcacttgcgttcgcccaacaatttctcccagagcacgcctgggtaccattctttaatatcataggattcttcatcggaacttatgtaaattctgtgaccaagaagaagcgtcttgcggccttgcgtaaaaaacatcatgatgataaccgaaaaattcgacctgatgacggctacggtgggaatccaaaatactagaacatttaaatgctgatttttcttaatttctatgcgtgcgggactcgctgttgatcttatgagtacgagagcgcctgaatattacccttgggaattttcgcctgggagttcacaaaattaacctttttgaatatcgcc

SEQ ID NO: 94087 - DNA, 526 bp, Triticum aestivum
  unsure (1)..(526): unsure at all n locations
  Clone ID: PAT_TA_94087
gtttttttttttttttttttttttttntttttnttgggggnggaaattaaagctattaattcataaaataaggagtgcatattcnagctcaaatcatgttacattgttacatacttttacatctccatagaatgaaatcacncttcgtcctanaatattttttgctaacctaattgngcccacacctacaggagaagcttgtttgttggngtgtcactaaaccttaagtaggacttgccaaaataccttgacaagactaactgatcaaacaacacccctacaccaaagnacgcactgaatgcaatcacaaagggcatcttataagtcaagctcttttttcctgaaanaatgacgggttgangcncctctgctggaattgcatttttgangtgangaacaagagtcacaatacctggtgggttcccgttggaaactaaaaagtctngaaatgntatcaaactggnccccaanatggggaanaggnccccttctaaggttattggtttgaaanngttgnatcgccgca

SEQ ID NO: 94088 - DNA, 514 bp, Triticum aestivum
  unsure (1)..(514): unsure at all n locations
  Clone ID: PAT_TA_94088
agggctcgtttaagggaaaaaatatcaatcctgcgcaaccctgtgggaaagctggtatcaaagggtgagtttctctacaaagtaaaacccaaacttccaaaccagttcaaaagcggntgaggnaaatggtgttccgttttgtataagtgataggcgaggaggagctatccaatggtcaagtaaaaattaaagagatgggcttacaagatggncatccaaaaaaaagaaggnatcctaattaatcttgaagacattgttcctgaactgagtcaacgtctgaaacaaaaggattccgaaaactgcgtagcgcagaaatcaaaaattgtgcatggagtgggtatcaagagcgaatccttaaagtcatcacaagncaagactcttctcacccaactctaactagcgatacaagccactgantcaaangatcaacacgaactccatcgcagaaaaaccaagagctaacatgntttatgaaatatgttaatttcaagnaaccaaatgggggctggngcca

SEQ ID NO: 94089 - DNA, 367 bp, Triticum aestivum
  unsure (1)..(367): unsure at all n locations
  Clone ID: PAT_TA_94089
ctctcaactgncctcttggtcgaaaatacttnaatctcgtccanagggagggacgagtcattggtgcactcctagtcataagtgacgcgtgggcacggngtaacaaaatcatcatcatcaacatcaaatacatcttgtgaagatttaggtcgagcaacacttccaccataaggtccaagacgccacatctgtgttcaaaccatctccaagccaaagaaccaaaattatctggagagatttcaacggnacaatcctccataactaagctcaaaaccctgggactcaaacgggggatgtacaaccttcatgaagggccccatcaaaacctaaaaacggtgtaggaaaaaaatgggaacactcaccacaa

SEQ ID NO: 94090 - DNA, 450 bp, Triticum aestivum
  unsure (1)..(450): unsure at all n locations
  Clone ID: PAT_TA_94090
ctgctttcgagctgattgttaagcagcagataaaacgtctggaagaccctagcttaaaatgtgtctcgctagtttacgacgagctagtccggattctttcgcagctactcggcaagcagctttttcggagatacccgggattaaaagagaaatttcatatggtggtcatcaacttttttaagaaggtaatggagccaacgaataaactcgtgaaagatcttgtagcaatggaatcttgctacattaataccggacatcctgacttccttaatggtcaccgcgcaatggcaattgttaatgagcgccattcagctacaaaacctgtgcaagttgatccgaagaccggtaaacccattaacacagcaactattgcaagctcagatnaccactcctaacccagatcctctaaatgactccaatggcggcttctttgggagcttctttgcatca

SEQ ID NO: 94091 - DNA, 448 bp, Triticum aestivum
  unsure (1)..(448): unsure at all n locations
  Clone ID: PAT_TA_94091
gagcattctaccaccgcaccgcacgagtgaagtgagagctttgcacgaaaagttcatcagcgaccatgaagggcaccaagctcgcggngatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacnagccccgaaatgtggcgctgcgcggatatgaaatccaccgtcgacggcacctgcggtgggccctgcaagaagtactgatcggctcatgccagcatgatatgttccgcctaaaatgaaataaaagctcaaacgaagatgaagcaacgtcatcgtgcctaagcgtgtgtgtgtggccaacaaatatgtatacc

SEQ ID NO: 94092 - DNA, 464 bp, Triticum aestivum
  unsure (1)..(464): unsure at all n locations
  Clone ID: PAT_TA_94092
aataaatagattctagaaaataacctggctaaagcgacgtaaattacacgctgttttccaataattagtctagtatgactttaaccttgttgtctacgtctcttgccaacttgggccgagaatccagttttaatagcggtcacagatctacgggaaccgcaagagttgcatgttatgaagtacagcctattttcacccttgtttaactccgtgtccggtgacctacaagttttgcaagtaacatactccatgatatatcttcttaaaacgttttcaatttgtttctgctgaaaacggcctttaataacaagtcttctgcttccatcaaccgatccgcttgtacccaattctgcaaaaagatacgaagtgacatgctcatctgtcctcttcattcttttgcaagatttcggctatgttagcaaagaatgtctttttgttgccttcgcgtagacactgagggangg

SEQ ID NO: 94093 - DNA, 508 bp, Triticum aestivum
  unsure (1)..(508): unsure at all n locations
  Clone ID: PAT_TA_94093
cccctcttacacagcttcctggaagctcagcacagcattcagagaaaatgccaccacctataccaaatgtagctccctcaccatttacacctctagatatgccacctccaccactatctccaccaccattacctgtttccgagccaccttctgttccaccacccccaagttctcctccggcacaaccttcaactgatccttgtaattcacagaagccatgccctcagcctcaatggcagggttctcttacaaaaagtggcatacactactgcacaatctatgcaagtagaatagagttggatgcttgtagatacgaaagtactgtttctgaaccaagcagaatgggcctcaagattagatgttctaaagcgcacagctttccaagcacgcgaagacaatcatctccaatggtccacctaataaaaaaagaagtctgtngggtggtgncntgttcgaatggngatcaaaaangggtccggggatttatctcctatctggaaagctggaa

SEQ ID NO: 94094 - DNA, 182 bp, Triticum aestivum
  unsure (1)..(182): unsure at all n locations
  Clone ID: PAT_TA_94094
ggatagattctggtctggtccaagtgtgtgtgtgtgtgagcgtctcccttcctcttttgatcgtgtgtgcagcgtgcgtgtcgatggcgcagcaggggcagggcgcggcgacgtcgctgccgccggggttncggntccacccgacggacgaaggagctcatccctgcactaactccngaacc

SEQ ID NO: 94095 - DNA, 155 bp, Triticum aestivum
  unsure (1)..(155): unsure at all n locations
  Clone ID: PAT_TA_94095
ntcgtgccgaattngggacgagcctcaccatccantccaatcatcgagagacgtacgccagcgagcgagcggcaaccggaggaggaggcgaagcgatggcgcggcgcgggccggtcnatctgnggggggtngatgancggccganccggcaggtg

SEQ ID NO: 94096 - DNA, 218 bp, Triticum aestivum
  unsure (1)..(218): unsure at all n locations
  Clone ID: PAT_TA_94096
ntcgtctcancctctccacacgcgcacataagcactttcatgggcgncgnctcccctcctcccanaatccgcctcctccgcgccttttaaggactttgcgangcgtacntgtgnaaaaggtggatcgcgcaanancaaaagcgtangtcttgggttgncgttannaggaggangctangaccgtngagtgnggtggaggctaaatggggganaaaccc

SEQ ID NO: 94097 - DNA, 252 bp, Triticum aestivum
  unsure (1)..(252): unsure at all n locations
  Clone ID: PAT_TA_94097
ctcgtgccgaattcggcacgaggcgtgctctanctcgctccgacgaccgtccgatcgtacagtgctggcgcgcgccatgaagagcacagtggtggcactcttgctgctggtggcggtgcaatgcctcgcgctgggccccggcacganggcgggggngaagccgcggcgcacgcggcagggcgactacctgaancggctgcgcgggtcgccgtcttcccgcntgtcctgggagtcnctggcgggccgtggtga

SEQ ID NO: 94098 - DNA, 495 bp, Triticum aestivum
  unsure (1)..(495): unsure at all n locations
  Clone ID: PAT_TA_94098
atgctctccatcaaatttgttagacgccagaaagtgttaaccaccctgatatgctttatttagggtttaaattggatataaattgttttcaacttaggagggatagtcaagcttgtgagacttaggcccttgtcctgttaatccattgtgaaaacatttaaagttcaataaaatgtcggttagtctgactgttgctccaagcttacatattcagtcacaatccaaatatattaaagcaatggagcatttgtcattcattttccccactttactgtgacgcacattgaacccgttcggcgccggctggatggccatcttcatcgtcttcatccattgctgtcgcaccctgtgcacgagcttgttgagtagggtcaatgtcttcgaagtatacagtttcagtcaaggnatcaagtgggtggagtgataggtaccacaagncgggcgggataatactcttcaaagctgcnnatgcctcggnatttgcaacnaaagttn

SEQ ID NO: 94099 - DNA, 510 bp, Triticum aestivum
  unsure (1)..(510): unsure at all n locations
  Clone ID: PAT_TA_94099
ctcgtgccgaattcggcacgaggttcggcccatctcttagatgcgaataatccattaaaacaacgagttggaattcgttttgagttcaactaagtttagagatttcggttctgatcctctgtacaattttctttcgctacaattctagtcgtcgataataccagaactgtatttagcaattccaataattgtgggaaagttccgccttcttaagccatgaatagccgctctctgctttcaccaaccctttgcttgagccgttctacttactcggccaagcggcaacagtagcaatatccaccaccgcaagcaatagcaacggnaacgccagcaccaagagctacaccagcaacaagtagcaagcgcgagcggcagcacaaatcatgccaagaagagaggatcagctcgtgggcaacgcttactaagtcctatcaatgggaggcgaacgggtggggactantgggggnaggcgggggctagggaagaagaaatncganacaagtaatngtn

SEQ ID NO: 94100 - DNA, 507 bp, Triticum aestivum
  unsure (1)..(507): unsure at all n locations
  Clone ID: PAT_TA_94100
caagctntatacctacatagtacaaccatggnccccaccgtgatggnctcgtcggncaactccgtcgctcctttccangggctcaagtccancgccggnctccccgtcagccgccgctccaacggcgctagcctcggnagcgtcagcaacggtggaaggatnaggtgcatgcaggtgtggcccatcgagggcatcaagaagttcgagaccctgtcttacctgccaccgctcancacggaggncctcctcaagcangtcgactacctgatccgctccaagtgggtgccttgcctcgagttcagcaaggntgggttcatcttccgtgagcacaacgcatctcctgggtactacgatgggcggtattggacaatgtggaagntgcctatgttcgggtgcactgacgccacacaagtgattaacgangtggaggaggtcaagaaaggagtaccctgacgcctatgtccgcatcaaccggntttcgacaacaatgcgtcaaggtgcagttgg

SEQ ID NO: 94101 - DNA, 568 bp, Triticum aestivum
  unsure (1)..(568): unsure at all n locations
  Clone ID: PAT_TA_94101
ggggggggggcgctctaaaactantggattcccgggctgcaagntcgtgccgaattcggcacgagctcctcctaacaagctatatacctacatagcacanccatgggccccaccgtnatggcctcgtcgggcanctccgtcgctcctttccaggggctcaagtccaccgccggnctccccgtcaagccgccgctccaacggcgctagcctcggcaagcgtcagcaacggtggaaggatnaggtgcatgcaggtgtggnccatcgagggcatcaagaagttcgagaccctgtcctacctgccaccgctcancacggaggncctcctcaagcangtcgactacctgattcgctccaaatggggtgccttgcctcgaagttcaacaaggntgggttcatcttccgtgagcacaacgcatcccctgggtactacgatggccggtactggacaatgtgggagctgcctatgttcgggtgcaccggacgccacacaaggtgatnaaacgaaggtgggagaagtcaaagaaaggagtaccctgacgcggtacgtccgcnatcatcggnnttcgan

SEQ ID NO: 94102 - DNA, 504 bp, Triticum aestivum
  unsure (1)..(504): unsure at all n locations
  Clone ID: PAT_TA_94102
agcctcctcctancaagctatatacctacatagtacaagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcaacacgggggncctcctcaagcaggtcgactacctgatccgctccaagtgggtgccttgcctcgagttcaacaaggttgggttcatcttccgtgagcacaacgcatcccctgggtactatgatggccggtactgggacaatgtgggaagctgcctatgttcgggtgcaaccgacgncacaacaagtgattaacgaaggtgggaggaggtcaaagaanggagtaccctgacgcgtaatgtccgcaatcatcggattcgan

SEQ ID NO: 94103 - DNA, 502 bp, Triticum aestivum
  unsure (1)..(502): unsure at all n locations
  Clone ID: PAT_TA_94103
gcctcctcctagcaagctatatacctacatagtacagccatggnccccaccgtgatggnctcgtcggncacctccgtcgctcctttccangggntcaagtccancgccgggctccccgtcagccgccgctccaacggngctagcctcggcagcgtcagcaacggtggaaggatcangtgcatgcaggtgtggcccatcgagggcatcaagaagttcgagaccctgtcttacctgccaccgctcancacggnggncctcctcaagcaggtggactacctgatncgctccaagtgggtgccttgccttgagttcancaaggncgggttcatcttccgtgagcacaatgcgtctcccgggtactangaagggcgctactggacaatgtgggnagctggctatgttcgggtgcacccgacgccacacaaggtgnttaacgaggtgggggnggncaagaaaggagtaacctgacgcgtacgttcgcaatcnatccgggttcgacaan

SEQ ID NO: 94104 - DNA, 509 bp, Triticum aestivum
  unsure (1)..(509): unsure at all n locations
  Clone ID: PAT_TA_94104
gtttcggataaaatcaaattaatcgataacctccttggcaaagttgatagcctcattatatgtgggggaatggcctttacatttaagaagaccttagaaaacgtcaacattggagatagtctatttgacaaggctggtagtgaaactgttggtgcgctggtggaaaaggccaaaaagaataaagtaaagatcgtcctacctgttgattatatcacagcagacaagtttgcaaaagacgccaaaacagcaacagcaacagatgaggagggcataccanatggctggatgggtctcgactgcggaaaaaaaagcattgaactatataaagcagctattggggaagcatctacaattctctggaacggtcctccaggaagtttttgaatttgatgcctttgcaaacggtacaaaagaaactcctatatgcagcggtcgaaancccgctcaacaaaggaaagantgtgattaatangtggggggtgacactgcaactngttgctggccaaagn

SEQ ID NO: 94105 - DNA, 515 bp, Triticum aestivum
  unsure (1)..(515): unsure at all n locations
  Clone ID: PAT_TA_94105
ctcgtgccgaattcggcacgaggtcacaaccacttcacttgaagcacatctcatctatctgcctggagcaagtagttgaacaactgataagaaatttgccctccgaactaagcactatttctgattattctacaacataaagggcccacatcatccggtcaagttttcggctttgtagcagcaggtaccgagattatcaacgctttaccatctctagattccaaaatcatggntgagacagcagcaaaagatattaaaattgatccaactgtccaagttgatttatcaacaatccctatttccccagacggcggaaacggngatgaaagcaagaataaggntggngaaaatgtaaaatctctagacgaacaaattacaagtatttcacgacccggntaatttcaatggtaaacatcccnttgatgcacaaaatggncnttatgggntacaaaagncgtctataagggaaaagncgaaaaattggggatgntttactcaagnaaggcaattacaat

SEQ ID NO: 94106 - DNA, 490 bp, Triticum aestivum
  unsure (1)..(490): unsure at all n locations
  Clone ID: PAT_TA_94106
cttcctcctctcntcttanccggaagtacancangntcccgatgtncgtccaacccgctantaagccgggcctcgcgtcgcgcccccgcgtntccctgcccaaaccttccananccccgtcctcctcctcctcttccgggcttgntcccctcaanancaagaggntggcccttcgctcgctccgcancctcnccgccgccgccgctggcggggccgtcnaagcgggggagccatacntcggtttgggggacgaggagccacttggcggagaaagagatgcgggaaccgtggcgggaagcgaggagtacaaagnggnggtgcctgaaaaacaaganccgatgctggnggtcaagttcanatggatgggggaaaaacaatccggnaaaacnccttgccaaaatggntccgggtgttgggaacatncccctttangcccgtactaactttctgggccgcggggaaaaattcaatgggganggaactgganaan

SEQ ID NO: 94107 - DNA, 507 bp, Triticum aestivum
  unsure (1)..(507): unsure at all n locations
  Clone ID: PAT_TA_94107
catccgggccgatntcatgagtagatactgggtagcttgaacacctatcccattcgtgactgggagaaagctgattcgaataaagcaatacccacacgtcactctctggcggtgatatcgtacccatggaatgatgaaagtacacttggttagacataggtttttcgcggtttttccctgtagtggttacgcacggcagaggtcatacgccgtaaggattaaccttgagtagtatcaacaagatgaaatctgagtgtgagtattctatgtgtcaagttaagtaatcctactttaagtacatatcttccgataaaaacctgcatgggcctcaaggnaccaaatcaggtaaaatgaatcatatatatgatgggtattcaagctgaatagctatgacacctgacatactcanggtaaaagncctcattgtctttagaaaagggattgaaaaaacagtatacataaaaacaagtggaattttagtgggttagtgtctacntttaaaaaaaa

SEQ ID NO: 94108 - DNA, 369 bp, Triticum aestivum
  unsure (1)..(369): unsure at all n locations
  Clone ID: PAT_TA_94108
cggggttccactccttcancaaccacactcctctcctctcctccgggaggtccacgcccgcccanaatccccgcccccggnctccgaccacctcccgcatcccccgccatggcgttttccacccccaacgccctctcagcttccgcttccggccccgcctccccgttccacctccgcctccagccgcagcccttcctccgcctccccgccctccccttccaacgctccctcccgctccanctcccctccctccgcctcaanncgggccctcctccctcncctcccgctcgcctcctcggggggggggagnaacatnnctccggcggngggggtggtnatgannacctcccctcangcggatgaggagaa

SEQ ID NO: 94109 - DNA, 512 bp, Triticum aestivum
  unsure (1)..(512): unsure at all n locations
  Clone ID: PAT_TA_94109
ggctgcaagaattcggcaccaactcgtgccgaattcggnacnagcgggaacgttacctaccctgtatttgtcatatctatgtcgaccatacatctcactgctataattcaacatttattcttgaaacttttgctcaaccttgccgtcaaaaaatgtatttgaaaggcgaagatgtcttganacataacacgaagagaaagctgctgggttattatccacgtaggccaatcataattattctttgactaatcatgtagccanctctatatagggaaaagcatatgatgtcactgagtttttgtcagaacatccggggcggttctggtgtcattctcaaacatgcanggccatgatgctaccttggcggttcgatccaatccatccaagccggacacattagagaagtaccttngaccaagtctaagcatcctangattggtgggatatgagtacagtccagcagcaagggggattccatcttaaaaaagtccnaaggataatcgaaagacngg

SEQ ID NO: 94110 - DNA, 228 bp, Triticum aestivum
  unsure (1)..(228): unsure at all n locations
  Clone ID: PAT_TA_94110
gcgggacggctcctaaaaactaagtgggttcccccggggctggcaaaggctcgttgnccgaaattcggnaacgaagctccgtgtccggaattcgggaacgaaggctggnagcccgggggggataccactanctctctaagnagcggnccgncaacnggcgggtgggaagntcgaagctttntgttcacnttanccgaagggggtgnaattatacccntngtactnacc

SEQ ID NO: 94111 - DNA, 526 bp, Triticum aestivum
  unsure (1)..(526): unsure at all n locations
  Clone ID: PAT_TA_94111
ggctggaagngcntcctgggctggtactgggcaatcccttcaanccggctgntctcgcatcaagctcatatgggaaaatacaatcctgctgtaaacacaccggcctttccttcacatttctatctcggataggggataatgtccagcaagccgactaccacaatgggcttctctatgaagcatatttctctcataactctcacttttcaaaattctgcacttatactgatcatgcactattcgagggataatgcccgtagnaaatagnaacccgatactttactttcacaagctgtattccctgaatgaaatantaaaagcttgnattctctcttactaaaagctcttcacgaaatatctcgcaactccttcccnccttgnactccgggctacaaactncttttcaagcaaactttatctctcaagtantcgggttggggatagctgggaaactagntattcccaagctacactctaaaactcttcaaaaactcaatgggagtatattggcaggttaggaatccna

SEQ ID NO: 94112 - DNA, 474 bp, Triticum aestivum
  unsure (1)..(474): unsure at all n locations
  Clone ID: PAT_TA_94112
ctctcccatctcaagattgatgtgccctcactgatccgtcatcaacacggnatatccccacgatctagtctgtcggattacctgtcgacgtatcgcttggctcttgtcgtctcgattcccctcctcttctctctcattctcttctggcctctcacacatctcaaggcgacactcgttctctactacaacttcttccccatggtataccttggctttgtcgtcggcgtcttttgcctgcccgctcggggccttgctgcgtcgggtcgctcccaatttttgagcatgctccgtcgcatatccatcggtgggctcgcgctatcaaagaatatgaaatttgccgacatccttctggcaagacgtgctcacctcctactcaaaggtcttgagtgatttctttgcggctatatgggccctggcttctagcactcttggnacgggggacgcctctgcttgcgcgggtcgaactctaagtac

SEQ ID NO: 94113 - DNA, 541 bp, Triticum aestivum
  unsure (1)..(541): unsure at all n locations
  Clone ID: PAT_TA_94113
aattgataaggggagaangaagaagcaacgatgggcgccaactcnagcccgatgggggtttctcncngctgcccctgggcgctggctccctcgccgatcgggatcgtcgcgcgggnctcgacgcggtgccccaaagcccccccggtccccaaagggcaatctcccgaccttgaagggaaggcggatcggttgaaaggggggctgggggnctccaantccgngagggaagctcaanngtgtcccggggnttcnaccntngaangggaacgcngcttggttggggggcaacgcggntgggcngtaacgaaagtttcccacattgnanggtccggggaagggaaangnccgtngcccgggttgccggccttgcctccgagggaacgntcaaanccgcctggggnaactttccgtccganccttgctccaatncttnccgnggtcccnaaggtccggnacgcccgatttaaaangggtngcctcctcnccaanaattcggnncngggtggaagctttcgnacccccaaanccnggcggcgccttt

SEQ ID NO: 94114 - DNA, 418 bp, Triticum aestivum
  unsure (1)..(418): unsure at all n locations
  Clone ID: PAT_TA_94114
gctcgtgccgaattcggcacganccggttttgacaccgacattggtgntttcattgagagttcctctgtgtcgtcncctttangcccgatggnttcttcgctcgtcaatcacgatgtggtccgggatgagacttttctccccngacagatcttcgtactcggcggctttgcactgcgggccaactcgtttggncatctagagcaagatcgaaggntacacccctggncatcaaggncaggtttggnaggcttaaactacacggccgacatccgcggggacttgatcttcgacggattcgagccacgaccgggcgcgccgcacggtcacgaagggcatgatttatttctggcatcgggcaacanccaanaacgnccctcaaagaggncgcctccgaccattaanttcgggnggccactg

SEQ ID NO: 94115 - DNA, 488 bp, Triticum aestivum
  unsure (1)..(488): unsure at all n locations
  Clone ID: PAT_TA_94115
cctcctcanccccgcccccaancgcaacgcccgccggaaggttctanagatggcggnggagaaggagtcgacntcngtcccgctcaaccaaggcggcggaggncgtcgaccccgangacccgggcaagtcgccgccgcgccccanctcgcccancacctccanccgcaaggnatgctgcgctgttcttcaagagttgggtgtccaagaaaatttatgactggntgtgtgggtctttttcctgtggctttcaccgttcttcatcacatgggggttcgttcagtttgttgatgggtttttcaacccactatacgcaaaactcgggngtcaanatatttggnccttggntttctgacntctctgggcaattcaatatttctggctgggaaatatttgtttctttcgnggggtggggttcaactggccttctgggttgggngaaatgggtttannaaagaaaaatgcccaattttgtgggaagcaacatatt

SEQ ID NO: 94116 - DNA, 502 bp, Triticum aestivum
  unsure (1)..(502): unsure at all n locations
  Clone ID: PAT_TA_94116
caacaacacagagcatctaccaccgcaccgcacgagtgaagtgagagctttgcacgaaaacttcatcagaaaccatgaaggggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggngtcgacgagccccgaaatgtggcgctgcgcgggatatgaaatccaccgtcgacggcacctgcggtggaccctgcaagaaagtactgatcggttcatgccggcatgatatgtttccgcctaaaaataaaaataaaaagctcaaggcgaagatgagcaagcgtcatccgtgcctatgcgtgtgtgtgtgggccaaacaantgctttataccaatatgtcgtcctcttccgncncttgtgttttc

SEQ ID NO: 94117 - DNA, 395 bp, Triticum aestivum
  unsure (1)..(395): unsure at all n locations
  Clone ID: PAT_TA_94117
ggaaattcgggnacgaagcaacngcatagcatcatcatcaagaatangggacantaacttactgtncacaaaaanccataaatcgtccccngccgggnaatgggttctttctcaaccaacgagcggggcgagagagcaaacacaccgtggtgccctgcctggcgggccgcgcaaggngnacaaacatcnccatgnatngacgtggncaagatgctccancgcccgcgggcttttntnncaccttcgttcaacaccggaggtaanaaaccaattgcacngcttcgtccgccncgcggggtgngggcaagcgagtgggtccggcgtcccngggggtttcgcttcgtcaaccatcncctgaatggcttgcctggccggtccggcccggcgacgtcacg

SEQ ID NO: 94118 - DNA, 479 bp, Triticum aestivum
  unsure (1)..(479): unsure at all n locations
  Clone ID: PAT_TA_94118
cgacagtctctaaatcatttctttgcatcatagttggaaaattttggaaaaaagggaggattgaagtctaagaaaacttgcatcgntattcagaaatgagtcaagagggtcaaacgcgggccgttttgattcaggatacaccaagatggctcctagaattccaaaaattagagaaagaagatctaattgtccttatcactcctgtggctaatcctgttagccaagactacactgatattagtgatccatttgagcctcttggncgctctatatcaagcagacacgctaaaattgcccatgttccatatatccaaagaaagggcttgacttcaactcatgtgggcttcatagaaaantgcaagctcataatattttgtcttcttccgcaacctgatagaagcttacaagctgnaactcactgatcaattgttcgaacttgggagacaataaagccgnttactgntgnacagatnctgcgg

SEQ ID NO: 94119 - DNA, 353 bp, Triticum aestivum
  unsure (1)..(353): unsure at all n locations
  Clone ID: PAT_TA_94119
acgaacaaatatcctctggggcggacaaagaaaagggcancaacgtcggtcgtcgtccttaattgttcctgcgnctcccaacttttccttccaaanagcggngncctccaacaccacccaagagccgagcgaggagaagagaaganatcggccatggntgcggacggcgagaagtgggngggnctggnggtggacttctnngcggggagccgcncggcgctgcagtgggnggcggacaacntgctccgctccgggcgacaacctgctcctcctgcangncctcaaggacnccngctacnagcagggggagaccctcctctgggaggnctccggctcncctttgntncccctct

SEQ ID NO: 94120 - DNA, 503 bp, Triticum aestivum
  unsure (1)..(503): unsure at all n locations
  Clone ID: PAT_TA_94120
agctccgtgccgaattcggcacgaggaaggnctgccaagtcttcaaatcttttcacaagaaacaagcaaccgtttccaaacgattgcaagatgcactcattttgtttaccttcttcaagtactctgggatatggcgagcagataccaacaaataccattccgatgcaaccttacctactcatagcctaaagccactgccggttccatcaagaancatctttgtttccaccggactttcaatgtaaaaaaggncctaaatctccctcgagcttatctgttgagaaaagagtcccaaagacgctctatcaccttcctcgcacccgaaagattcccaaagtcacaatcaagaaaggcaattgtgccggnccaaagatccatacctcaactggggccgtagagacaccaaagagcgagcataagaatgtggggtctcctggagnagtaaattcctctgaaaaccctttgcatctgaataccaacctcatcgacaaaaaccgtancaa

SEQ ID NO: 94121 - DNA, 496 bp, Triticum aestivum
  unsure (1)..(496): unsure at all n locations
  Clone ID: PAT_TA_94121
tgatacgtcgcactggtctagaaaaggcaccatttgccaatatcactcgttacaaatcaaaaaaagtttggccaccagatttcaagtaaactcaatgccaaacaacaattccgctttgaacgaaagctaaaaagaagatctaaattgaaatgggcaagacccangatgggttaaaggggttaagattgcgcaattgagctctatccttatcgtaatggtatatggggtcttattcatggatctgagtgcacaagacagccgtaacggaccgttttgtagcatacgtagctggttctttgggttgaccggtgacctgtttaatccaagaaacctaccgtagggataaacaagatacacgatccgcacaaatcatgtcatctgggcaaatgatttcgctgagctattaattatgggctaaattgacagcgccgaaagaatctgtcacttggccgtgcactgggaattaagtggatgcaaacttatacccaagaaacga

SEQ ID NO: 94122 - DNA, 663 bp, Triticum aestivum
  unsure (1)..(663): unsure at all n locations
  Clone ID: PAT_TA_94122
gggattcccccgggggctgnaagggaaatttcgataatcaaaagctttaatccgaataaccgtccnacctccgaagggggggggggcccggtaccaaattcggccctaanaagngaggtcgtattnacgcgcggctcaactggggcgtccgttttaacaacgncggtgactggggaaaaaccctgggcggttaaccaaacttaaatccggcctttggaagnaacaatcccccttttcgccaagctgggcgtnaatancgaaaggaagggcccgcaaccggattnggccccttcccaaaacaangntgcngcaagcctggaatgggcgaaatggggacggcggccctggtaagcggggngcaaataaaccncgggcggggntgtgggtnggntaacgccgcaagcgtggaaccggctacaactttggccaancggcccctaaancggcccggcctnccttttcggcntttcttccccttccttttctcggccnaacggttccgcccgggcttttcccccggtcaaagcttctaaaaatncgggggggctncccttttaanggggtcccgaattttaaagnggctttaaangggaanccttcgancccccaaaaaaaactttgattaaggggnggattggggttcaaagtagggggggggccaat

SEQ ID NO: 94123 - DNA, 425 bp, Triticum aestivum
  unsure (1)..(425): unsure at all n locations
  Clone ID: PAT_TA_94123
gtgctctgggaagtcgatggccattgggtcgttcaaggagcagttgatgtggacattggagccaatccctctgctgagggtggtggtgatgatgagggtgttgatgaccaggccgtgnaggtggntgacattgttgacaccttccgtcttcaggagcaacctgcttttgncaagaagcagtttatctctcacatgaaacgctacatcaanaacctctctgccaagcttgnaggggatgacctagatgctttcatcgaaaaaatgttgacgtccgccacaaagtatcctcttagcnaagctcaagggnccttcagttcctttggttgncgagannatgcatcactgatngcggnnttggtgttccgcctactacaanggagggagctggcngatnccaactttcctgtacnttgnacatgggnctg

SEQ ID NO: 94124 - DNA, 564 bp, Triticum aestivum
  unsure (1)..(564): unsure at all n locations
  Clone ID: PAT_TA_94124
gggttccccgggntgganggaattccggancaanaaacgctagccaaancccaanattctccccaaagaaaaacaaactnccccgnaaacgggaggccgagccccaatgccgccccaaaggatccaanaaanaaccccnagccggggggngcggcccaacctcgggcgnttctcctcccacctnaagatnggnatcgnggggntacccaatgttgggaaatcaactttnttcaacaaaagaacaaagntgtccatcccggntgngaaattcccaatctggtancaatggaaccaaatgaggnaaggggnacatgttccgggcgaacgaattnnctaactttggcaactttttaaagccaaannagtgngggngggtggntatctgggaatcaatgacaaaanctgggcttgtttaganggagcaaagtgcaangggggaagggtctggggaaaaggccctccttaatncccaanaaacgtggctgggtggatngggaatcctttcaatgtcccttggggagcnanttttttggacaaccgggaaatcanccccaatatttggtn

SEQ ID NO: 94125 - DNA, 502 bp, Triticum aestivum
  unsure (1)..(502): unsure at all n locations
  Clone ID: PAT_TA_94125
ctcgtgncgaattcggcacgagatttatctcatcatgtccactactcagcatcccgaaatctgctgggcccaaaggtcccatgtatcaagatccggaaaagaacttattatatctcaccatagtcgctacagatgtgccaaaagagtccatgaagatggaaattaatccacaaagcatctctttcactggcgagaacccaaagaccaagatcaattataaatttcaagattgaactataccgaagaaatcgacacagatcataccaaggactctgcacacctcgaggagtgttcaagttgaccctacgaaagaaaaaagttgcacaaagaatattgggcacgattaaccaaaggactccaaaaaaaacgcatccattaagaccgactttgacaagtgggtcgatgagggattcacaangagggnagcctcagccgnatttangtgaagggatttgattgacatggggcgggtatgggtgggtatggggaagggtntgggggg

SEQ ID NO: 94126 - DNA, 248 bp, Triticum aestivum
  unsure (1)..(248): unsure at all n locations
  Clone ID: PAT_TA_94126
acngaggagacggggagaagagaagctctcgtgctcgcgcgacgaacgacnatggcgacgacctccgccgcggcnacganganccccctccggtgccnctcctcgtcctcgccgccgtcctcgcggagtncctcggtcccgcggcccgcgngaccaancccggattcgtcnaggggtacaccatcgccggncgcatcaagatcgacgttgcaaggggctttggtcttccacccaacgacatcanacac

SEQ ID NO: 94127 - DNA, 244 bp, Triticum aestivum
  unsure (1)..(244): unsure at all n locations
  Clone ID: PAT_TA_94127
agctcgtgccgaattcgcgaacgagcgcantcgtacaaaacttctttgctctcgttcgtggnccaagcctaaacctaancgtcaacccctttcttcctcgcacgcgaaccctcccggnagatatcaaccgggcgctagggggnggngggagacgtccgtcgcgagcttcctgcgcgctcttctctcccctgtgacggccggcgcgcgcgcggaaggntctcctccccncgggaagcccccccag

SEQ ID NO: 94128 - DNA, 622 bp, Triticum aestivum
  unsure (1)..(622): unsure at all n locations
  Clone ID: PAT_TA_94128
cccgggctgcaaggaaattcggcacgaaggtncgcccgcgggattctaancaagcctccgtcgngagcgggagaatgaaaaaattaacnggngctcggtcgtgcttgaaagcccgtccgggccgggggggccgtcgggggggctcctcctccaagcgggcggggcaagggctccgagggcgctcgttgctggggcaacgccacgggacgtcaagccaacttcgggcttcttccaaccgcgggcgccgcccggggagttcaatcgtcttccgtccgnccgcaaccggtcggcccaagcgcaaccaagcccgggccaagcgccagtcccgtcccaagcaacggaaagaagtacaagggtccaactcaacacaaacaagaaaatgggcctctggcgtgggtgggcatttaatgggatggacccacctatccctggtacgaaaagtgcaatttttcctccttcctgaataaagggtactttgantgaaataaccaaanaaaggctttttgggggaatgctttgggnaaaggcccgccaacaagcangttccnactcaaaagangtggggcctttcctggaatggnaaggctttggaccaaaaattttcaangaattcttgcnagng

SEQ ID NO: 94129 - DNA, 485 bp, Triticum aestivum
  unsure (1)..(485): unsure at all n locations
  Clone ID: PAT_TA_94129
gttgaactggctagacgaaggtacaggttctcgccacttccatcacgaaactttcctgtgtcgacaagctcccccaaccaaatcaagcaccttgcctggtcactagacgtgctgccatttttcatgttagaaaaagcatatgcggtgcaagcgcagttgtttctgcactctgcttcgcattggtcaaagcttctgttcctgacatacacaaacttatcgggtgtcttcatgccactcaaggttgagaaactatctccaccaccacatgtcagctcctcctttctccgacacccttgggagaagtttacaccatcaggctcaaacccactgaggcaagttgcatttcggaactgtttcagtggcatcacagtaaccaaatggnccacaataggcgtagcggtcacaactaggattaggncgctctatgaaaacattccatgacgatgaggtgctgttccacgctaaaaactgaancatgcccgtgg

SEQ ID NO: 94130 - DNA, 414 bp, Triticum aestivum
  unsure (1)..(414): unsure at all n locations
  Clone ID: PAT_TA_94130
gggggggggcgctctaagaantantggattccccggggctgcaggctcgtgccgaattcggcacgaggaaaataaaagcaaactggggagaccatctgttcctctccctaccaaccatcttccttantgacgagggcacccaagagctccacaggaaanaagcgcgaccggngaaagaaggagagcaagatgtcgtcggtgntcancggcgatgananggggnccttcttcggcttcctcggcgccgncgccgccctcgtcttctcatgaatgggggnggnctacgggacggccaanagcggcgtcngggtggngtccaaggggaagtcaatgcggccgggnggttgtnatgaantccatcntgcccntccgtcaanggggggaagtgntcgggaatcctacnggnctcaacat

SEQ ID NO: 94131 - DNA, 464 bp, Triticum aestivum
  unsure (1)..(464): unsure at all n locations
  Clone ID: PAT_TA_94131
agatncattcgtgttccactcagaaagattattntggntcgattaacgcatcgccataggcgcggngcgtctggatcattaacaacctcaccattaaagtcacccctaaagatcccgttgaatgacgatgtgcaagagaagggtaagaggctacagtcgcggtatgcantgcaagatatccaaatgaatcagataaaagcggcagcaagccctattcgaaagcatgcaaatttggnacaagctatctcttcccctccaaggaccaaacctaaaacgcctcgaagatccagtgatgaaaaggatcctgatgatgaactatttaaagttgtaggaaatgcagtaacacccatgaagcgcgttccaatcctggctaatttcgaagaatggatgaagatggctactgacaacaagattaacgccaccaactcatgggacttcgcattaattgactacttccatgacct

SEQ ID NO: 94132 - DNA, 475 bp, Triticum aestivum
  unsure (1)..(475): unsure at all n locations
  Clone ID: PAT_TA_94132
ctcgtgccgaattcggcacgagctcgtgccgaattcggcacgaggggagaagaacatcctctaactatctggacatcaactctcaagcgtactatagcaactgctcgacatcttccggtagcctacaaccagcttcagtggaaagccctcgatgagctcgattcaggcgtatgcgataatatgacctatgccgaaatcaaggaagagtttcccgaagactttgaagctcgagatcatgacaagtacaactaccgttatagaggtggagaatcgtatcgggatattgtgggncgattagagccaattattatggagctcgagcgttcggagaacattctcattgtnactcatcaagccatccttcgctgcatctatgcctactttatgaacaaggacnatggtcaantctccttggatgaacgtcccgctgcatacacttataaagctcactccaaacgcctacgggttgtgaggt

SEQ ID NO: 94133 - DNA, 461 bp, Triticum aestivum
  unsure (1)..(461): unsure at all n locations
  Clone ID: PAT_TA_94133
ctcgtgccgaattcggcacgaggagagaactagtctcgaggtttttttttttttttttttttttttcgagatttaaggattaagtgaaatttccttgccattaggctattcctcaatggttttcacacagttccattcccccttcaagtcttctttccataaactcactgtattgtcatttccgcttacggctaatacattgccacttagactccaactaactctccagattacgacttcgaattgtaatactttactgttccaattaccaggctgacttggntcacttgtccagatccgcacagttttatcttgactagcagatgcaatataactcttctgtaggaaagtaggagaccatgcaacatcacntacccaatccgntatgaccctgtcagcggttctcgttctgatttatagcttcgagatgccgtatcgaaaatccatcctcgggccggaag

SEQ ID NO: 94134 - DNA, 500 bp, Triticum aestivum
  unsure (1)..(500): unsure at all n locations
  Clone ID: PAT_TA_94134
cgcactcgctcctcctccacccctcccgtgancacacgccgccgncatctccttcatncatcggtcgccgccttcgcctantcctcctcccctcccactcccgggagggngnaacaccccgaggacctccccttgatcgcctcttcctcccatccagncagattcatggagcaagggctctcacgctcgctcgcgaccctcanctgtgtctaggggnttgggnagggcatcncctttgtngctggtggactccggcgggtcctcttcgtttcctccctcgcccacacagngcgggtccgcttcccgcgggctatggngcgtggttgggctcccggcgccaagaancgtcccaagnactcgctgcatctccgggntctatcaaggnattccttggggnggaaccggggnaganttntctctcccttcccggtcccctctcccaaatngncaaggcaaccaanacgaggctcaaccttaaggctnctttcttcaatccaaan

SEQ ID NO: 94135 - DNA, 473 bp, Triticum aestivum
  unsure (1)..(473): unsure at all n locations
  Clone ID: PAT_TA_94135
ctcgtgccgaattcggcacgaggtcgtgtacaaactacacaaagctctttgacaaccttcggtaataaagcagtgtcgcatcctctagtcatctagagttgcgcatagctcgtcttatggcttcccgatttcactcgaacctgcaccagcgcagtgatccccgagatgccctcttcgaaaactatcagcccacggcgggtggctcggctggcaaggcacgacgcagtcctgcaccgccaggagagatgcgtggcgctggggctancagcatgagcgggagtgttggttatgatacangaccgaggtggaatggctgggccgacgttgggcagancggcggtgccgtgggatttcnaactgcgacgcccaacaaacaaggtcaatactccgatgncgtcctctcctcactcgaatcgcaaaacgactcgcaagtcganggtatcatcggcaaggtccgtcagctcaagagtatt

SEQ ID NO: 94136 - DNA, 480 bp, Triticum aestivum
  unsure (1)..(480): unsure at all n locations
  Clone ID: PAT_TA_94136
tttcgagaaaaaacanacncgtgtgtgaagaggatgaagtgcgtgcgtgcacctcttcccttcctgtataacgtactattaaactcagagtataagattttgtgggtggcacgatggtgcgtgcgagaagtcccgagagataggtttaatgcattaattgcaaggcatgcataaagtacatgcattggtcaattttctcttaatacttgcatgcantgatttaatgcaccttggaatctgaacatgtgttggggacaaccaaattgagctttataaaatgggaaaaactaaaattttgngataagccctaaaaaaccggaaaggagggagtagaaaaagaagtactccatccgggaatagttgttccacacttcgncanctagaaccgtcaataaattttgagcttgccgtcttgtcacattccagggntactccacgctatattgaattgcaaacctgttcacactgatcacaacctag

SEQ ID NO: 94137 - DNA, 452 bp, Triticum aestivum
  unsure (1)..(452): unsure at all n locations
  Clone ID: PAT_TA_94137
aagcagcgcaaagcacaacaaccaaatggncaccatcangcgccgccgcggngaccancgtcgtcgcccgtntcgccatcgccaggncgcaggncctaggtctgccccagctgntgacnaggagcgagagggtgaggtgcagctactccaaggacgccaaggaggcgacccctgccgccgccgtccgcggggctggtgcgtccctactcgccgcggngggcgcggtgaccgngtccgcggggcnggtgctggtgctgntcgacgannggatgtcgacngnggggcaccgggctganncctggggctgangcaacaaactgctggggtggttnctcctgtgcgncttcgggcctcaatctgggccgntctncaccngtctanacctccggcccncnaantaggaangaanggattcccgggggtcntctcncctctnagntnacatatatgtt

SEQ ID NO: 94138 - DNA, 457 bp, Triticum aestivum
  unsure (1)..(457): unsure at all n locations
  Clone ID: PAT_TA_94138
cactaagcctatctctcgtcgctgcggnagccgttgtggnggcacaggaagatnggaacgggacctgggtcgggcccacggntcatcccatttcaccgcttgcgctgcacccatcccccaccagctatacaacttcgaccatctatacgaccacagtctttacagtcacttcatgtgctcccgccgtcacattttgccccgaacgaggntctgtggtcaccaaaaccgtatctctctacaccaccgtctgtcccgtctccaagcgcggttccccatcttccgccccccgagccgacgcccacgtcctttggngtctcgacggtggnaaagaccattgttaggactgtaacctcttgtcctccggnaagtgcctaattgtgacattggggcgcgaggncaacctccgtctccacctacaccaccacataccccatcgggngggcctactgcggggnat

SEQ ID NO: 94139 - DNA, 481 bp, Triticum aestivum
  unsure (1)..(481): unsure at all n locations
  Clone ID: PAT_TA_94139
cttccctggacaggcaggttcttctgaagaagctcagagatgttctagacacgctgaaaggccgtgtggctggtcgaaacagagatgatgctgatgaagctatctcgctggtggaagcactagcagttcaacttactcaaagagaaggtgaattaatttatgagaaggctgaagtaaaaaagttggctagcttcctcaagcaggctactgaagatgcccgaaaggtagctgaagaggaaagagctcttgcactcgctgaaattgaaaaatctagagctgcaatagaaaaagttgagaaagcgttgcaggagcaggattcagcatcaagtannagagagaangaggngatagaggaacttatgaaacnagattcgagaggctagacgaataaaaatgctacaccanccatgcaaggtaanggncatgcagtttgagcttcangggactgcggtacacctaatntcangnaaaaaacacagnt

SEQ ID NO: 94140 - DNA, 467 bp, Triticum aestivum
  unsure (1)..(467): unsure at all n locations
  Clone ID: PAT_TA_94140
gtgggttaggggtcaaaagattccccctcaagtancttctgaaatattacctccttacatatgtgaaattaaaaaaaaatgtatggagctatccgaaccctcaaatttaactctttaaatccaattgtgcacaaacatgtcatccgaaactcaaatttgaaactanagtangaccacgccgtgcataattttaggtagtactagtttataacacaacatcataggttcataantaaactantagcactaacttaaagttcaatganagctaaaacgacttaaatttaagctgaaacgagcactaactagagtcggagtcaaggtttatcaccctctgcctgccaaagcacgatatctcgtcgtcgtgggcgccccttgatatcttcgacgcacacttatcattggntctcgagggggggcccggnacccaattcgcccctataggtggagtcgtatttacgccgcgn

SEQ ID NO: 94141 - DNA, 175 bp, Triticum aestivum
  unsure (1)..(175): unsure at all n locations
  Clone ID: PAT_TA_94141
cccancccattnngctgggcctcacgcgtcgtcgcggnagatnctggcatgcaggcanccgggggcatngcacctcacgtcctgtgactccgtaccaactcntcancntcatccatcggggccgctcacgtacatanaccntcgtgttctggggtcnacaaactgtgnttcccac

SEQ ID NO: 94142 - DNA, 456 bp, Triticum aestivum
  Clone ID: PAT_TA_94142
agcatgatcgaaaacgacaagtacggcaatggccctgaatccgactccgattctggcgctggctctgattgccatgaagacaacacggttcagccattaaaatcttcccttaaaagtgtaacaatacaagcaccgatagtaaagactattttgccaccacagacagaacccaaggatctcgacgtaaagtcactcactcctcttactcctgaaatcatagcaaggcaagctacgattaatatcgggactattggacacgtggcacatggaaaatcaaccgtagttaaagccatatcaggagtgcagactgtccgattcaagaatgaattagagcgtaatattaccattaaacttggctatgctaatgcaaaaatattcaagtgcgataacgaggaatgtccaaggccaggatgctttataagctacaagagtgacaaagaagttgatcctccttgc

SEQ ID NO: 94143 - DNA, 475 bp, Triticum aestivum
  unsure (1)..(475): unsure at all n locations
  Clone ID: PAT_TA_94143
ctcgtgccgaattcggcacgaggagaaacctctctgatacatggagtgaaaaatcccaatctcgatccatgccaactcaacagacaccttcggagatacctgtagagcatctttatgatcacccagttaagttgtgacatttgatagcacacaaggtattcctccggtatacgggagttagcatgatctcatggtcgaaggaatatgtatttgacattaagaaagaagtagcaataaactgaatgatcatatgctaagctaacagatgggtcttgtccatcacatcattctcctaatgatttgatcccgttgtcaagtgtcaactcatgtccatgggtaagaaaccttaaccatctttgatcaacgagcaagtctaagtagaggctgngtaactcataaagtataggggatcgcnacaagttttcggaggggnagattattcaacccaaatttattggttcgacncaaagggaag

SEQ ID NO: 94144 - DNA, 473 bp, Triticum aestivum
  Clone ID: PAT_TA_94144
cggcttcgctctgctggagctggagatcacaagacagagtagggtgccattgtgtagtaaactacgctctgagaggaagattttaatttcttggcgttgtctattcgcccatgagagtatatctgctctatggtctaactttttcatccaaagttaggtttcagatatactttctcagttatgtcacacttcttcccatctcttttatatgcacataagtctcatttgtcacagttcaaacggagttaatagaggtatacaagctatgcgactagcatttccaattaatagatacgcatgaccttagcactcagaaacattcgtggcaaactactacggatgcaaaatatcggtcacactttcacaaccgaaatttatgaccctcgtctaataagttgcgaatagaagtactgagtgctcagccgttagtgtgggcgtatgtcaggggaaggtcatgaagtagattgacgagg

SEQ ID NO: 94145 - DNA, 471 bp, Triticum aestivum
  Clone ID: PAT_TA_94145
tttttttttttttttttgccctccatgtaaactaatcatattatctctgccgaccaaagaaactgcttaaaaatagtcacaggaatctactaatcaactagcgcgagagtacccgaacacgaaataacaccatactaacaggaatccaccaaaagcagcaaaggctctaatacgctggccgctcgaaaaccctaccagtccaaaagcttatacaatctatcattagtaatatcaagctacccaaatgagggagagaagaaattcgcgccaacaataggaaattatatctggcaagctgggtggaagtttgtggggaagaccagtctaaaaaacggcagaaagaggcaggaaaggccgtcgcataccaacaatgggctaagtcctgggcaaaataaaaggcagatttaacagccctgacagatagttattgctgaccccgatacctgaaagagcggtgaagctctatcagaa

SEQ ID NO: 94146 - DNA, 184 bp, Triticum aestivum
  unsure (1)..(184): unsure at all n locations
  Clone ID: PAT_TA_94146
gccgctgttccgcctcgtcccgcccccctcctccgaagattcgaggncccgggctcccgcgcggnggcggnggaggaagcatgangacggnggctgcggcggcggaggcgcancagtcgcgcctgctctacgagctgggcgcgctgctgctcancatcctccggtcgccgctcgggccggggga

SEQ ID NO: 94147 - DNA, 477 bp, Triticum aestivum
  unsure (1)..(477): unsure at all n locations
  Clone ID: PAT_TA_94147
ccgccgccgtccaatctccggcgagatcccctcccccgccggcagccatggcctccaccttcagcggcgacgagaccgcccccttcttcggcttcctcggcgccgccgccgccctcgtcttctcctgcatgggggcggcgtacgggacggcgaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggggtacgcgcacctctcctccggnctcgcctgcggnctcgccggcctcgccgccggcatggncatcgncatcgtcngcgacgccggcgtcaggggcaacgcacagcagtccangctgtttgtcggcatgaatcctcatcntcatctttggccgaag

SEQ ID NO: 94148 - DNA, 490 bp, Triticum aestivum
  unsure (1)..(490): unsure at all n locations
  Clone ID: PAT_TA_94148
tttttttttaatttgnacaatcaaaatagagctagcttttcttttgagaaaaatagctgtttcattcatagcacaagattacaaagagtccctcngcaaagaaagggaatacatcanaaagccacagccggccaacgggcagacccacaccagaacacgtcgccatcgccggagcacancgaagctggngaagacgccatgctcacangcatggnggccgaagtcgcctcaccgccctgcctgaggatccaagaactcgcngaatcgactgatccgcgaggacnaaaattgcttctccatccgacgctgccaccatcggngaggaangccaagacaccgaccganccaagaatgcaaccgaccancggctgggtnaaccaccaccaacccacgagcttgttgacgccacnccaagagggagagcatccccacgggggaaaagctcnggggttgaaaatcgccgcaagccggaagccgccggccacccccc

SEQ ID NO: 94149 - DNA, 296 bp, Triticum aestivum
  unsure (1)..(296): unsure at all n locations
  Clone ID: PAT_TA_94149
ccatgcgattgctcttccnactactcccatggctcgngtcagcgnctcctctcaatacccnantctccgatacgttgcggtaatcttgcatantcccatantacaatgctccccggngtattctgntatnaanaggcctnattgantcgaggctattttccntgagatagggcttgttcaaaataattggagcggncatataagacctctggattgtttttaanaaaattgaaanaggtttntatggatattttgcttgaaggnggggggnnccggtanccatttcgncntaatag

SEQ ID NO: 94150 - DNA, 224 bp, Triticum aestivum
  unsure (1)..(224): unsure at all n locations
  Clone ID: PAT_TA_94150
cacacacgtnacgcaagcacgccacaggagagaccgatcgcgcgcgctcgcacgctccggnaaggcacggcggngccgccancaccaccctgagantctggcgccggganccacctgccacccgagacncgncaccccggacaactcgtttttacaantgtgcccgtgngcgcggctgggcctcggtccgcccgtctgcccggtctccacgtccggatggatcg

SEQ ID NO: 94151 - DNA, 300 bp, Triticum aestivum
  unsure (1)..(300): unsure at all n locations
  Clone ID: PAT_TA_94151
gtcgcgtctgggnacgtcaccaaacgcgccatcggngtcgagattaaaaaacanggtggnaacaaggatnatcaaanaanagggattcaatgtgcgtgtgggggcacgtgcagccatccaaggtgcaacgaggagttcctccacagggaagntcancaaccaacaaacttaatgggggggggcaangcgcgtggttgaggtcatcaaacaaccnaagaagnaagccaagcaagnccncaagcctgggttcaatgntgggnggggnaacaacntcccagacgggtcaacccccatcccggt

SEQ ID NO: 94152 - DNA, 301 bp, Triticum aestivum
  unsure (1)..(301): unsure at all n locations
  Clone ID: PAT_TA_94152
tttatgcccatttacacgtcatatggtaagtgatgtagagaacctacaaatagtgtacttttttctctctaacaaacacttcgaaagcaagtccttagtcttgagaaatactcgtctaatgcatgcaccagcacaaaagtcccctaggaacctctttctctctgtccaggttcagctagcgttggacagttgaatagtcctgtcacgacagcctattgtcggagattcagtattagatctgccgatacatttgcannaaaaaaaaaaaaaaaaaaagaaactttttttgcgacaaacaaaa

SEQ ID NO: 94153 - DNA, 242 bp, Triticum aestivum
  unsure (1)..(242): unsure at all n locations
  Clone ID: PAT_TA_94153
ctcgtgccgaattcggcacgaggtgaagacgtttcaaacaagttgaaaattcccgacatacaatgcacactcggcaagcctgaggtaatgcggcaccttcatgaggtcccttgatgagatctgtagcttcagtgagagctgttaaagatattagtgaaagtatccaatacttgcattctaaataattgtagacaatgatatatgggcaatcacgtaccanaaaaaaaaaaaaaaaaaaaaaa

SEQ ID NO: 94154 - DNA, 485 bp, Triticum aestivum
  unsure (1)..(485): unsure at all n locations
  Clone ID: PAT_TA_94154
ggaagagtagcatccatggngtgcatcaataccttgcagagctgctccatgttcaaangggncaaggctgangncaagaaagggnaaagccaccggcgcanggagcttcgggtgncgggcgtccacnttcatngacgggagngggctccngctcgggctcgancaaaaacccnacnccatcatctccngcgagtgggccgagaacttctncctcctcagctacgaagaactccgngcctacctccantcccagcaagnagaagcaanaagaagcaccttcccacgctgccgatnaataaagggggncgctccttcncgagggcatgttacgcccgtgcctgatggtcacaaaagagcaagcnctggtggaggtttgtntggcacttttcattctncctgncaagggcctcccccncttgttgacanaaactcgcaaaangcntccnggggtcgtnctnnaaaaancgaattgntngaagggggtt

SEQ ID NO: 94155 - DNA, 485 bp, Triticum aestivum
  unsure (1)..(485): unsure at all n locations
  Clone ID: PAT_TA_94155
ctcgtgccgaattcggcacgagaatctacgctcaattaaacctcttgacgttgaatcaatcattaattcagtaaaaaaaacacaccgactcttggccgttgaatctggattcccagcatttggtgttggtgccgaaattcttgcactaacgatggaatacggtttcgactatttggatgcaccaagctcaaagaataactggagccgatgtacctactccatatgctcagggcttggaggacctatccttccctaatgaaactctagtcgaaaatttcgctaaaaaattactgaaaatataagatgggaaaaataaaaggggtgtcaattgctggcttgtatttctaggattctttaacatataaatcaaaatcttttgtgcttttactggaaaaaaaaaaaaaaaaaaactcnaggggggggccgggtacccaattcgccctataagtgagtcngtattacgcgcgctcactngggccggtcct

SEQ ID NO: 94156 - DNA, 469 bp, Triticum aestivum
  unsure (1)..(469): unsure at all n locations
  Clone ID: PAT_TA_94156
ntcaaacgcaccgcttcctcgtgtccgnactaagncccaatcccancancancgccgctggtgctcggngcgatggngcaaaaagacgccgccaatgggaacggggncaacangcgcccgccgnccaatccctcccccatccggttctccaagttcttccangccaacatgcngntnctggtgaccggcggggctggcttcatnngctcgcacctcgtccncaagctcatggagaacganaaaaacgaggncattgttnntgacaantttttcactgggtnaaaagacaacctgnanaaatggggtnggtcacccannaattgttntcatccgtcacgaagtcaccgaaaccaatgntcgtgggggntgggncaaaatctaccaaacttgcttgccctgcctcaacaaatcttcttnaancacaaancctgtcnggacatcaagacgaanggtcatttgggancttgga

SEQ ID NO: 94157 - DNA, 479 bp, Triticum aestivum
  unsure (1)..(479): unsure at all n locations
  Clone ID: PAT_TA_94157
cctcgattttaaacaagctattttgtacacttccgctactagttgtatcgataacatgtccgatcaaattcatacgctccgcgaaggtttgaaggcgtcctggtttgggtgcgctctgacggcggagaaatgccttttcgggtagtcctttaaagatcttttgcgcaacaaaggcattagctttatgcataagctcttcaataacttcgacagatggagaagagttgaaaatatttcgctcaactagactgttttcatcatcaagctgataaatcagacgtaagggtgcaactttctcgtcagtattgagcctagtttcacgccagttctgagccacgttatgtaaatctctcagcttgcagctcccactttcatccttgctcttaagatganaatatgttatccaattcaagcgcgtgaaattttgctagagctcctttaaaaaggctcctggcccaaccaagtctcttcttccaang

SEQ ID NO: 94158 - DNA, 226 bp, Triticum aestivum
  unsure (1)..(226): unsure at all n locations
  Clone ID: PAT_TA_94158
gtatcctgccatgggttgnactccanaaatnctgcccantttgncggntcgagctgccatctgatgagacaaaaaacttgagngagcctaacaacgttggtnggttagagagcaaacatgangntgnaagaactgatggncctggnaacaatggtgggggcagtaacacanacgacagggagggcagtaacagaccntgggcccctgngtccntggtttaatgggc

SEQ ID NO: 94159 - DNA, 374 bp, Triticum aestivum
  unsure (1)..(374): unsure at all n locations
  Clone ID: PAT_TA_94159
ctcgtgccgaattcggcacgagcggtaactaaggtcgagggcctgaaagtcagagatcagagcgtagccgatacatggaataaagcccttggacttgcgtaagaggataagaacttcgacaagcccacaacaatcggtcttatcagccgcgtctatttggataaacaatattaacctccccatcgtaaatttctgagctggccgacccacagcttactatttgaatattcaagtaatgcattgccgcagtgcgggtggatgactgttgcaaaacagatgagtggttatttaaagcttcgtgtggtatggtggaatctanaaatatttataatagatgattacaatacactggttaccaactatcaananaaaaa

SEQ ID NO: 94160 - DNA, 463 bp, Triticum aestivum
  unsure (1)..(463): unsure at all n locations
  Clone ID: PAT_TA_94160
agcccttctactcgaatataatcttctcctatcaaaaataacttgaatcacaacatgaaccgaggcggcccccgtaaagtccttcttcctcccatcaacttgatattcaaattacttcaacaacgctcaactgtcatagtatggctgtacgaacaactagcaactcgtatcgaaggaaagatcaggggatttgacgaattcatgaacctagtgcttgatgatgcagttgaagttcggcaagctacgaaaactaagcgaagaaagcaagaagatctctaggccaaattcttctgaagggtgataatgtgtcacttatccaaagcttaaatggatagatgcagagccaatgaattcttttgtgaacaatttatgagacatgtgttgccnttgnaaatagcganttttgggacgagaaaaccggtctatcanaccaaggaaacgtgctttaattgntaatacaagt

SEQ ID NO: 94161 - DNA, 163 bp, Triticum aestivum
  unsure (1)..(163): unsure at all n locations
  Clone ID: PAT_TA_94161
ntcgtgccgaattcngcacgagctcgtgccggtcaagattacagcagttcanacangcctagggctccagctgagaagatcaaacaagtctccngncngcatgcccaatcaaganataaactttcctccctccnaagattaccaactganatcgtggganaga

SEQ ID NO: 94162 - DNA, 462 bp, Triticum aestivum
  unsure (1)..(462): unsure at all n locations
  Clone ID: PAT_TA_94162
gcacgagcggcagctgctcgaagagaccgacatgtcaccggccgacgtggcagagaacctgatgcccatgtcaaagaagaaaaagaaggacccgaacatgtgcttggcaggcctcatcgcggcgctcaaacaagccaagaaagacgcggtcacgactgcagcagtggcaaaggcgaaggaggaagaggaggcagaagcaaagaaagccaangagaaagaggaaccgaaggaagataaatgaaaggacaaacatgacaggaagccaggtagccaaccaagacatcaaacaagacaacccaactctcttatatttctttacaaagggagtatgtatcactcaccttattttcggntaaatatgtgtcactcaactgaaataaaaaaataatggggttctttttcatttgccntattaacacaagaangcgaccnntgtgntgttctattataaagaggagtgct

SEQ ID NO: 94163 - DNA, 489 bp, Triticum aestivum
  unsure (1)..(489): unsure at all n locations
  Clone ID: PAT_TA_94163
gcaaggtcntgccgaattccggaacgangganggtttggtggctactcaacaaanaaattggtaaccatccaactaagcaatccaaaagagccaatttgatntggcaagattggcaagaaaatgggaggggaggcaacttggtcaacctcccaaacttnaancaatgtnctggatttcctaaccccngcccaaaaagccaaatgctggctcaatgctcccgaggattcgaagggaggggtctcctaacatcctccccctggctggcctcttcctgctgctgntcccgaacccccaagcttacanacgggagggaaggggnaacgtngccccccgccggcggtcgactggcgccaacggcaacgggcctcancntcggncggnccnaagcccggtcnngcaancaaagnggacggggagnagcaactnggnccacaccgtccacaaaaaaatgggaactgggnaanaacaagtgggntnccgcncagaac

SEQ ID NO: 94164 - DNA, 499 bp, Triticum aestivum
  unsure (1)..(499): unsure at all n locations
  Clone ID: PAT_TA_94164
ttgggacattctatctattcatgtatatccttggcttacagtgcttcccgtgcctatccgtagcgaatatctcctattaacagtgattcccctcgcctgtgagcgcgtagggacgatgtgaataagcccatcccaaaagtccaccgcctttcaagccccagattgatcctagacgccaacgtgcccagccgcttccccattaataaacacgtcattacactatagtccggctttagaaaaaagacttcagtaattcctgcgtgcccgaaatttccctgacaaaagctccttttcgtcattaacacatttacgccaagaacttcagccattcgagatggcgtccaaactgggccttctcaaatcaanagggtcctggggtttactaancgggtcttccacggggngnatctccaacccttcttctttttctttanggtgcancaatgggtaaaagtggttgttgttggtcgtccntcccntggtcgtngggaacggggga

SEQ ID NO: 94165 - DNA, 492 bp, Triticum aestivum
  unsure (1)..(492): unsure at all n locations
  Clone ID: PAT_TA_94165
ctcgtgccgaattcggcacgagcttgagagagcgcgcgcgagatggnagcctccatgatnacctcgccgattgtggngccgacgagcgtcccctccctctcccgccggggttcctccttngccgtcgtctgcagnggtgggaagaanatnaangtcgacaanccccttggacttggaggcggnttgncaatcgacatcgacnccaacggcangaangtgggcaaaaagggcgtgtaccaattcgttgacaaatatggggccaaagtcgacgggtanaagnccaatctacacccaaaggaatggnctgaatctggtgaccgctacgccggcggaacgaanggggnttcttatctgggggggtcaacctccgccggggctcctcggggggggggggggtcctcctcgtctacaaaaaaaaaangcnctccgccggggtaaagagaaggatctacntgttntaaaaaaggccggggtntcttgcnttttatnnan

SEQ ID NO: 94166 - DNA, 191 bp, Triticum aestivum
  unsure (1)..(191): unsure at all n locations
  Clone ID: PAT_TA_94166
ctcgtgccgaattcggcacgaggcagtatccttaagtaatgaataaggggactccatatttttcaaaccaacacatangactgacacgaacnacaaaacanttcaaatgaacngtanggnaccaccgaccanacgacccagnataaaccancaggttgaacgccagggcaattactgagccaccgctccca

SEQ ID NO: 94167 - DNA, 499 bp, Triticum aestivum
  unsure (1)..(499): unsure at all n locations
  Clone ID: PAT_TA_94167
gagctcgtgccgaattnggnacgaggaganaangagcantccgccgccgccgggtggtccgtnacccacgaagctagatagataaagcanggggggcancaacgcgagtgncggtggctccctctccgtcangggtggcgntcancgcctcaaggaacgggaggtatgcgcttgcgcacgtggggcccgcgangcgaacgcatcccctcctcaaactgaancgccgcaactacncngtcgcggggtcctcgggggggggcaaagtctccccccgtccctggtnggaanggcaaaggatccnggcnggagtttgttngccccnggagggagttgncaaacggtggacgtcaatggggccttcttnttccggggagnggannaatctttcctnccggnaaacaanaatttanggantttcctcccccggaacgccggtcggtnaagcaaannntcctccctcctccaaaggccaatgggaantnccgangtctnngaaant

SEQ ID NO: 94168 - DNA, 176 bp, Triticum aestivum
  unsure (1)..(176): unsure at all n locations
  Clone ID: PAT_TA_94168
gtttttttttttttttttaagcaaaaaaacanagangccttggttaatcngnngaaaatagccanatattanacaaacaccaacttgtagngtgtanaaaanaaatccccaacncgaatcgcgctcananggaaaaanctatcaanccgggntactcaatctcacaanggggaaaa

SEQ ID NO: 94169 - DNA, 235 bp, Triticum aestivum
  unsure (1)..(235): unsure at all n locations
  Clone ID: PAT_TA_94169
ttccggttcgggttctggttcggttcgggttcggttcgacnagagangccgagtaactaancccaagtctanaggtttcggtacaagaggaaagtgagatncatggcggnagacngagtaccgctgcttcntgggcggnctcgcctgggcnaaccgacnncaanaaatntccaannaggncttcagncanaaatggntgagatcctccnacctccangattatcaaacgtantcc

SEQ ID NO: 94170 - DNA, 424 bp, Triticum aestivum
  unsure (1)..(424): unsure at all n locations
  Clone ID: PAT_TA_94170
acgggtgaccttgaggnttttaacttcactggggctggnggagtcnccatggctatgtacaacacaaatnagtcaattccaggntttgctgnagcttcnatngcaatcncttatnaaaaaaaatggncattgttncttaacanaaaaaacacaanccttaataaatatganggcaggttcaaggacattttccanccagatctatgnaagctggctgggnaatccaaatatgaagctggctggaatatgggatgaacancntctcacccaacgacatgggtgcctatgcnacttaantaacgaaaggagggctatgtttgggnnttgcaaagnaactatnacgggagattgtgcaanaatgatttccttaccctcaaaggnttttggnctcctttggggcctgatgacgtcagtaattgattgt

SEQ ID NO: 94171 - DNA, 260 bp, Triticum aestivum
  unsure (1)..(260): unsure at all n locations
  Clone ID: PAT_TA_94171
catcccgacggcaactccccctcgcaccgcatcgcccgngtcgccgngcacctcaaccccactcgcccgnanatggaggaggggcgcggngctgaaggcccgcggtgtgccgcgccaangggcggggcgccggggttnaaagtggngggtggtgggccgcggccggggggattnggttcagtcgctgncngctggctcatgagggatgaatcccgctncgtctccgctnccctccacctcctancgaccgntcgancaaa

SEQ ID NO: 94172 - DNA, 202 bp, Triticum aestivum
  unsure (1)..(202): unsure at all n locations
  Clone ID: PAT_TA_94172
ctcgtgccgaattcggcacnagtcggcaactcctctcgcccgggcagctgcttccaccccccgctttcanatttttaaacccncgacagaaatggnttccaactacgtggacaccacgggggaggagggaaggttccanncccaggggggngcancaccngggnggangtactcncanccgggggnnggtcnccgctcggcc

SEQ ID NO: 94173 - DNA, 403 bp, Triticum aestivum
  unsure (1)..(403): unsure at all n locations
  Clone ID: PAT_TA_94173
ggacgaggtaagaagcagcagccgcagcgcgacaccgcgaggaaaccctaccgccgccgacgcagaagcagccatgggtatcgacctcgtcgccggcgggaggaacaagaggaccaagcgcgtcgcgcccaagtccgacgatgtctacctcaagctcctcgncaagctctaccgtttcctggtgaggaggaccaagagcaagttcaacgccgtcatcctcaagaggctcttcatgagcaagactaaccgcccgccgctctccatgcgccgcctctccaacttcatgaaagggaangggggggaagaacattgctgtgggttggtggtacantcncagagtgngcaatgcggngtcnaangangttctcaccaatgantcgtttacttgntcntgaggtttcac

SEQ ID NO: 94174 - DNA, 471 bp, Triticum aestivum
  unsure (1)..(471): unsure at all n locations
  Clone ID: PAT_TA_94174
cgccgacgccgccgacccgcggatcgtcgccaccatcgacgagatctccgccaccacgcccgaccccgcgcgccgccgggaccgcgtcacgcaggacgaccaggccacgctgctctactcctccggcaccacggggcccagcaagggcgtcgtcgccacgcaccggaacctcatctccatggtgcagatcgtcatgaaccgcttccgcctcgaggactcggacaccacggagacgttcctctgcacggtgcccatgttccacgtatatgggctcgtcgccttcccaccggcctgctcgggtgcggggccaccatcgtcgtgctctccaagttcgagctccccgagatgctgcgctgcatcaacgcctacggggtcacctacctgccgcttgtgtncgcccatcctcgtccgccatggttcgcgcancccaaagncggtggcgcttcgggaaactgcgcaanggnggtctcc

SEQ ID NO: 94175 - DNA, 510 bp, Triticum aestivum
  unsure (1)..(510): unsure at all n locations
  Clone ID: PAT_TA_94175
ctcgtgccgaattcggcangagttctcgccccctcttgccccgtggtccccaancgccgtccgccgccgcagaggggagaggcggccgccgcccaccgccgcaagaccgccggccacgtcgcccccgccgggtttgatcccatggcgnccaagaggatcctcaaggagctcanggacctgcagaaggancctcccaccctcatgcagcgcaggtcctgtangttaggacatgttccactggcaggncactancatgggaccctcggacaggccgttcancggtgagcctaatttttggttgaacattcatttcccacccnattacccngngaggggnncgcgaaagggggtntttccgcaccaaaggtgnttccacccacagcatcaaggnggngggggggagncatttgggctttgncatttctnaangngaacaatgggnccccnnccttttgggcgagntnanaaggggcngtggcnggncaatctnttccantngtcgacccaaat

SEQ ID NO: 94176 - DNA, 374 bp, Triticum aestivum
  unsure (1)..(374): unsure at all n locations
  Clone ID: PAT_TA_94176
ctcgtgccgctcgtgccgaattcggcacgaggaactaggcncgaggttttttttttttttttttttttttttttttttttttacgcaacctaatacatcttctgtatattttttgcggtgaaatacncagcccaatacatgttctgtggttacaacttacaaaccaagatggtacaaattcatcatggtttcatgatacatgnanacgcagctacgtncaacaatacaagcaaccccgcagatactttgattgggncgncgntacagtacctatttatcngcnacagtncacatctatatggtacacacacaatcttaattaacttcagggttagtntatcctacgcnggnaaggctaagtttagtccatccgg

SEQ ID NO: 94177 - DNA, 380 bp, Triticum aestivum
  unsure (1)..(380): unsure at all n locations
  Clone ID: PAT_TA_94177
gtggnggcgaantnggcacgagntttccttccancctancccacaccgnggnggcggngggggcgggaggaaggcaaggatncgcgcctttgcttgngnggcagaaattggtgggcaatgnccaattcatataaagattacagtaaaagnaaccgttcctgtgngacatggaacttcaagtcccgatagtaagaaagcttgcccttggtttggtganngaaagaattgtangnagggtaaaactggcttccaacctaatcctgaaagannccctgncttgnacaaaaatggggnccctaantggggtaangggaanaccctccaaaacactggcttnntcaaacnaagtacnttntcnagggggggngncaaggngaaaa

SEQ ID NO: 94178 - DNA, 391 bp, Triticum aestivum
  unsure (1)..(391): unsure at all n locations
  Clone ID: PAT_TA_94178
agcttcccattcctcgccgccgccgccgcttcgtanccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaaaaggaaacccatggngctcgtcaagaanctgcgcaaggcnaaaaaggacgctcctgctggngagaaatcttaccagtgaggacacatcttngggggnggatcattgtccctgaaatgaatgggcaacccttatcgggtgnctacaatggggggggggg

SEQ ID NO: 94179 - DNA, 505 bp, Triticum aestivum
  unsure (1)..(505): unsure at all n locations
  Clone ID: PAT_TA_94179
gggctgcaggctcgtgccgaattcggcacgaggtgcctcctcctagcaagctatatacctacatagtacagccatggcccccaccgtgatggnctcgtcggccacctccgtcgctcctttccaggggctcaagtccaccgccggcctccccgtcagccgccgctccaacggngctagcctcggcagcgtcagcaacggtggaaggatcaggtgcatgcaggtgtggcccatcgagggcatcaagaagttcgatgaccctgtcttacctgccaccgctcagcacggaggccctcctcaagcaggtcgactacctgatccgctccaagtgggtgccttgcctcgaagttcaagcaaggntgggttcatcttccgtgcgcacaancgcatctcctggggtnctacnattgtcgngtnttgganaatgtggnangctgccctatgtttcgggtgcanctgncngccacacaaggttgantcaacaaggntggggggnggnccanggntg

SEQ ID NO: 94180 - DNA, 260 bp, Triticum aestivum
  unsure (1)..(260): unsure at all n locations
  Clone ID: PAT_TA_94180
ttncanctgttccgacgcacgaagtatccanccggngtttatgtacgtagctnaacgtccaatatatctcncaagaaaatcncaagctaggtgctctcgtgctcccgatnctttccacacggngggnggcttgnccgtattgaaaaatttctcaccangcaaccaaatgncnnccatgcgtaatgntgtccaangccggggntcatcgcgagcgcggggcancccgaagatngccagaaatggggnttnttggtnaagca

SEQ ID NO: 94181 - DNA, 323 bp, Triticum aestivum
  unsure (1)..(323): unsure at all n locations
  Clone ID: PAT_TA_94181
tcggaacaagaatttgacgcccgaacgttcgtcttctgctgacgatgtggaaaatatccggcagagtatgcgtctggcggggcaaatagctcgtcgatggaaggctggngacgtttatgctcctcatgacctacatcaggcagagcaagttaagttcaggcaaagagttgacgcgagcactgatatctttgatgctctggacatgaacccacttgaacattaccggnacttttctttaatgtctgaatggatgacccccatgggccgaattaaatcgcgtaaagaaacggggcttcgtcctgtcaatcaacgacgaattgcga

SEQ ID NO: 94182 - DNA, 417 bp, Triticum aestivum
  unsure (1)..(417): unsure at all n locations
  Clone ID: PAT_TA_94182
ctcgtgccgaattcggcacgagaacgcgaaaccccaantcgatggtcgccgccgccctcctccgccgctcgccggcggcgcgcgctctcctttcgccggccctctcctcccgcctcgtcgcctccaagccccactcctcatcccccgcgccgccgcccccctcatcgnngncagccaagcaccanagaccttctcgatctacccgctggggacccgggactccccgtcgaccaaangccccacctcaaagggactaacaacgggtgggacctctccggacatgcgggcccccatggtggctccgacgcgctcctcnaagatcaaaagaaacccaancaanaacccggtccggggnggggngggggcgggagcctngcccctcaactncaatcttgccncgcnaacctgcctccaatc

SEQ ID NO: 94183 - DNA, 412 bp, Triticum aestivum
  unsure (1)..(412): unsure at all n locations
  Clone ID: PAT_TA_94183
cagccaagagcagaccctcgcgaggntgttcttccttgtattgttcatcatcataagcccaagaggcaatccaccacaccacacactggggtagggtattacaccacaatggggggccgnaccagtataaaccctgtgtctcttgtgttgttctttccttggtttagatcctaatgaggcggaggagtgcaggtaggtangaggcgaaatctccatgcgnaccccagtgttcgaanctcangggtctgctgganccccganatctgacaatcatgcaggctctttnntgtctgccaaccgacgcnaccaggatctttgtcgtcatgaccgcnggacngtcaagnggagggcacataggcaagncaaactgngccttcctggggngctgancccatttgggtcagttngcntc

SEQ ID NO: 94184 - DNA, 500 bp, Triticum aestivum
  unsure (1)..(500): unsure at all n locations
  Clone ID: PAT_TA_94184
ctcgtgccgaattcggcacgagcctaaacgtccaatcactctaaggaatatcacaacgacgggaactgtttcctgtcagtcaagaatttgaactatcgatccacagtcaaaatggccaacccacttgatacagacatcggatctgaacttttcagcagctatgaagcagagctcaagctggtgcaagctgatttaaatcaaaaattagaccaaatcccggacttaggcggagaaccacgcaaagcggncataacatcagcagaacgaaccatcgatgaggccaatgaaatacttgatcaaatgcgccttgagaagcaaaatattccatcttccatcacaacgggggggtgggtcaacgcttccaccatcatgaatcggaccctttatactgcgagaaagnggggggggngggagncttaacaaatacaaacatctgctctttttgggaaaccnaatactccggattaatccgaaacnaatgtgcaaattaaaaacaagng

SEQ ID NO: 94185 - DNA, 392 bp, Triticum aestivum
  unsure (1)..(392): unsure at all n locations
  Clone ID: PAT_TA_94185
ctcgtgccgaattcggcacnaggtcatgttcaagctgattgcccgactcttcgtttaaacggagccagcattagtggtctctgctattcttgtggcttgccgggacatctagctcgtacgtgcccaagccctggtagtcatcttgccgtctcgggcgcaggtagaagctacagctctccacgaactggatttaacggaggatttaacactcgaggatacctctctggaccccgttcagctacttgctacaagtgtggaggcccaaatcattacgcccgtgattgtcaagctcaatccatgaaatgttatgcatgtggcaaggttggtcatatatctcggggngngttcatctccaaatggtggctcccctcaatacatctgggcaagatttg

SEQ ID NO: 94186 - DNA, 535 bp, Triticum aestivum
  unsure (1)..(535): unsure at all n locations
  Clone ID: PAT_TA_94186
tgatcccgacccatccaagatcctganactccctttatacattccgtgacattttgtgcgatctttaacatacgtgccttaccgcgccctgcttctctgcttctttgcttccctgatccagttacctgtaaccagaaaaaaaattgtatcctgtaagaagatccttctcgaacgcgacaaggnaagcctatattcttaaaatcaatttatccangtttttgtaaaaatggncancaaccagggacgcgtctacctctgaaccaacttttagattccttccgtgaaaagttgggccgaatcttgccancgcccattgggnagaccacacattcccgccaggactcaaaatcccganctccctctcttggacaanccaanangccccanacttcctggaantcacccctnnaaaaacaatnaacngtttcctgccagggttgngttaanaatggntttcgntccttaangntttgngcgtancttnacangacaaggattntcccaaccaagtcaangcaaacnaggatctggaggn

SEQ ID NO: 94187 - DNA, 273 bp, Triticum aestivum
  unsure (1)..(273): unsure at all n locations
  Clone ID: PAT_TA_94187
ctcgtgccgaattcggnacgancaactgcgctgctggaaagataancattantgtctgagtacgtgggctcacgcacctatggagggcggcagcgtcggcgtctccganagcaatgacggnggaggaggngggagggtnaccatgttcgtggnggtgncntgcatcaccgccnggcatgggnggggggccatcttcggctaacnacatccggatcgcnggcgggcgtgtcgtccatgnaacgccttcctgcctanagttntttccctgggcgg

SEQ ID NO: 94188 - DNA, 483 bp, Triticum aestivum
  unsure (1)..(483): unsure at all n locations
  Clone ID: PAT_TA_94188
atctgacccttgatacggcctgtaaaccacaaaagattccccgtttgatgcatcaccgatgcgagttttctcagatgaaatatttacagttgaggttggtctatattgaagaattcgataccttatctctgatctcttttatgaggtctgctcctttcattgagaagttagagctgcacttttgtttccctggntacgtgcgtttggcacaagaacttgaacctatcaggaagctaccggagcatctgttcaacaatttgaagagtttacatgttacaggatttaaagcatgcattggccaagttgagttactttcncacatgggtggaaaatgcccccgcantggaggttttangtacagataaatcaagcaaaatatccccctaataagggnatgaaaaagaacgcaaaaacctgtcgcntggattttggccaaaanaattggntnanaaggganccttggaagggaaaagntttccgccc

SEQ ID NO: 94189 - DNA, 235 bp, Triticum aestivum
  unsure (1)..(235): unsure at all n locations
  Clone ID: PAT_TA_94189
ctcgtgccgaattcggcacgagtcgtgacctccgtctcgcgtgccctcccctccctcccctcccccgtcgtgggcgaccggaagctcgccgnccactccccgtgaancccagccctagancangcggngctggtgnttctggtgcgagcgntggntcagntacncaccgggngggccatggcgaggtggaggtcgggcgaatgctgctggnaacggcgctggcgctggccngcgg

SEQ ID NO: 94190 - DNA, 265 bp, Triticum aestivum
  unsure (1)..(265): unsure at all n locations
  Clone ID: PAT_TA_94190
nccacgccgcagttgggagccaggcccccaactcttatcaaaccctaaaccaaaaaatacctcaaaaaaatccgcaaaatcacganaaaaaatctacctttcgatcggngatggcggccgcangcggcgagctcggcgtcngggggggggntccccggncgnggnggccgctgctgntgnggcggcggcttcttcgttcccggggacatcgnntgnacgtgggagacctcgaccttgagcgtgcagggacgcgcagctcttccta

SEQ ID NO: 94191 - DNA, 475 bp, Triticum aestivum
  unsure (1)..(475): unsure at all n locations
  Clone ID: PAT_TA_94191
caaggctgcttatctgccattttcatacctcgtgattatacgacattaaataaaaaacaaacaacaaaatccgaaatgacaatggaggaagagggccgaataccggccgtgatattctctacaaacctggtagtgaaagattcgcccaaagtcaagattcagcccaccccaaacgaccgaatcgattttttcctgactgaaagtcttgtcagaagaagcagtgctgggctgatcttggtcggaactcctgcattacaagagacttctcgactactgaccacgaagaaaatcatcaagactattcaaccccatancatttaacctgggggggcgnggctttccctcgatacactaaaaattttttgaaactccatttttagnnggggggggngggnnagcacgacccgctaccttctcttccaaacctgtatcaancgggggaggnttncggacgnaacccccaaacttnggtttn

SEQ ID NO: 94192 - DNA, 503 bp, Triticum aestivum
  unsure (1)..(503): unsure at all n locations
  Clone ID: PAT_TA_94192
ctcgtgccgctcctcctctcgccgccgccgccgacnggggggncgccgcanccgccatgtcagggaggaagaanacccncgagcccaaggaggagaacgtgacgctcggccccgccgtccgcgagggggagcacgtcttcggcgtcgcgcacatcttcgcctccttcaacgacaccttcatccatgtcacggatctgtccgggagggagacnctcgtccgcatcaccggtggcatgaaggtcaaanctgatcgtgatgaatcatccccttatgcanctatgcttgcatctcangatgttgctgtaaagatgcaaangagcttggtattactgctctgcacattaagctccntgctactgntggnaacaaanacaaaaaaactccaaggtcctgctnctnaaagnctgccgctttanaacctctntccacgtttctnncataaacatttgcncntatttcangattgtttaccccntgtcccaaaatnganaancaacccccct

SEQ ID NO: 94193 - DNA, 567 bp, Triticum aestivum
  unsure (1)..(567): unsure at all n locations
  Clone ID: PAT_TA_94193
ctcgtgccgnattcggcacgagaatcattatccccgttagttgcggtcataggtgcctatgtctcaagagtcgggccctcgaattgtcatctattaccagactcaagattcatgcccgacggttccgtttgttcaattcttccactgnattaccgaaacctatcacctttgtcactcatgtnaangtcgccgctatacatctcaatggacccaccaaggagaatatcacattaaacggaccaccgaatccctctcatcccggaggatantttacnactatgngggctgaancttccgnngcnacttacnaangcctacncggagtgtcaaagngtgccttgggtnatncctgccaggncgcaagcaanaanggttcttttttctcggacttgaccccttgacccaaccaaannccttttgaacctgggtncgaccgnntccaatttcagggnggncatggatgttccgggcaaaacntagaccctttggaacgngtccttngancctggcantgttttcaagnagnaanaatggncngctttaaattggcantnattttccgnnctg

SEQ ID NO: 94194 - DNA, 165 bp, Triticum aestivum
  unsure (1)..(165): unsure at all n locations
  Clone ID: PAT_TA_94194
ctcgtgccnaattcggcangagctcgtgccgcggacctttcaagtaacaaaaaaggatgggaagcactgtacaaggtgtgacctgggtcaagagaggancccaatgtgctaagatagncatanactcaacgtagtacaataacactcangggagggcagnaaaat

SEQ ID NO: 94195 - DNA, 429 bp, Triticum aestivum
  unsure (1)..(429): unsure at all n locations
  Clone ID: PAT_TA_94195
agctgcccagctctcaaaggctcgctccgaatcatcaagctagcagcctcgaatcatcaccatggngtctgccggccgccgtcccacggtggctcatgcaggatcgctctcttcttcgtcgtcgcggggggtcatcaatgaacaagctccgtctgccttggagcccgcccgccggcgancgccaantgcagggctctggntgctttcgacccctaaancggcccctgctgtccctgtcnacggggtgggtggcctgggtaaaaccctaacaccgggggcggtcgggtgggctcccctaaaagttaccnggctngcctacccaaccggtctggggtgggncnaaccccnaaanttaagaaggggggggggtgggaaccccccccggnggccgaaggacnccctgtcccccccaaaaaaaatnaantgcaa

SEQ ID NO: 94196 - DNA, 269 bp, Triticum aestivum
  unsure (1)..(269): unsure at all n locations
  Clone ID: PAT_TA_94196
gttgnagcccataagcacatgccaccatgcgtgtccctgcnggttgttgncccanagcgagagcttcttacanaaaatgcgatcaactagccagcaaaactgtcnccaggnatatggnaaagaaaccacaagcttcgcgagcctcttgggcagccaggtcccttcgtccggaatggtagtnacttgttcaatcccgcggggaatgcagagaaaaggcaaaagggccnaatggttaattgcnaactttggataactacctttggggaatc

SEQ ID NO: 94197 - DNA, 453 bp, Triticum aestivum
  unsure (1)..(453): unsure at all n locations
  Clone ID: PAT_TA_94197
ncgatctttgcagtcttaaaagtatttangctctancanatanactcgtgaatggnactttatttcccgattctagggacgaacagcttagctacgggttcaccgagattcacgcatcacgagctcaatgtcatacgaagaaaaatgaggaacagcgaatggagggaggtaaccaaagcatccgaataccaaggatagatatactcttcttaacagccggaattggtggatggagtgggaattaattggttttccgccatgaaagatatgtgtctcgatgtcgttgaggccgttacctggcccaaatacaaaatagctaaagttggtncgctccgccgagaccacaannttgagcctacnaagaagaaaagggcttggccgangggggcanggttacttcagcccatggaagccatcnnccggggaaccangcttttggaaaaanggnttttn

SEQ ID NO: 94198 - DNA, 455 bp, Triticum aestivum
  unsure (1)..(455): unsure at all n locations
  Clone ID: PAT_TA_94198
ctcgtgccgaattcggcacgaggggaaactctcttggtttcccttgtccaacttggacatgatcatatcataagtgaaggtcttcgacgctttgacaccttaatccatgatcacaactcttctatcctttctcctagtaccagaaaggctgcatacctatctgtgatgcaaaatgttagtagttcaaatagatccaaatatgattctcttcgacaactctacaaggacttgggtgacgaggaggaaaagttacgtgtcttaggcacattatcttcttgcctggataaggatattgttcttgagtcactgaatttaatattcactaatgagggcccaaattatcatgcagtttatgttcttaaaggnattgggatagatgcacgtgaaacgacatggagttggttgaaggaaaattgggaccgtgtcctgaagggtgttcccaaaagaganctact

SEQ ID NO: 94199 - DNA, 299 bp, Triticum aestivum
  unsure (1)..(299): unsure at all n locations
  Clone ID: PAT_TA_94199
gagagagaccgttaaaagtgatttcgataccgcctttgctgggntgcaaagtataaacaagccacangagcgtactagtaggagaagctcttctangtcaggatcagtaagaaatattaatacttcagctttcctaaaggaattccctccaatatctaaattgggaaatgaagatggtgaaagcgatagcgaaagcgaaggtgttggctttgttgacgactttgcaccaccatcacctgggcatttgtgaaaagcgaacatactttcggnggaattatatgttcgagagaangaaagtt

SEQ ID NO: 94200 - DNA, 167 bp, Triticum aestivum
  unsure (1)..(167): unsure at all n locations
  Clone ID: PAT_TA_94200
cgctgctaaggcgggntggtgatgttgcgcaancaccaatgggttcaattgctcaaaaatctcaccttgggaactgccatgattgctcaagtcggcgccatccttctggtcgctgccacctggggangctggtgttcctcaaggantttgnccttttctcaagccca

SEQ ID NO: 94201 - DNA, 459 bp, Triticum aestivum
  unsure (1)..(459): unsure at all n locations
  Clone ID: PAT_TA_94201
aggcgcgcatccaccgttgctagcaaggtcgaccaagcagcaccgagatgggtgntgncttctcctccaccgtcggtgncccggcttctacgccgaccaacttccttgggaaagaagctcaagaaagcaggtgacctcggccgtgnactaccatggcaagagctccaatgccaacaggttcacaagtcatggcagcgggaaacctcnacgagaagaggaacacggacaagtgggagggtcttgcgtacgatatctccnncgaccagcaggncatcaccaaagggaagggnatcgtggactcgctcttccatgcgcccacgggcgacgggacccacgaggncgtcctcaanctcctacgagtacgtcagccagggnctcaaagaagtacgacttctacaaacaccatggggagggttctacaatcncctcctgctttcatgggagnaancttgttgttcn

SEQ ID NO: 94202 - DNA, 463 bp, Triticum aestivum
  unsure (1)..(463): unsure at all n locations
  Clone ID: PAT_TA_94202
ggttacaagttatttttgntanantgctaactttangncctttctttgntcttctacgctccaaaaaagtccagaatgcttcatggggantagaaatantaagagntctgntattaaacttgntaaccaaacgatgaattctaaaacattattgcgccctctacaaaaggtgnnaaagataccaaagaggtcttacacaancaccaagactggncanaacacaacgctaaacagagagacaatgctgncctcgatgacaaccttgaagagaccagngacatcttctcgaattcctcgccnacttttatnaaagcggaatagacgagcttaaggnagggngggnccttcantgggctaggctagaatcacatcaaaggtacactcactatcaagaggaattttgccganaggatgggnagcancttatcaacccaaaagaaatacgcggnaagaaagacgggag

SEQ ID NO: 94203 - DNA, 213 bp, Triticum aestivum
  unsure (1)..(213): unsure at all n locations
  Clone ID: PAT_TA_94203
natcttgctgagagacaacctgattgcgccgtcaaccaancgaaatcgtcgctaatcatgcaagtttgtaggaacttccgcacggnaaagctggcgtctaccaacantattcgtggngnatcaattagacgggtctcaaatattgccattacacggncaggnaagcctatactccnaacacaaggtggganatcatctatcggtggncataca

SEQ ID NO: 94204 - DNA, 494 bp, Triticum aestivum
  unsure (1)..(494): unsure at all n locations
  Clone ID: PAT_TA_94204
tatgcaccacaatcataggtcgccgacggggtggtctggncgtccggcacacncgggtctggcctcacacaaacgcaaactgcaaagttttatttntaagcangcccttctgagcttgcacgtggacctcacctgtgggactggtactcctgcctcctgcacttggggaaaangggcancggagccagcggcggtgtgatnanccccggcgcctcgttcaatgtccaaagcgtgccccggcggggagttcccagtcnaaagtggggcacaangctgggggagtgcgatntccaacaccgggatcnccgaagctgatnccgggggnaanancccgcccggccgggcggccnaaacggggaaggagntggttatccntttccccgnangggnccaangncccctngcgcngcttggcgnnccgcccaangnaaatccgcttccgngncaagnaattcctcccggnccggttgctcccccacnccttggccggggtg

SEQ ID NO: 94205 - DNA, 195 bp, Triticum aestivum
  unsure (1)..(195): unsure at all n locations
  Clone ID: PAT_TA_94205
ctcgtgccgaattcggcancaatccgcccgcttgngctcnagcgcatccgccgaaaccgaggaggantcttctccacnccgccgccgcctcctcgggntctgcctcctcgggctctgcctcctcttcgggcgaggggagaancggtgcttatagctcaaaagggnttaaccttcntgnccangaatatgtatttc

SEQ ID NO: 94206 - DNA, 466 bp, Triticum aestivum
  unsure (1)..(466): unsure at all n locations
  Clone ID: PAT_TA_94206
ctcgtgccgaattcggcacgagctcgtgccgcaacaacagagagcattctaccaccgcaccgcacgagtgaagtgagagctttgcacgaaaagttcatcaagcgaccatgaagggnaccaagctcgcggngatnctcatcctccaggccgtcctggtcatgggagtcctctcacacgtgaacgccgactatttccccaagtgctgcaacaactgcaggtccttctccggggtcgacgtctgcgaagacgcccancccaagtgccccaagggctgctcggcgtgccgcgtggtgtcnacgagccccgaaatgtggcgctgcgcggntatnaaatccaacgtcgacggnaactgcggtggggcctgcaagaagtactgatcgggtcanggcaacatgatatgttccgcctaaaatgaaataaaagctcanacgaagatgagcagcgtcatcgcggcctatgcggtgtn

SEQ ID NO: 94207 - DNA, 224 bp, Triticum aestivum
  unsure (1)..(224): unsure at all n locations
  Clone ID: PAT_TA_94207
agctcgtgccgaattcggcacgagaacaactcancaagcgtgtgaaagagatgaagcangggcagatggtttctcttgtggntactcttgaaagaggagtaggaaagaanctggnggggagaaggagctcnaggtggaggcgatgaacaagaaaagccaggagctgtatgaacagatcaagacaggtcgccatgcaggtccagtcatgggantcggccgcgctc

SEQ ID NO: 94208 - DNA, 417 bp, Triticum aestivum
  unsure (1)..(417): unsure at all n locations
  Clone ID: PAT_TA_94208
ctccgggatnaagccggggattcgcgggccgtcgatggtganggggggnctcancngggtcctgggaggggtnangtacncctancaaaantccgccggacgcctcaaggggttcttccccaanagaanccgaggtcgcgcgctacaantacaaanctgtantggnaggaggggccanttctcctcgtctctctaacgcaaatgggnanaacctttggcgtttatctttctctaancctcncgtgagcaaagtgtgggcttgggggaanaaaaggggtggcttgctgcacantaatgaggaattcaagcnnatgagtttactcgctttgntatgacctgggcaaaanttggncgccattttgggaaacttntggaaagggggaacttttgtattatgaaatggnttatagtgtnccc

SEQ ID NO: 94209 - DNA, 448 bp, Triticum aestivum
  unsure (1)..(448): unsure at all n locations
  Clone ID: PAT_TA_94209
ctcgtgccgaattcggcacgaggcgcgccggcgattgccggctgcagcactccggcgggccgttcggcgagaacatcttctggggttccgggcagtcgtggacggncgccgacgcggtgaagctgtgggtggacgagaagcagaactaccatcttgacagcaacacctgcgacgccggcaaggtgtgcgggcactacacgcaggtggtgtggcgcaagtcgacccgcatcggctgcgcgcgcgtggtctgcacggggaaccggggcgtcttcatcacctgcaactacaatcccccgggcaacttcaacggtgagcgcccgttcgcgttcctcacccttgacgccgaagcctaantacgtgcgaagtgagtgtgatcatacatgcaaacgtncntgcgtgtgtttatgttttgtgtgggttgnataattttatacctctacaaatgttt

SEQ ID NO: 94210 - DNA, 485 bp, Triticum aestivum
  unsure (1)..(485): unsure at all n locations
  Clone ID: PAT_TA_94210
ctcgtgccgaattcgggacgaacctccggcgcctaacaggccgcctcccggagctctatcgaggagaagcgtcgccgccgtgggcantctgtgggtgcggactcacctgctcggtcngatgcgtcaanaagaccgacgtccgtcttctactacaccaacggcatcttcggcgtcntccacctcggctgctccattcgnananccgtcgncgtcctctgtcctgggggncaccaagccaagcagccgagtccctgtcncctgagtcnncccccagttcccgtcatgntgtccaccacngnctgagactgcgncangcttcntgnngacccaagagttctaccaangacctcctgcgntgggctccagcatgccaggnnatcggacccgatgggacttccgcgccggggcttgtttnccttggncgnctccggagggcgtcctgnttantttggancgngggancaaggantctgctgctncggtng

SEQ ID NO: 94211 - DNA, 268 bp, Triticum aestivum
  unsure (1)..(268): unsure at all n locations
  Clone ID: PAT_TA_94211
ncaggacacgcccacggnatacgcacgtacagctcgatcgcaatggggtcgctcgtcgccgtccagccggtcgccgtgnggggcctgtgtcggcanctccatctccggccgcaagctcgccgtccggncgcctccgccgccgtctcccgctccacccgtatggttctcgggggggnggtggtggccaagtacggggagaagagngtctaattcganctggaggacatcgccaacacnagggggcantgggacctgttnngcagcgacg

SEQ ID NO: 94212 - DNA, 460 bp, Triticum aestivum
  unsure (1)..(460): unsure at all n locations
  Clone ID: PAT_TA_94212
ttctactcctccacacaagtgaagtgagagctttgcgctgaaagttcatcaagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtgggnccctgcaagaagtactgatcggttcatgccggcatatgatatgttccgccnaaaattaaataaaaagctcngacgagatgagcaacgtcatcgtgcctatgcgtgtgtgtgtggccaacaaatatgtataccantatgtcgtgtcctcg

SEQ ID NO: 94213 - DNA, 532 bp, Triticum aestivum
  unsure (1)..(532): unsure at all n locations
  Clone ID: PAT_TA_94213
gntagtcatgggatcttccaagagcantcttgcaatgttcggcactggncaataaatcaatggncgtggggggtggacgtctcnggcgcaaaaaaaacccggcaagganttccgtcaacctggcaaaacccgccccccgcgccgtgggacggtggtccgggcccggtgggggtgngggacaaacaaacntgggccaaggtttttnngaaggactggggcgggnggcaaacgccgccccggcggatttgccgggtccnanncaactcccnggcgggggncggtttcngtttgaagaaacaatctttcttggggggtttncgggggcaaatccctgggaccgggnccggccnnaacngcccggttgaaaaacntgttgggggtgggggcggangaaaancaaaaaacttaaccaatcctttggggaggnaaaacaaaccttgccggaacngcccgggcaaaagggtggttgngggggcaacttacaaccacaaaggtgggggtgttgggggggnaangtncaanccccgccaat

SEQ ID NO: 94214 - DNA, 401 bp, Triticum aestivum
  unsure (1)..(401): unsure at all n locations
  Clone ID: PAT_TA_94214
ctcgtgccgaattcggcacgaggagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaaagctgcctatgttcgggtgcaccgacgccacacaagtgatnaacganggtggnggaggtcaaagaaaggagtaccctgacgcgtatgtccgcatcancggattcgacaaacatcgccaaggtgnantgggtcaagcttcatcgccctttaaagnccaaccggggcttgccnaaggaggtcccgggcaagggcctaaaacaagctca

SEQ ID NO: 94215 - DNA, 441 bp, Triticum aestivum
  unsure (1)..(441): unsure at all n locations
  Clone ID: PAT_TA_94215
gttctgcgataaatgaatatcttcccattgataaatcttcttggntaaatattcgaattaaattcataacctccgtaatatctgtaactttgcaacatttgatccttggaatcttcgaaccctcgtcttcgtcgaaactgactcaacctccacagcttaatatcttcgtaaatccgtccacaagaaggagagggaagaacaccactaacaataaccttcaccaatcctcagctgacctcatgggtgattcctgcttcagttattccaagggcatacatgctaacaacccccaattaccttcttcttcgccatttttttctctaccaacccaagcaaaacccacctttccaacttctcaagcaaaacccacctttccaacttctcaagcaaaacccaccttaccaacttcccaagcaaaacccaccttaccaacgtcgnagg

SEQ ID NO: 94216 - DNA, 233 bp, Triticum aestivum
  unsure (1)..(233): unsure at all n locations
  Clone ID: PAT_TA_94216
acatgccctccttggcctcancggcttcgccgtcgcttgtgtactttccgagctgcagcgagcgagttggccttggaacgcancagcagcgcctcctgcgccgccttgacattctccggacggccgccccacgtcttgaggnacgtgttctgcancgccctggcgtatganaagganacgtgncacnggttgggcccctggttcatgncnttgaggttgancgtggcctccac

SEQ ID NO: 94217 - DNA, 449 bp, Triticum aestivum
  unsure (1)..(449): unsure at all n locations
  Clone ID: PAT_TA_94217
ttagatcttcgctttctcttgctgcacgtagctgtctcagttcataaatacctagctacattttacctcatataggatgcaattttggttagtaaaaggaggccttatagtcaaaggcaatattttctaagttctagccaactttgctactcatgagaatcatcgacaagttacaattttccttaggaactattcaatactttttttaatttgctcaagtaactttctagaatcaccaagagtcatcttgtcttatgaaatgcttcaaacttcgcatgtattcttgagaattatattaaggacctgacacttgggatgtgatctatctctgaatctccaagtggnataggagcgattttacagactgaaagataacaaagtgtgtaggtccattcttacaagttgatgttcgttctcttgggacaccaaacctggtaattttgtaattt

SEQ ID NO: 94218 - DNA, 224 bp, Triticum aestivum
  unsure (1)..(224): unsure at all n locations
  Clone ID: PAT_TA_94218
ctcgtgccgaattcggcacgagatnatccataccctgctgggagaacatccctggcacgancancgggtacatgantggaaccgtgggagaaacaacanttggngngcctacctggggngggcggatnggttcgcccgacncctccgccggcggggaggangaatgcgcgttgctctgggtttgggcgtcccgcttccgccatgggagacagaaaaaagggggc

SEQ ID NO: 94219 - DNA, 342 bp, Triticum aestivum
  unsure (1)..(342): unsure at all n locations
  Clone ID: PAT_TA_94219
aaatcgcctcctcacgtttccggttcggattcccctcgcgtcacacgctccccttcccctcccgcacgctctctccctcgcgctcccatggggtccctcttcaaggctcgccggnggggatngccggagtacgaaggggacgacggcgacggatncggattcgggcggggcaagcgccgccgcctctcgccggangagggcgcgctggtgccggcggaggtgggcaagaagccccgggtggntctccaacatcgtcaccgggggcaagcgggtcaatatnctccggtgctcttctcctcctccgaggaagcaaggcctccggggacnaaggangaggnagga

SEQ ID NO: 94220 - DNA, 459 bp, Triticum aestivum
  unsure (1)..(459): unsure at all n locations
  Clone ID: PAT_TA_94220
ttttttttaaataagcaaataaatagatatacatatgcataatgaaaagaggatacagatgtgtcgcaaaaaaagaaaagatacagatgcatctgtgatgctattgttcagctaaacataggttcctgaatactatatttaccattaattctgaagcttcaaatgaaaacagtatcatattacccgtgtattgcatagtcttgcttcatgctacacttatttattaacaagcaggcactacaagaagtgaactgatgaaggaagagggatccggaggcgtggggatctgcactgctccatcaagcatttgtgtcactttaagcatggttggcctcatagtcggctcctcctggaggcaccaaaggggcgacagccacgaatcgctctgcctttttgatgttgaagtttgcctcatcgtcaccttccaccancaagtcgatcctcccacatctgtaanaa

SEQ ID NO: 94221 - DNA, 461 bp, Triticum aestivum
  unsure (1)..(461): unsure at all n locations
  Clone ID: PAT_TA_94221
gttgaagaccgcattgaaccatcccattcatcgcacccatcaaagtcaagcaaannaaataatcctcataaaagcgtcgcgtcgcgtcaacaccaaatcaactaatatagacatcccgatcgccacaatgtcactcttcccacgagcatttttgcatcaagaccagtcctctagcccgaccatcttccgactgatagacgagatcgaccaagtactcccgcggtgtggaccgaaacacccatcaaatcacanngtcnttcacacctaagttcgacgttgaangagctcggagactcgttttgaactacatggagaagctacctggtattgatnaaaaaaagacgtcgacatcgagttaacggangcggtaacactcacgggtcaaaggccgcattgancgncantttnccaaagggaaacccaaccaactgggtttcnttgaagggnnaaagccccaaaac

SEQ ID NO: 94222 - DNA, 401 bp, Triticum aestivum
  unsure (1)..(401): unsure at all n locations
  Clone ID: PAT_TA_94222
aaaacccaagcccccaaccctaacgangactgaaagangaggaggnggnggcaaccccgtcnaccggaggggagatggtgttcttcccgctgctcgtgggggcanagctcgacgggctcancaanctgcaancccgcggngggtgngacgaccccaactacccttactacttnaaactgcggtgcgaagagctgcggggagacnagcgccaaaaacanctgcgtctccctcnacgangtcntccaactgcccactggnaaaggnancgccaatctcctccaaaantgcaagttatgttngangganggatnaattgtnatnantcctgggnaaggaanaacactnacnggtgagcaaagccaaaaagggggaanaagacctgttttgatgggctttnaatg

SEQ ID NO: 94223 - DNA, 495 bp, Triticum aestivum
  unsure (1)..(495): unsure at all n locations
  Clone ID: PAT_TA_94223
gcaggnattcggnacgagaaaacattatcacataaattttaattacttgaaaatttcaactggacccttaaacatcctaatttcaacctaaagaaattaagggggggaagtcgctcanaaaacaaagctggntatttcgataaagctgaagggnctcctcgaaagaaaacaaaagtatctttattggtccggngtccgacatgtcaagcncccannaaatgcacgaaatccggacnatcccctacgtgggcaaagctggtagtccttgatgggcaaaaaacaacaaaggggcccgtccgngctaantaaaagggttttaatttctggatggcgccaagagnaacgaaatggccttctttccaataacgtncaaaggggaaaatgtagggggtttgtnctttacaaaacaancgaaccnttaaaagaaaatcccggtggacaaagaatttttgggnaaaacaaaaggtccccctggcaancccgccctannaagct

SEQ ID NO: 94224 - DNA, 459 bp, Triticum aestivum
  unsure (1)..(459): unsure at all n locations
  Clone ID: PAT_TA_94224
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgaagttcaagcaaggttgggttcatcttccgtgagcacaacgcatcccctggggtactacgatggcccggtactgggacaatgtgggaaanctgcctattgttcgggattgcacccgacgccaacgcaagtgatnaaacgaggtgggagggaggtccagaanggngtacccttgacgccctatt

SEQ ID NO: 94225 - DNA, 441 bp, Triticum aestivum
  unsure (1)..(441): unsure at all n locations
  Clone ID: PAT_TA_94225
ccgacctccacgtccaccagttcatcaccttcttccaggcgtccgagtccctccgccccgccttcgaagggttcgtctccggcatccggtccccggtctgcatcgtcgccgacgccttcttcggctggacggccgacgtcgcccgcgcgcaccgcgcgttccacgcggtcttcctcaccggcggcgccttcggcttcgccgtcttcttctccgtgtgggagcacctgccgcacacgctcgccgccggcgacgagttccctctgcccgatttccccaacgtcgtcctccaccgcacgcagatcccgcggtatatgctcccggcgaccgggtccgatccctggacgggcttcttccggcgggtcatctcgctttgccgcaaagaccgatgcggtccttggtcaacactgtnnaagaagctcnaaggggggggcccgggaacca

SEQ ID NO: 94226 - DNA, 445 bp, Triticum aestivum
  unsure (1)..(445): unsure at all n locations
  Clone ID: PAT_TA_94226
gatcaatgctcatcatttctaccctcagttactcatggttgatggaaatgggttactccatccacgaggttttggtttagcatgtcatcttggtgtccttgcagacctgccgaccatcggagtgggaaaaaatttgcaccatgtggatggtcttgaccaatctgaagtcagaagacagcttgaagctgaaggaaactgcaacaaggaatgtatttcattgactggacagtcggggacgatatggggagcggcaatgcgttcatcccctggttcattgaggncaatctacatctcangttggtcatcgcatttcgctcgactctgccattgggataantgaagtactgctgcagatatcgtgttccagancctacacgccaggctgatataagatcgaaggtattcctccaanagcaccaaanatttcatgcagttannaagggnc

SEQ ID NO: 94227 - DNA, 447 bp, Triticum aestivum
  unsure (1)..(447): unsure at all n locations
  Clone ID: PAT_TA_94227
ggtctttctcctctcgcccctcctttttataaatcgttttcgaaccttcaaattacgactctgtcttggtattctggctttgacagctgcagtgtgctttggagtggtggcagttgtccaagactatcatcggggttctggtgaaatgcttaagtcaagccaagcttggctcagggctaggtattcgtgctgaaagtggtcggcgtcttctatcattattgtggattaactttggactaatgatcgtctccgtcgatggcccttctancccantgtttcaaaagaagtatttgtccggaaatcaacatcagagataaaaaagcaacatgattcaagaaaaataataagccgaacctaagttaataaacatttctgtagctgactaagtgggnagctaagtcttcaagaggatgctnagcaattaagagaaatattatcaacgtggtt

SEQ ID NO: 94228 - DNA, 457 bp, Triticum aestivum
  unsure (1)..(457): unsure at all n locations
  Clone ID: PAT_TA_94228
ctcgtgccgaattcggcacgaggcggcttgcattaccttcgcaaaaaactacctgagactctcacccggatcttgttattcattttttgataaaacccgactgaaacgagagagttaaactatcacatagtccactaattccattgaaacaaagataaaatcttttgcacacgacggcagcaatatgaaagtctcaagtcttctttcatatgcagcttttttaaattatctgttgcctgtatcagctgtattacctgttacaaattttaaatgttggaacaaggttatttcttgcgcaatcatacaagaggcaattgaccatcaatatgctaaaatgggaaaacctaagtggagttaaccgtgtccgagaaacattttccatagcacaattccacattaaatactacactccaataaaagtttatgatgtcacaatcaaatgtngcatttacggggn

SEQ ID NO: 94229 - DNA, 390 bp, Triticum aestivum
  unsure (1)..(390): unsure at all n locations
  Clone ID: PAT_TA_94229
tttggaggatgtcttgcaactgtggatncggttgcagctgcggntcaaactgcaagtgcgggaagatgtaccctgatntgacggagcaaggcantgccgcggnccaagtcgccgccgtggncgtcctcngcgtggggcctganaaaaaagaggggcaattngangtgggcgncngccaatccggcganggctgnanctgccgcgacaaatgcaagtgcaacccctgcaactgttnangctgcatgcactccctctgatggggtgagagtnaacatngaataacgaancgtccctctgatntgatggangtccancaaagagtgcgtgtgcntgtgcctgtgggttanttgctcgctctccgcctaaggatctgcccttgggtgncccttg

SEQ ID NO: 94230 - DNA, 422 bp, Triticum aestivum
  unsure (1)..(422): unsure at all n locations
  Clone ID: PAT_TA_94230
ctgacaagagacacgttgccattgtcantaccgccagtcttccctggatgacgggaacagctgtaaatcctttgtttcgagctgcatacttggctaaatcttccaagcaatacgtaaccttgatggtgccctggctttgcaagtcagaccaagagctcgtctatccgaataacatgacttttagttctccanaagaccaagaaacttatataaggaattggctggaggaaagagttggatttaaaaccgacttcagaatatcattcnaccctggaaagtttcataaagaaagggngaangtataattcctgctggggatacttcacaatttataccatcgaangaagntgacattgcaattctggaagagccngagcacctgaacctgggtaccatcatggaanagccgttgggcctgnata

SEQ ID NO: 94231 - DNA, 453 bp, Triticum aestivum
  unsure (1)..(453): unsure at all n locations
  Clone ID: PAT_TA_94231
agaacggctggggcaacaacgaagcacaaatgtacacacaaaatctagcgaattgtttctttacttccgataacaagcttgttgtgcgcgccatttccaagccagacgcagctgaagataagtacacttcancacgccttgtctcgcggcaaactttggcgcgggaccgagggtgtgtgacggctaatttgaccgctccaagtgcaccaaggtatttggccaactttctggatgctgccgtccaagccaagtacttggcctgtagacggagaggtggatatctgtgaactatggaacgggaatgccaaaaatcacaactgcgttcaatggggnnactacaacgatnagggataaggngaagcatccgtgtcgtccgnaacaactatgaacgcctcctacnagnccttgcaccaaataatcctttttgtgtggggancaaggcancccagnggg

SEQ ID NO: 94232 - DNA, 477 bp, Triticum aestivum
  unsure (1)..(477): unsure at all n locations
  Clone ID: PAT_TA_94232
ctcgtgccgaattcggcacgagctcctgtttccgcccaccttctccggctccggngccggcgaacccaccgcggatcgagcgattcctccgatcaggagaggccagccgggaggaagagcacctacgcgggagganaggagatggggctcacgttcaccaagctgttcagccgcctgttcncgangaangagatgnggatcctgatggtgggtctcgacnccgcgggaaanaccaccatcctctacaagctcaagctcggcgagatcgtcaccaccaatccccaccatcgggttcaatgttgnaactgtggttgtacaaagaacatcaacttcantgtctgggatgtcnggggtcaggacantatcaggnnactgtgggaggcattacttccangaaacacacaaggggtcctcaatcttttgnttgnggggnaagcaaacnattatngggaccgntgtttgttgnnaggcaaangg

SEQ ID NO: 94233 - DNA, 454 bp, Triticum aestivum
  unsure (1)..(454): unsure at all n locations
  Clone ID: PAT_TA_94233
ctcgtgccgaattcggcacgaggtgggctcgggctggatcgggttaaataccataaaaatcgtcccacctgaattacagtaccagctcagacttcactcatagatttgaacttgtcgtctaatcttaccacaggaaccataagattatctgagacttttgatgaatgagtccattctctcgcgactatgtttatgtcatcatgaatacgggttttaattaaatcagccattttaagagaaacttgctggttttagaggataggtatacgaagggtagtttcgtccgcgaaattcaatttgggtgtacgactcanggtcaaaatacggctgaaattatgacaagcgcagtcggtgtcatccttcgagaggggtaatttaagattgaagtgagaatcatcaatgttgnttaatatttagcttcattacttcagtcctccnatccgtataaatcaat

SEQ ID NO: 94234 - DNA, 284 bp, Triticum aestivum
  unsure (1)..(284): unsure at all n locations
  Clone ID: PAT_TA_94234
gcctatgaactatctacaaccatgcattcattttgactggattcaaacccaaacatttgtcacaaaaacagcaaaccttttctcaancctacagnagctatctaaattctggaangagacccgaccagcaacagcaacagggaaggggagaccgaagaaagaactacacaaatggcgatcaatccatcgttgccaactctcttcttgcatcaagatggnatgattgctcgatcgccatgaaccggangccgaggccgtcatgccgtcggcggcgccgagcagtt

SEQ ID NO: 94235 - DNA, 430 bp, Triticum aestivum
  unsure (1)..(430): unsure at all n locations
  Clone ID: PAT_TA_94235
ctcgtgccgaattcggcacgagcttcttgcataattttcatctgcgcaacctctcgatcgaatcgcctcaactgtagccgccgtgatggaggagccaccacttacacngncgcgcaacaaggccganganatcggggngccgccgacaccgcgggaggccctcaaaacgagctcgctctccctgcagcgcaagaagctcggctcccacttcctggagagcgacgagcgccgccgcttctacaacgcatcctcctcctccgccgcantgggcacgacgccgctggacatccggggcttgccgatcccaaancgcgacctgccgcncacgggcggctgggtggngggcttcttcancttcnggcaaccaaacngcgggancggatggnctactaagggcctcaacntcaacaatgggtggtcctcatgttca

SEQ ID NO: 94236 - DNA, 325 bp, Triticum aestivum
  unsure (1)..(325): unsure at all n locations
  Clone ID: PAT_TA_94236
ctcntgccgaattcggcacgangcccgatcccntctggccccatcacatcaccagagcccnagacgaaaccccnacananatcnatccatgccggantaacgcggcggngactggactcctctcggcggcnaaacaaccaaccactgattggttcaatctttttgtcggancccattntccnngactctacnaaaaaggggggggccgggggaacnataatctatattatccgtcagtcanccacaaaatgctccggctttaattatccgcggcggnggacggcggcgatggncccncatntggctcgttcacggcccgccactg

SEQ ID NO: 94237 - DNA, 158 bp, Triticum aestivum
  unsure (1)..(158): unsure at all n locations
  Clone ID: PAT_TA_94237
ccggaccaatgccactctaaccccacgtaccctctctatcccaaccctatcgcggcggcggcgtcnatggcgtcnatggcgtcnatcccgtctgacnangtctcccanaacngccacngnaacgnaaacntggcatcccctcctctcnccaatctccc

SEQ ID NO: 94238 - DNA, 209 bp, Triticum aestivum
  unsure (1)..(209): unsure at all n locations
  Clone ID: PAT_TA_94238
caaatattnaatcntctaacgactgtatataaaatatttccnatttcaacaaaaatntnaggagccttnttcncaaatctcattaaattctctnaaaaattannaaaaagcccccccccccccacccccccncnaaagtntcttnctttcaccaaatctctcaccttattccatcacttgcacttctccccctttttattttccnttca

SEQ ID NO: 94239 - DNA, 249 bp, Triticum aestivum
  unsure (1)..(249): unsure at all n locations
  Clone ID: PAT_TA_94239
gtaaattcatttaanattcataataatattaaaaatggntnccccncacacaanatatacctgtctcnagcgtgttcctatatnaaataatataatgaaactcctatcccttaaaantttttttttttttntnttttancaaggcccttccantccaattcacatggggtgttttcacccactttgtatttctcntttncaaattctccctttattttaaangtntgcgcnccaaantantctctttta

SEQ ID NO: 94240 - DNA, 425 bp, Triticum aestivum
  unsure (1)..(425): unsure at all n locations
  Clone ID: PAT_TA_94240
tggctttggtgaggcagtgggaaacttggaaaatganantgctatacaataagaggaacacnaggaanaggacttgatctcaacagggacagctanacggtctgtcgatactcgctctatggatggaactacttccaagaggcagaggaaggaaccaaggccaaagagggtgacgggaccaagtgatccctttgcagtgatgcttcaagatgtcaatatccatctcaacaatgtnacacaatatgtgggtacaattggcagcatcattgtcagcatcaatggcacnanaagcagcgcnaagaggatcctcancagnaaatcaanagagaangctattactganttggctaggcttacgcttttaccgggagcgaanatcgtttgtaggcttgcaanccgtattttgcctanaagctnccaangat

SEQ ID NO: 94241 - DNA, 447 bp, Triticum aestivum
  unsure (1)..(447): unsure at all n locations
  Clone ID: PAT_TA_94241
ctcgtgccgaattcggcacgagccgtgatgaaatttacggtccctatgacaactcatttttacaaagcaatgtgcccaaacagcatacaaaatcacccatcgtaactggcacttcagttattgctgttaaatttcgggatggtgtcatcatcgcagctgacaacctagcatcttatggatctctagctagatttacaaacgtaaaacgcctaagaaaattcgcagacacttcagtcgttggcttcggtggtgatgtctcagacatgcaatatcttgaccggctcctcggttctctcgccattgatgaggcttacaattcaacgggccatacacttaatgccaaaaatattcacacttatctaagcaagagtaatgtataagcgccgctcaagaatttaatcctttgggggaatcaaattcttgtggcangtctagatgatgaaagat

SEQ ID NO: 94242 - DNA, 437 bp, Triticum aestivum
  unsure (1)..(437): unsure at all n locations
  Clone ID: PAT_TA_94242
aaaacacaagcctccttccaacaacaatggctcacctcaagaacttggccgtgttggtgtgcgtgatactggcctcgctcgcgttcgctgtgcaggccgtgctggccgccagaggcctcgccccagccaccggtgtttttagcagcatgtacacgggtaatgcgcctgttaaaccccattgtgacaacgatgatgattactgtttgagtggcaaacctgcacactagactacgagaagacaggccgcccgggaacctgaatgaagttagctactgaacactcgttgttgatataagcataatcataagtgattatctatcgttctgtttctcttttcgaataaacgccacgggaggcancaatgtctgcttgtgggcgcgtgattatctacaatangcaaggagaaagaaagggcggtgccgttgtttaacnccggg

SEQ ID NO: 94243 - DNA, 201 bp, Triticum aestivum
  unsure (1)..(201): unsure at all n locations
  Clone ID: PAT_TA_94243
cctacacatacncanctatctatanttcanncacatacatattanaaaccatttatacatctanccaantantaatttanacncccaagaaaagggtttttctctccctatccaanaagggcgccatnnttaacctttcccaagggggagaactcncctcaagactacctctctcctcacaacnccncccgcgcccccntc

SEQ ID NO: 94244 - DNA, 281 bp, Triticum aestivum
  unsure (1)..(281): unsure at all n locations
  Clone ID: PAT_TA_94244
caccatgcgctataanatatcttcaanaangaanatctatcaacttccaacaaagactcttctctacacnaattttcatcaattcccaaaagantcactactcttcttnccccacntcncactcccnctttcgnngnccctaancccaaactcanattcctgnngnagaatattttccctaaacnctttccaaataaatctccaataaaaattatatcnntcttacncccaaactaancccaaatatccctattnctattnccnatattccctattnctcc

SEQ ID NO: 94245 - DNA, 446 bp, Triticum aestivum
  unsure (1)..(446): unsure at all n locations
  Clone ID: PAT_TA_94245
ctcgtgccgaattcggcacgaggcgctagaagatatcttcaagaaggaagatctatcaacttccaacaaggactcttctctacacgaatttgcagcagttcccaggagagtcactactcttcttgccccgcgtcgcactccggctgtcttagcccctaatggaaactcaaattcgtcaataacaatatttgccctaaacggtttccaaggaaatctcgaataaaaattatatcggtcttacgcgcaaactaagcccagatatcnctattgctatggccgatattccgtatggctcgggtcccggtgtaaagcgagtagcaaaaatggttcgtaggacccaaagcctgggtatctgnaacgattcacggaaaatcngngaatcagggctacatttcgcggcaattctncctncttaaaagcttcaagagcaaatccgaatacttaat

SEQ ID NO: 94246 - DNA, 291 bp, Triticum aestivum
  unsure (1)..(291): unsure at all n locations
  Clone ID: PAT_TA_94246
tgacctttctcttccnttcctaacgtaccttancattcatctanttatctgattctaacatttcttggtcaggnctgtcttttccatctttcacttccaatcannctttttctgggagactacgtcggggnntcactcacggcacctatcaatgntggatgggtcagananatatccctatatctgtccngggcaatctatgactttttaantcaatanntattatccatcacgnnaagagcangtaccagcaagtctcaaaacttnanancaactgattatnggacgcgt

SEQ ID NO: 94247 - DNA, 454 bp, Triticum aestivum
  unsure (1)..(454): unsure at all n locations
  Clone ID: PAT_TA_94247
ttgacctagatgcaactcgggttggcaagtccgctgtcataaaaacctcaactcggcaaaccatattcctcccacttataggactagttagcccggaaaatttaaagccaggtgacctaatcggcgtgaacaaggattcctacttaattctanacacactaccagctgaatatgacagcagggtaaaaacaatggaggttgntgaaaaaccaagcgagaaatacacacatnttggnggacttgacaagcaaattgaatagcttgtcnnagcaatcgtatggccgntgaaggaagctgagcgctttaanaaaattggtataaaagcaccnaaaggtgnattaatgtatggccctccanggtacgggaaaaaacnctccctgctnggggcggtgtgnagntcaaaacaagacnctacattcccttaaactcgccngggcctcanacnttgtttaaa

SEQ ID NO: 94248 - DNA, 218 bp, Triticum aestivum
  unsure (1)..(218): unsure at all n locations
  Clone ID: PAT_TA_94248
cctcatctcatcttatataaaacatatacatatancctacnttcntacaattaatcaatattcattcattacacacctcccntcttacccatcaacaatttacccaaattctcaannacaatacaannagctactanaanatancttantttacnnttacctttccccccaccaaangntttttncctcccccgaaagncccccccccnccctccccc

SEQ ID NO: 94249 - DNA, 288 bp, Triticum aestivum
  unsure (1)..(288): unsure at all n locations
  Clone ID: PAT_TA_94249
aggcatcaatcatgccaattttctttctggccaactgctgggaactgaaaaacatatccatggagagagatcactcaggttcanatnagatcagatgcaagcaagggagatttaagataatgcacagggnngaagcattttctcnatctacgaanggttccggangcancacatgaactacctcaccggcgtgggccantcgcttgattattncnagcatatttataantntaagcactctcancactctcaacaaccttaacaataanntccattcaaagggggctg

SEQ ID NO: 94250 - DNA, 196 bp, Triticum aestivum
  unsure (1)..(196): unsure at all n locations
  Clone ID: PAT_TA_94250
ctccacaaatcctaaccctaanccataactnccttaacttccttcctctccatntatctntaaccatttctcccaccaaannccatcttcctcacatccncatccacctctncaccacctactctttcctcnncntttttcaccccgaaaaggnctcnnccctccnccccgaagncncacctcatncncaccaccc

SEQ ID NO: 94251 - DNA, 169 bp, Triticum aestivum
  unsure (1)..(169): unsure at all n locations
  Clone ID: PAT_TA_94251
nttttttttttttaaaaaanaatgtaaactacntgttgatatttatgtcttgcgaccaaanttacaaccncggatccnaanctnaacatncnaaaaataatactacaananatccccttcccaacaattnaaattttgtatcntancttcaacaaangtacatctccca

SEQ ID NO: 94252 - DNA, 444 bp, Triticum aestivum
  Clone ID: PAT_TA_94252
ctcgtgccgaattcggcacgagtatgttcggccgttgaccgattgcataaggcctgtctctcacaccccaataaatgtccatttcctgaatatcaggcgtaataatggccgaaaaatctatcacaccacctatctctgccacgcgcttaaatcaaatcgccaacgatgcttgccaggctgcgctcggatcagttgaatattacgagcattcgaaaacagaggcatggaacaccatgataatcaatagcattctccgctctctcgtctcagaatcgccgacaacatcagatgccaacccttcatacaaatatactgtcaatagtaccataatccaacaccttgtgccgactactgccatccagcgggccaaggctatgcaagaaagtcctcaacagtctattaataatactaacagatgtttccggtatcaaagaaaatttggaa

SEQ ID NO: 94253 - DNA, 214 bp, Triticum aestivum
  unsure (1)..(214): unsure at all n locations
  Clone ID: PAT_TA_94253
ctctttccnaattcatcacaaagccactctcaancctctctctcatccacnttcaacatctctctanctcccccctanataaatctcacatcctaataatcatcanntaaaccccctcctgggtcctctcccatcaccacnaaccaaggggngtccccaattncccctctcaccntgnngttcgtctaccttctccnccataatctcctcactc

SEQ ID NO: 94254 - DNA, 433 bp, Triticum aestivum
  Clone ID: PAT_TA_94254
acctttctcttcctttcctatcgtaccttaacattcatctaattatctgattctaccatttcttggtcaggactgcttttccatctttcacttccaatcagactttttcggagagattatgtctgaactcactcaccccactatcaaggatggatggttcagagagatatccgatatgtggcccgggcaagctatgactttgaaagtcaagaatattatccatcacgagaagagcaagtaccaggacgtcttaatatttgaatcaactgattatgggacggtgttggtgctcgacaatgtcattcagtgcaccgaaagagatgaattcgcctatcaagaaatgatcacccatcttgccaatgaactcacacccaagattccaaagaaagttttagtcattgggaggaggtgatgggggggttcctccgtgaaa

SEQ ID NO: 94255 - DNA, 448 bp, Triticum aestivum
  unsure (1)..(448): unsure at all n locations
  Clone ID: PAT_TA_94255
ctcgtgccgaattcggcaccaggagagaactagttgggagaatgtctgcatcgttccaggtggccgggcaggattaatccgtatcgctgctgtattgaataacgcatacctgggattctttatacccgactacacggcgtacaatgagatgttgtcattatttaaaaattttgctgcaatcccttcccccttggaagagcaagacggttaccacattcatccaaacaanattgccgaagagataactcnaggtgtttcggttattcttacctcaaatcccccgcaatcctacgggaaaagttgtgaaaaaccccgagttggcanagattcnagatctctgtcgtgggcgtgccacactaatcanggntgngttttacgggnggggtataactatacnaagcggactgggacgggaactaannataaagtggccccccgncaaatgttt

SEQ ID NO: 94256 - DNA, 271 bp, Triticum aestivum
  unsure (1)..(271): unsure at all n locations
  Clone ID: PAT_TA_94256
caaaacaaaccccntttgagagntcaagagagnttcaacgctcccgggccccgattcctttatcttctccggacggcgaacgcccgggccgggagcncgagaaggggaagaaggtgcaatggccgttggtccctnntgtntaatagagtccaagtnataaggtttgagggncgaagtaagtggcccaatgtgggcggtatgggctgtatgcccgattgtnggagaagcngccgcccgcccgcgtactaatcaaccggctgggttgggctca

SEQ ID NO: 94257 - DNA, 499 bp, Triticum aestivum
  unsure (1)..(499): unsure at all n locations
  Clone ID: PAT_TA_94257
gcancttgggagcgcgtttgttttggggacaaaatgtnacanggtcaaancctgtcatccccacccaatacttcnttcntcnttntaggnagtagcgacgagatnaattaaagtaaagtgggtataacntgaatttgtggngacnatacgtacgtnngatacattaggnatagaaaaagattttctttttgaatgaatgaaagcgctcttagttcanttcggnagaacgcggggncnccaaaanccgatgtcctaggntcaaatccnacaaaagcggngnntccatccatcttatgtccgaagcagagnaaaataacctaacaaaattgaattgnaactccaanttnaaattggcctcctcncctggggccngggggagggcaatcaaaaaaaaatgactcaatcnaagatncaactgnntccccacgcctgnattgcaaatacgcaatcacnaatnatcccncnaaagttatanggaataaggcctaagacnttccna

SEQ ID NO: 94258 - DNA, 203 bp, Triticum aestivum
  unsure (1)..(203): unsure at all n locations
  Clone ID: PAT_TA_94258
cgtgcccgtttnttcaaacccaagacncaaaagggcaccggacaaggctgccattggcgnaaacccaaaggccctttttgggaggnatcaangantcncccatggggcaananaaaaacctcgacntcatcgcgctcgcccgcttcgncgtctccgnnganaaaaaacaaagncaatgccccgctggggttcccagaacntgg

SEQ ID NO: 94259 - DNA, 463 bp, Triticum aestivum
  unsure (1)..(463): unsure at all n locations
  Clone ID: PAT_TA_94259
caacangggagcaaatgntcnaacacaaacgttgntacaacctgggagnttctgatctgncnggntcgtttaagcgatataaacnaagtgttttgggggaggncatccccccccgcgtcagcaagggnnatgtattccaaatggngatgattgtcagggctaccaagaaagggtatcacattgaagagggcccaatcactttcntanacaggggcntccgggatctcaaaactcngggggtncgnaattgntgggtatttgnaagggcnngggtatcctgttgctcacaanaaaagggggaaaaacacnggtatggaagactgggtntatgacaaaacacctgntnagagggagttttcttntgttttcacaacctgagncggaanaaatcctgcccancggtttcaaaccctacaaatggaattatatacaaccaaacttttggnccggggnngaacccctc

SEQ ID NO: 94260 - DNA, 379 bp, Triticum aestivum
  unsure (1)..(379): unsure at all n locations
  Clone ID: PAT_TA_94260
ggctggggnccctggggcttgggccaaaaaaaaaccttngacaacaaaaggttgntttggatngtcccngcgccccaatgggggcttcttngancaaacctgtnggaannacancgtggggcgggccgcggcccgggccaanaggctcggganggntccggaagtnnagcctccttttcccccgtcctcctcgggngggcgggaangaacgctgggcgtngccgtncnggccgacgttggtgggcncccggccggttgaccncgggaagcatcaaatantcntcccgccccgcccgggctntnttncggtgaagttcccngcgcgggggaagtnccggggtcccnggtcccggtgccctcntnccccggggnnagcggt

SEQ ID NO: 94261 - DNA, 259 bp, Triticum aestivum
  unsure (1)..(259): unsure at all n locations
  Clone ID: PAT_TA_94261
tttttttttttttcaactgcagaatgntttattaaatnatcnaaagtgacntcngngaacaagccacaaacaaatacacagcanntagcagaggnaagcttttattcaaaactgnagncccattcaagtccantagttgcaaaaccaaggatccttgcgcaagaantcaancttttcctccaccttctttggggttcgangacgaaccctcntcaanttgatcccngaagctcgtgccnaattcggcaagagggggggg

SEQ ID NO: 94262 - DNA, 155 bp, Triticum aestivum
  unsure (1)..(155): unsure at all n locations
  Clone ID: PAT_TA_94262
ctcccccgccgctcccaaaagaaaccntcccgggttgncccaatggggaactgcccntccgnngaaagaaaaatctgttgccggncncccangggaaacncntccccctcaagtnntaaacnggtnactgggccgtgctctccgcgaanctgggc

SEQ ID NO: 94263 - DNA, 552 bp, Triticum aestivum
  unsure (1)..(552): unsure at all n locations
  Clone ID: PAT_TA_94263
ttcccgggctgcaaggngtcaantcgctcctcnaggagganggggtcacggtgggggggaccaaccacanncacnccaccaaggncctgancgactccatcgccgccgggaactanccggagtggnccttntacatccanaccatcgacccngnccacgangaccgcttcgactttnncccgctggncgtgaacaaaacgtggcccgaggacgtggtgccgctgcanccggtggggnggntggtgctcaaccncaacatcgacaacttcttctcggagaacgagcaactgggcttctgccccgggatnatngtccccggggtgtagtactcnggcgacaaactgctgcagacnaagatnttctcctactccggcacgcanncgcanccgcctggggggccaactacctgctggtggccgggcaaatnggnccaagtgctcccaccacaacaaccactacgaccgggtcaagaaattnatgcaccgcgacnaaggaggncgactanttcccccccaaagntnganccccccaaagcaaagaggccccgcgnat

SEQ ID NO: 94264 - DNA, 653 bp, Triticum aestivum
  unsure (1)..(653): unsure at all n locations
  Clone ID: PAT_TA_94264
ccgaattcnggaacgaagggcaaantcaccaaacatnacgcccatttgaccaaccgatggcctacacactttangcaangactccncaaagcaatncgncgggacatggtttccgggctggtcaacgggnaagaagtanngaaaacaatccgcaaagncatccccgggtgggaaagaaggtccttggctgggtgggacaacatcaatcaaccgcaacnaaattatgggacaaagtaccatccctgggattactttcgggaaaaggggttgggtatggcgatantttcaacaaagcaaagggcaaccatttttgggagncctggtggtttgnaatcctccgaaaaagctgtgggncctttgatccctngttgaaaaaagcgagaacgnaatatctctccaatcctacaaaancccaagattgtaaaacccaaatcaatcngaccttattaccaacnttgggattattccnaagggnccctccgggaaaggggccngcaatccctaaaagtttcccccttggncgtaacgccgccccgctngggtttaanntaaagggaaagccccaaccgggaaaaatnaactgaaannctggggggnngtaanttttaagtttgntagcggtaaccccaangggaaaaaagaaaattcntgtg

SEQ ID NO: 94265 - DNA, 327 bp, Triticum aestivum
  unsure (1)..(327): unsure at all n locations
  Clone ID: PAT_TA_94265
aaaatacanatatgatgtatttgntgcgagagtgaaaacngcantgtctttccctgnaccaaaaanccatcgnctgagtgccacaaaancangcgatttgttgggcaanttgcacnggctcnttggnttggacaagccgggagncccngagatcgcngcnttccnattatgcattaatttttcaacaaacagttgnatggggcatcanttgngcangaatantcaagngatttggnagtgggagaaaaaaagtatcccacgaaatttgttatgtgcctgttgggcangaatgcaacggaagtttttcccccncaaaagcctgatgac

SEQ ID NO: 94266 - DNA, 193 bp, Triticum aestivum
  unsure (1)..(193): unsure at all n locations
  Clone ID: PAT_TA_94266
tgcggtgcatcntgtgtgttgttgggtccgttggnataattttgcatgccccaaaggagagggagattaattcaagtgggggaaatatggcattttgcaactcaaccaggtttcantgtttattcatgtgtngctgtggttggggcncnttttttgattttccgggctgtcaaacnccctggncataggaaga

SEQ ID NO: 94267 - DNA, 471 bp, Triticum aestivum
  unsure (1)..(471): unsure at all n locations
  Clone ID: PAT_TA_94267
gaaaccatccaaattctctgntcccaagtnccaaagaagggaanggggggggcacnnaaaagatctcccaatcnggcgggaaacaacggggcaacggntacggttcccgcgcctagccccgggggcaacgggggattctccgcggggccgttccgcggccatcccgnccgnggctatcccatncctgcnggggagggggtggggtctttgattcancanggattgcccaagatgtnttaaaccaaaaanccnattttccgagcnactgggnntcaagcgccacaaanaantccgggtttnntcaccgatncaaacaaatccnggnncaaaccttgccaaacnaatgcaagncaatcctaanatttgggnggggaaatgggggncaaaaacaaanaagctttgcccanccaanaacaaacggtttancggnggggncaaatnnagctttcatgggangttttctntggaggg

SEQ ID NO: 94268 - DNA, 651 bp, Triticum aestivum
  unsure (1)..(651): unsure at all n locations
  Clone ID: PAT_TA_94268
cccaaaaacaaagggttccccgggtgaaggaaatccggaananaaaaatctctcaactgangtcaaaaaaaattggcgcctggagtccttgggggaatgcnttcctttgaatcntggcaagcccgggntttccaataagntggttctccnncaagcntttggntggngcaattctctccccctggggctaaacccanccaacccttttgatcctcccctcaagaaataagttggcataaacgtgaagctgtcctcctggctcanaacgggnaatccttctngaagctcctccttcctcctggggtccttggtttggttccccntggagaagntccctcctcccttaaagtttgggntggatccggcggggctntggaaattccggtccnttccgaagggactggaagnttttccntggccaaaacttggataatttcccctggantttaacnggggaaatgggtaaaattgcaataaatcctgggnggaaagcnaaattccgggggtggntnttcaacccccctggnggntccttccgnccggaaaaccgaggcgcaaagannaacccaccgggcaggggnanggggtcaaaaccttgccctgncnaacctggggctttccggttccaatccaancngangggtggngctg

SEQ ID NO: 94269 - DNA, 657 bp, Triticum aestivum
  unsure (1)..(657): unsure at all n locations
  Clone ID: PAT_TA_94269
tncccccgggcnggcnaggaaatctnggaacnagaagaaaaaaccaagccnttctaactcctctggnctttgnaattccgnccttcccaattnccaattccnaaaccgcgaatcaaatgggntggccaangaaagatnngnccctcccnttgccgttgggccgcgaatgggccgtctttgctnagncaaccgcgttcaagcgggttaacctacaaacgtcccggngatnnaagggcggggtgggnnccctcaagcaaccnactacaacaagcttggggtggtcccggcaaagaaattcaaacgtgggggngatgaagatncgtcttcnaagtactncgaaccccaaccgcaacgaacgtggtccgagggtcangcaaagggccgggntacnactcctgcangnatccnacngggggccaatcnaanaaccttggncctccgggnaaacgaacgtcattcaacctccaaacgccaaccgggaacccggtaanttcaatctngtggggggtcccctaaacaattgganggcccaaccgccgggcngccanganttaaaggncctgatnaaangtccgcctccggggntncctcctcnccggtcgtcanccaatgcaaanttncaaggtccctggggngaancaaancccccccccgggg

SEQ ID NO: 94270 - DNA, 225 bp, Triticum aestivum
  unsure (1)..(225): unsure at all n locations
  Clone ID: PAT_TA_94270
ggaaagttttaatccggaccgataaagggcgaccgggacccccccgaaaagcncngaacaatatgggnggaccggnactcaataaaactcaatggtcgatntccgagaaaancgnaagattaataacacccgnatatttnatcacaagggcaaatttnttcaccaaaaaacaatnacctggggttttatngagacngngattggngaccggggaaanaaaaagct

SEQ ID NO: 94271 - DNA, 337 bp, Triticum aestivum
  unsure (1)..(337): unsure at all n locations
  Clone ID: PAT_TA_94271
ggaatccggacaaggnaaactccgccccggtttccntgctttcaaangganggagcctcccctgagcanggtcaagnaaaangggctgctacctgtccccgcaaaaggggncgatancccttttttttcttcaantggcgcaccaacctttaggagtttttaattccaagngaagtcgatcaaacaataccgttgntgtaataaattaaaagnaggtattttcaagtcaagtggctaacaatcaacaattaagtttgngtaaaaaanaaaaaaaaaaactcnagggggggggcccggnaccaattcnncctanaagggagtcgganttangcgcgcc

SEQ ID NO: 94272 - DNA, 545 bp, Triticum aestivum
  unsure (1)..(545): unsure at all n locations
  Clone ID: PAT_TA_94272
aagaaatccggacgagctcctgccnaattccggacgagcaaaggaaatccactccaatccaatccccacaaaaatccccatctcaaaaccctancccgtccgatnccggggagatgggcaaaccgagggtgttcttcgacatgaccgtcggcggcgcnccggncgggcgcatcgtgatngagctgtanaangacgcngtgccgcggacggtggaaaacttccgcgcgctctncaccggcgagaaggggtcggcaagagcgggaagccactgcactacaagggganctcgttccancgcgtgattcccgacttcatntgccanggnggngacttcaacaagggnaacgggaccggnggggaagtccatctacggcgagaagntcgcccgacgaagaaattcgtccacaagcacaccaaagnccgggattctctccatgggcaaagcggggcccaacancaaacggntcccanntcttcatctgnacccgtcccctgcaaattggtcgaccggaaagcnngttggtccttcggcgaaggtcntccng

SEQ ID NO: 94273 - DNA, 637 bp, Triticum aestivum
  unsure (1)..(637): unsure at all n locations
  Clone ID: PAT_TA_94273
gggatcccccnggctgcaaggctccctgcccgaaattccgcacgaagtgaaaaccctcccaaaaatccttacaacncaatggggccaaanctgantncatacaagcacaaacnttgtttggaaactaacgnagcaaaattttcaaaaattatacaagtacaaggtacaagtagcaagcaattttccaaaggccaagcccaaatatacnttttgtgcaaataaaactggcggtacatcacaagtatgttgctcatgaaagatgtntgaagaaataacttctgagaaaatnggcaatgtctgtccacaaagacgccctatttgaggggggggagcaatcaaggatccaaccttttctgggatttgcaagctgccgggctccnaaatttgccccaaacntgttcctggtnacancaatttcctcacctaaaaaagggactgnctngcttcatcgcctggagccaattccaagtttggcatggnggcggttttaaaagctggtaacnttcctcctcccntttcgggggttcaacgttccttgcaaacaagntccnaaccgtccgtaccttccccaatcaattaaaatacctgttccgggnctggctaaccggaaccccgcaattcctttaaacnaattccn

SEQ ID NO: 94274 - DNA, 608 bp, Triticum aestivum
  unsure (1)..(608): unsure at all n locations
  Clone ID: PAT_TA_94274
ncgggggggggcgcccccanaactaatgggttccccnggctgnaaggaattccggcacgaaggganttcctcccacttncnggtgcaacngcggcggggggcaacgcgcccaccggttgtggngacgagatgtcctacatgcgangcgacctgctgacgaaaacccgggaaactggtgaagggggtggncaancccgcccctgcctggctcaaggncatggggcangcacctccagtcacattccctaaaactggatgggtaaaatcccanaagatagaactgccaaaggatgtcnatntcaaagaggttcttcanaaaggnatcctggattcactcctaccatgatgcaataaannataaagcggggttttggtccaacgccagcaaaaagttttttgctttggggtgtccttacaggtgganaagaacaagggaagncaattgaagatgaatgcaantgggctgtagcaagatattnggaggtatggggccacagnaaaaaacnaagaagctccntacnaaggaacnngnaacaaatttgcacgcncngaaagggaaaggcaaccacctcccaantncatatcaaancncttttnaangaaatacn

SEQ ID NO: 94275 - DNA, 353 bp, Triticum aestivum
  unsure (1)..(353): unsure at all n locations
  Clone ID: PAT_TA_94275
tgccccaattttgcaaaaaagaaatnntggtgcaaanatncccccaagggangaatngggaagncgctctccaaancccttntccntnaacaacctncgggggccccgctctgggaagggcgnctccaangcaacgncgctggctcccctccgngcaaactccggngattacgcccccgggncggagaagccggncccggtcgccaacggcccccccgccgaagaaagaattccaagaaacgcgtgctgcaacttaaatcccgcgtccggcccaaaaaacgggggaagcgcccnggggcggcgcaaaaagaaaggcgccngccgagttcaaaccccgtnancctncgcccggt

SEQ ID NO: 94276 - DNA, 526 bp, Triticum aestivum
  unsure (1)..(526): unsure at all n locations
  Clone ID: PAT_TA_94276
gagatgctgatgctggcggnaatggtgaccctgaaaaangtcaaggngaaagcgaaggcttcgaccccaactcngnggtgggtcaacctgatggagttnnanaaaggaagagagagtgactgacaagcnggatactttaattnanaaaaagcacnatnttgtgcagatgctgaagcanattttaaatgccgaagaagaaatcaaaacacgttagcatgcacgcttcactgcgtgctgccatgnctcaaccgccaaaaaaaaaacagctgatggggaagtgttccctangacaggtgcccaanaatgaccgntgatgtcaantttcancgaanttttgctgggggaagtcanatgctggttccaaaccaaaggnactcctgggncgcccccntgcatcangtccaacaanntatttctcctttaacaagnctctttttgctaagggccccaaatccgggtctcccnaancaaaaaccctggntaacaacnccaagtaagtccnanaangacctttccnccatnggna

SEQ ID NO: 94277 - DNA, 272 bp, Triticum aestivum
  unsure (1)..(272): unsure at all n locations
  Clone ID: PAT_TA_94277
ggggcgctccanaaataaatgngttccccccgggntncaaagggcctgccgaattccggcancgagggttaacanttgtctcanaagactcaatntttcactcaaaatngggaagcncacgcatccaaagaaaattcngggcgaangagcccnccaaagnaaagtttcggggagnaagatngaggggaaacannaaagctctgactcaaaaaccccnaggcccnggggaagggggggggttncaattgggaagcatgggnnagtncaattca

SEQ ID NO: 94278 - DNA, 367 bp, Triticum aestivum
  unsure (1)..(367): unsure at all n locations
  Clone ID: PAT_TA_94278
caaagcncgagntcccanttnatcaccantctgctagcccgagtctccttcttgancccccccccccccntggnttcaaagtctcgcantcctcgtcccaatcnctttctccttccaaagaagaatttctttgggttgagggaactgctgttcttgcnaagnnagggctanatcagcgggaagaggntgggncgntgttccncntgaaatctctgggttttgttgcgctgggnggttcttgctgggcatggtttgtccaaggcaatggtgaggggcaatctctgagntttatgaaagatngccantcaccngcgccggnggtnnttcctccantccttctccgtngtctcctctactacntttatgg

SEQ ID NO: 94279 - DNA, 548 bp, Triticum aestivum
  unsure (1)..(548): unsure at all n locations
  Clone ID: PAT_TA_94279
aatggnaaaaggggctccaattgntcaacntcatggcggagggagcccaatcaagcctaaaccgcagggagttcnggaaantantaacccaaanatnccantccngaaacgcaaagcaaatccgccattgcaagtagccnacaatttaagggaaaanaaattttgttaatccaagggttcccctttttccnacctcagacaagttgntttagnntaaaaaaattgggcaagaagcttcaaatccggncctttgangacctgccgggnaccccaaattattntggtngaacgntaaattttttcacccgggcaaagaaatttggnanaaacaccgnagggngtccttaatnccggaacaaaaaaaaaaaaaaaaaaacccccanggggggggcccnggnaacccaaantcccccctaaangtggagtncnnaattacgccccgcnncaacgggccngccntttanaaanctncgggnaactggggaaaaacccctggggggtaacccaancctaaatcncccctggaggaananaccccctttcgccan

SEQ ID NO: 94280 - DNA, 382 bp, Triticum aestivum
  unsure (1)..(382): unsure at all n locations
  Clone ID: PAT_TA_94280
agancattncatcccgctccaacagtccaaancgcaacagcacgaagtgagctcgagaccgagaggggaaagagaggaggaaagcnattcagtactnacagggaaccatggtggtggtnaccggcagcaacggcgggaggctgnanccngtgggcgggngcccttcttnccnggggaggtggtgncgccccgccccccgtgcaangcggccgcngcggnggtctaggacttctcncccngagtggtgggggctcgtcgcctcctnctccgtccttccgcgacagntggctcctccgantacgggngacctgnggctgcntggatgcccgactaaaggggccaagttttttagcggancgcctttcttccctcccgccggcgg

SEQ ID NO: 94281 - DNA, 297 bp, Triticum aestivum
  unsure (1)..(297): unsure at all n locations
  Clone ID: PAT_TA_94281
agagaactaaataatttacctacttccgtctattgtcttttaatgtttacatagccatgccatttctctcacttatgaaatcactgttcttcagaaattgctatataaacattaaaagacaatagacggnagtaggtaaattatttagtttctcaaagccaccaggcactaacctccactcagtctaacagcccaacctttctatcatgattaaattaagttcactttgatttacaaaagttgtccaaatattattatgcatttaaagtccgccacattactactccctccattcca

SEQ ID NO: 94282 - DNA, 494 bp, Triticum aestivum
  unsure (1)..(494): unsure at all n locations
  Clone ID: PAT_TA_94282
ctcgtgccgaattcngcangagctcgtggcgggcctcttcgcctctcttctcttctcctgnctggccctccctcctcgcgctccatcganaacgaagcanctcgtcttgttcttggtcttggcttttggtgtggcgacgttgggtagtgtgattatcttgttctcgctggcaggagatggcctgtacgcaggagaacgccatggcaaccgacgaaagcacggcggatcatcgcgggagtcgtccgagttcccacgacatggatttatcaggggatgaccacgtgccaaaggcacgcaagccgtacaccatcacgaagcagcgggagaagtggaccgaggaagagcacaagcgcttcctgnagggcctgcanctgcacggccgcgcctggcgccgcatacaaagagcacataggcaccaagacgggcaagtgcaaatccggagccacgcgcaaaaanttcttctctnaggtcaacaaanaagtcgtcccgggagn

SEQ ID NO: 94283 - DNA, 475 bp, Triticum aestivum
  unsure (1)..(475): unsure at all n locations
  Clone ID: PAT_TA_94283
tagaaaatggatgctgccttatctcacacacctcaatgggttattgatttaaattctacacccattaagccaaagttcagttccacccccgatccgccaggttatactagtacatcgcaaaagaagcatcaatcgctctcaaaagctactgatttcatatctccaagtcctgctgataaggatgtactgaaacttaaaaaagcatgggagctggctctcgcaccagtaaagcaactaccgatgaccgcgttcatgatgtacatgtctgggaacactttgcagatttttagcattatgatggttgtcatggcttttaaaacaccttttatgggcttactagctacgaatcaggtcttcgaaaaatttgagagcgatgggacgaagtctcagcttgtaatggnaaaaattgtatatatttctatgcaaatattagccctggctcttgggatatggaaggttaatggaatgggcctcc

SEQ ID NO: 94284 - DNA, 566 bp, Triticum aestivum
  unsure (1)..(566): unsure at all n locations
  Clone ID: PAT_TA_94284
cgcggggccctccggngtcccnacgaaaagggatggtgggggcccaatcctatgacaaatgcccttnaagatgaagtgggaggttncgaaaaangctnctactgggcttggtgggngaacgnaagacttggggcgacgattatttggngctgggcaaagaaacaattggttggaaagctttctgggtgggnttcacaagggagaaagcacccggggccaaagatgacattcaaaatttgaaaatttcattctgaagccccctctgactttggggttaccttctcaacccgctggtcaagacgtcttttccggggnnaaaagaggccangtgganagaaatggccgctatttttaatggaggaattactcccannaaacaaaactttcgccgcggacgantccaaataattacactttgtcctcaataaaatacatcgggntctaatttggtaatttctgggcaatcctggtgaagggcgggntacaaaagcaaataatgggataacgngcggataagcgggtcctccgtcaattactggagccgagggaccaacnaagggtggagg

SEQ ID NO: 94285 - DNA, 499 bp, Triticum aestivum
  Clone ID: PAT_TA_94285
ctcgtgccgaattcggcacgagaaacactcccgatcccacccggctcatctccgagagatctaccactccgaaatcttctaccccgaaacctcatccgaggtctatcccgcccaagtccatcgtcaagaccacccgtttcgaactgactgaaaacgtcagaaaaccttccagtgcggctcagaaaatgtcggaacgaagatcaagttctgtttcgcccaagatgattcggccaccaccacgcgatctcgaatctatctctcgcattgacgcttctctcgtctttgagcattttacgacgtcggatgcctgggaacttggctccagtctacgcagccgcttattaccaattcctacacctgtcgtcatcaatatatccctgggccaaccaaaagcaaactatatttcattccgtcactcacagtgggtgtcatgccctgataacgaaactctggggtagaggcgggaaacgcaacaacgtgctcaagatgggggggggca

SEQ ID NO: 94286 - DNA, 217 bp, Triticum aestivum
  unsure (1)..(217): unsure at all n locations
  Clone ID: PAT_TA_94286
ctcctggccgaaattcggnaacgaagtcccaatcctaangtncgaaccaacaaaantcgttcaatccgcctaaagtttttcttggggcngggccggggggggggntttttttnaaaccccccccaaancccnttgatnggggaaaaatnngggggcaaagggcaaaaagggcccaaaccccccccngggaanccgggaaaccccaaagngggggagg

SEQ ID NO: 94287 - DNA, 348 bp, Triticum aestivum
  unsure (1)..(348): unsure at all n locations
  Clone ID: PAT_TA_94287
ggagcagaggncggtcagcgagccagcgcctggcaganactgaccagcaatggcagcagcaacatcacgtacatccccatgtatgaagaagacctcgtgaggatatttatattcttatatctatcatctaatcgtaatctccaattctccatacagaatatatcatgtttcttggngtatatataagcagtggaagaaggtgttgtttctgatgttcatacgtgtaatgtcgtgctttgtagagtatgtacgtgcgactttgatccgttttgctccgcaagttctgcagttccgatcgatttgcacaggctcaagggtcctagaaatctaaaaaaaaaaaaaaaaaaa

SEQ ID NO: 94288 - DNA, 489 bp, Triticum aestivum
  Clone ID: PAT_TA_94288
ctcgtgccgaattcggcacgagcttctaagctactctagacatgcaggaaatactaagcgattagtctggcaccaccggaagttgaagaattcctctttgccagatcgtcttggaacgaatgccccaggctatgcttgaggtagacgccagcatcatgactcggtcatcccatgttttcgtccatagcgacaaatcatgcttggatgatgctgagcaataatttccacgattcagataggaagcacataatcaaccggagaaaacacactagaactaactcgtcgattcgatcgcccacaagaattgaagccaactcgcaacaatggtggccaaaaacgccggtcaaaatgtttttttatcatgccaccgaaacaaattctttccggaccaggtgaaatctaatcatgaacaaaaaagtagatttcacgaagcgtaatttttgatatcaaagctataccacatttcatgaccatggatcgcaacgcgaa

SEQ ID NO: 94289 - DNA, 476 bp, Triticum aestivum
  unsure (1)..(476): unsure at all n locations
  Clone ID: PAT_TA_94289
gcccggagctttcattcaagctcctcgagctacgccagcttgcctcagcttcaacatcccttgctccccgccagcgaaacaatcagtgtcaaacgcagaccgtgtgaacagttgtatgaaagagaacaaatcgaagactgttcacacatcgattttgtctagcttgtggcatgactgattccctcatcacctgttaactgctaataacaactacaaatggattattccatctctttaaactaacccctacctcactcactcctactattgcctaagactcagaacttccttcactacaccaacaatttcgtagggaattctacgaaaattactcatcaccccttcctttctgctgccaaatagaagcgcgaagcaacgtntctctcggcccctcgctcaagaatggtgggatccacgacgttgacaatgcctccacgatcttcgttgacgtcgtctttctccgtctccgacactaa

SEQ ID NO: 94290 - DNA, 490 bp, Triticum aestivum
  Clone ID: PAT_TA_94290
tttttttttccgaggtaatccgatgatggtggttgtgacagaaaactaagcgtagagaactccatatctacagaccatgccatcatatatatacctgccctccttccactagctcatcataaaatagaccttaacccagtatcaacatgacaccatgtgtcaaggactgtactattgtcatagcaacatagaaagaatggtagaattatatactgaaggaaggatcggaagaggaatccttacgccttctttgttaaagcagcggaatgcacgttagaaaaagaagaatagttattgcaagaaataggcgattttcccttcgtgatcaaagcagtggacgaggttaagttagaaaaagaaggacggtgcgacgaaagtaaagtacgcgaagaaattaaagacttgggtgtagaattgacgacgttgaagtagaataagccgtcttttacccgagcggttgctaaataattattgtcctctccgtgaacaa

SEQ ID NO: 94291 - DNA, 484 bp, Triticum aestivum
  unsure (1)..(484): unsure at all n locations
  Clone ID: PAT_TA_94291
ttttttttttttttttttgtggtcgctacttttttcttgttcattaacgtgctcagttaagtgactaccgttgcactcctactggagcttaagcacgagtggggtcggaatggtacggtgagcaaagttggngcaggacaatcatggtacccgagaaacatatttttcaggctaactgtttggggagagctgactagaggcaggacttcatgaattctgtttttcaatcatgaaaacatctggccagatgagatagctttgctattagacgagccatgcgggagcacgaactcatctcatgcctcctggctgtaatgctttagccaggtagattgactttttcgatctaaactatacggctagcctctgaaaccatgataagctccgtatgttctcgcctttgtggctctattcccatgtttatttcaacacgcatcgttttgctgcctcgagagttccacgatggcagggccaagcggactga

SEQ ID NO: 94292 - DNA, 484 bp, Triticum aestivum
  unsure (1)..(484): unsure at all n locations
  Clone ID: PAT_TA_94292
ctcntgccgaattcggnacgaactcancactgcctcatctacccaccacgggctcgccccgtcgggcgccgcctcctctccccancatggnctcgggccgccgccttctctccccaccacgacctcaccttgccggcttgccgctaaacccgccgttcttccctagatngactctgtcgctgccgtccacatcttccaagcgcagatnaagatgcgaagctagaggaagcatcctggaaacgatgcggcagcgggcatctcggagcgggccgagttccaagttcgtctacgtgcccaccgtgatagtcgacctcgtgcttcgctcccacacctgctccgaagaaggngctcctagctcgcctacgtggtcggttgctccaagatgtagcttgggaaggtcaagactgttggagttgaagcagttgtagatttcttcaagggaaaaataaagcanttgcacntggtgagatgaaaaagngggatg

SEQ ID NO: 94293 - DNA, 479 bp, Triticum aestivum
  Clone ID: PAT_TA_94293
ctaatatccaattgaagacgaatgatgtggtatctgtctcgaagggtatttcaggtccgtttgctattatgtctgagtcccaaacatttgaccaacttcatcgaggctagaggagcagcgtatcttagtccacctcgacccctaaaatctttaattctttgcgcgcttgtgtaatctgtccaataagctccttgtgagcgtgagttgcatcgttgaatgtgagaacaccatagcctaactttcccaatagatatgcgccaaaggaaaccgtagcccaagagtggcaaaatgggaatgatatctctttgaattattatgggcatgggaatgaggcctaggaacaatgctagatatagcgacgaggcgagtaggccgatggaaatagtttgctgggcgcgggtcatgatggatagccccaatttcaaaggatctaagtttgaacgtcataatccgtcacacgtcttctccgtgcccgaatt

SEQ ID NO: 94294 - DNA, 344 bp, Triticum aestivum
  unsure (1)..(344): unsure at all n locations
  Clone ID: PAT_TA_94294
ggggtgggggggggcggctcctaagaactaaatgggattccccccngggcttgcaaaggctcccttgnccgaaatttcgggaacgangctccctaancaaagcttattattaccttacaattagtacaaagncaatggcccccanccgttgattgggcttcgtnggggcaactnccgttcgcttccttttcaaagggggttaaangtcaaacggcggggcttccccgttaaagccgccgggttcaaaaggggggntagccncgggaanggttnangaaanagggggggaaagggttaaggggnaatnaaaggngtggggccccncccaaggggganccaaaaaa

SEQ ID NO: 94295 - DNA, 325 bp, Triticum aestivum
  unsure (1)..(325): unsure at all n locations
  Clone ID: PAT_TA_94295
aaaagctccangggaagctgcccggccacaangacaccgagggtgagcacgtgacggggctnccggcancggcgggccccgcgtctgtgcaaacccacggnggncaccatgacaccgacgtcgtcntcnagaaaatngacggggacgtgaagacagaggcggcaccggcagtgccccgagganganaaaaaaggcttcttgngaaaagatnaaggagaagctgcccggcggccacaaaaagccggnggacgctgctgcggtgnccgtcacncacgctgctccatcaacantncacgcgccgggngccggncccccaggagggtga

SEQ ID NO: 94296 - DNA, 486 bp, Triticum aestivum
  unsure (1)..(486): unsure at all n locations
  Clone ID: PAT_TA_94296
aaagcttcatatgtagcttccagcagtctgtcatagtcttggtcacggtaaagactttaaaaatacaaactaataggtttcgagtagtatatttcctcctacaccctcgtcgaacaattatagtcttctcgtgtccttgatcattttactagacaagcccctagatcaagattatgcaatccccgtaactgatagatcgtaggccaactgtggtcgcatagtgtttgggtataggcacaaaattcggtgagtgtagtactcccctaacaacgacaccaagaccgaggccgaaaccttagctacccttctgaagcgtttacagaggcctgccaagccgggtactgcagatttgggtatatatagaataatcaattttcttcttcatatcgtctcttaaagtggcaatcaatcaaatgccacccgagacaaggcggtatctaatgttgaaatctccggggtaagtccgtgatanaagtggagtgggaa

SEQ ID NO: 94297 - DNA, 461 bp, Triticum aestivum
  unsure (1)..(461): unsure at all n locations
  Clone ID: PAT_TA_94297
cccaaacactccgctcggctgctagctgcgcgtccatacaaacgcagttacgcgcacaagtacagaaccgccccctcctcttccgggaggccggccggccggccagcccgctcctcccctcccatccacctctgtccttagcatggtgagggacaccggcggcgccctgcagctgctggcggtgcttctcctcgtcctggcgtccgagctcgccaccttcagctgcggccacaggatccccagggcggacgtcgccgcctggaagcgcggggcgacgccgacgggaacgcacggcgtccaccacgacgaacgacgaacgggcactcgtgccggcggcgccggcgggcgggcggcgctcggcgactccaaagaaggttggttgcccaaggggccgaaacccgcctgaaaaactanccncccccccaaaggtccttcctnccctcccaatttttttcngcggg

SEQ ID NO: 94298 - DNA, 395 bp, Triticum aestivum
  unsure (1)..(395): unsure at all n locations
  Clone ID: PAT_TA_94298
ctcgtgccgaattcggcacgagctggtcttctggagctcaccgctcatggcactcccaagtccagagtgaaggctcatgctctgctcgacctgctgcgcaactcnccctactcgaggttgaagctgcagcccaacacgctggagaacatcgtcagcaacatcgcttctcagattgacggggaggactgtggtgggaaggncaagaagatgctcgccgagatggtgaaggtcagcatggagcatagcttgaggcaccttcancgccgggcttccttcgctngacgtttaangttgcttcaaccttcaacctgttttgcttgcttgcaataacnatnggtaantacanaagnactncgaagaaatnaatnatnaatggangaactgnagaattggct

SEQ ID NO: 94299 - DNA, 459 bp, Triticum aestivum
  unsure (1)..(459): unsure at all n locations
  Clone ID: PAT_TA_94299
ctcggcctcggcatcgccggcgtccttctggcggcgaagcggctcaagcgccccgcccgcccggaccacggcgccttcgtgtcgctcctcgagctcctgccgcctccccagcccccgccgccccaggcgcgccaccccctcaccgacctctccttcgccatcgccgacgcattccatgtcagtggttatataacaagttttggcaacctagaatgggngaagacacatgatgcaancaacacaaatatntctaggggtttcaactcttggtagnacgggtggtgctatttgtgttgggaaaaactgtnatcnatgaagatgggatannagtatccntgggtgaagaaatnaacattttgggncaccaacaaatcctngagcntccggtngagttanctggnngatgcccnaattggattannctttttncctgtttnctggtngcaatggnagnttttt

SEQ ID NO: 94300 - DNA, 464 bp, Triticum aestivum
  unsure (1)..(464): unsure at all n locations
  Clone ID: PAT_TA_94300
ctcgtgccgaattcggcacgagcttacacatcaaactatcgattatcatttaacctacatgtatctcaatagactaccctcaagatctattcctagtcgatcaatcaatcagatatctcgtgcagtagcgagttctcctaagacccggctgggattccttggatcgtatcaaaatagtgtaaaaactaatcaggtaagatgtttacgcccgttttcatcaacaatgcggtcacgactacgcgattactttccaagaagaggatcatgagcatattaaagaagactggaggctgcttgggncaacatccaaaactaaccctaaagaagcaagtgctacaaacatatcaaaatgcccaancgggccccctaaggattcccaaattgcanagccctttacttaagacgaatccccccgcttaacactgatnttgcaacgggatatnagcaccaccctgtcnccnttn

SEQ ID NO: 94301 - DNA, 483 bp, Triticum aestivum
  unsure (1)..(483): unsure at all n locations
  Clone ID: PAT_TA_94301
ctcgtgccgaattcggcacgagcgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgaagggtggtggtgatgatgaagggtgtcgattgaccaagccgttgaaaggtggttgacaatttgttgacaccttcccgtcctcaaaggagcaaacttgctttttgacaagaaacaatttaaccnctcaanattaaagcgctacatcaaagaaactnctcctccaaaccttggaanggggaattaccctaaaatnttttcaaagaaaaaaatgttgangtctggccacnaag

SEQ ID NO: 94302 - DNA, 458 bp, Triticum aestivum
  unsure (1)..(458): unsure at all n locations
  Clone ID: PAT_TA_94302
tttttttttttttttttttttattcnctaaaaatgcacatctatttcaaaaattattgctctatattacaaaagtctacatcgaagctctcagtatggctcgcaactaaaatgaaagcgtaatacatgttttgtgtgtcttctccatcctcatactttgtgtaccctccatttgcctttatcaatgctacacatctttcgtgcatgctgccaattagtgacaatagctcctctgaaggtatagagtcccacgcggcctgcaacaatgtttccaacgtggtagagcatacaagcctgacaccatttatctctggactatttaccggaatgtggttttttaacgatgttccatagtgactcaattggggttcaagtncgggagattaaagtgggcatctaatanggtgttattccaacctcaacgtnancgncctaattgttgagtgtnccttaagacan

SEQ ID NO: 94303 - DNA, 210 bp, Triticum aestivum
  unsure (1)..(210): unsure at all n locations
  Clone ID: PAT_TA_94303
ctcgtgccgaattcggcacgagatctgtagaaccatctagttatgctagtaatttttttttgcggggatatgctagtacatttcagctggttgtaacctacagtgtatggaatttcagatctccaatctccagggagaattaagtttgggtcttcttcaggagacatgtgcaagaagcanaanaaaaaaaaaaaaanaaaaaaaaaaaac

SEQ ID NO: 94304 - DNA, 478 bp, Triticum aestivum
  unsure (1)..(478): unsure at all n locations
  Clone ID: PAT_TA_94304
ttgtgttgatcgcgttcccgaatgcctatatacacgttcatcgattacatagaagctcagaaaatcggccaatcatgtctccatctaacgtgctcgcagcaaaacccagacaagaatcgacagtagcaagattattgggatcaggttctgccgggattgctgaactcgcagtctttcatcctgttgacaccatagcgaaacgcttaatgagtaaccaaagcagaatcagttcggtatcacaacttaatggtgttatatttgtttgataaatcatccgttatcagcccggtcagaaatttcttctccccttttccctgggaccttggttaatgcctgccggggctacaaagattccccaaaagaataatataagttttgggngggtcaaccattcngtacgttgactacttnaacnaaaatcacggntccacctttggggggtacttttgggnctaaaaactgggcaaaagcaaatnat

SEQ ID NO: 94305 - DNA, 455 bp, Triticum aestivum
  unsure (1)..(455): unsure at all n locations
  Clone ID: PAT_TA_94305
ttttttttttagtagtgtccaattaattttatttctctaaattacgtaaagaaagaaatgagtatccggtggctttttctcaataaagttctacgctccgtttgtgtgaaatgtaacaagtattagagctcaaggatcaaagtatgagagagcatagatccgagaaaagtactatgttagtaccatttgagaaggatgtttgtggccaattcaagacatgacgttttcaattctaggcaccgagagaaaatttcgtgatatgaaggttaaaatttaaaaacctgatccttaaaatagccaagttcctccaaaataaaaccatccaaatttccctggtcaagaaacaaatttcttcaaancaaagataaatttgtcataaggtgggggnccacaaacaaatatccttgaaattttcntccttgggttcccggggaaaaccggttttgagaaaaatc

SEQ ID NO: 94306 - DNA, 184 bp, Triticum aestivum
  unsure (1)..(184): unsure at all n locations
  Clone ID: PAT_TA_94306
ctctttttttttttttgacaaactttcnaggaaancgcntnattcttcccanccaattaccananggtgtcgtgcattgnaactggtccattaaaggngaatggcgttnctcttcnaccagtcaacgcccgatacntaatcgccacatctnacaanattaacctgacangcattantnagaaca

SEQ ID NO: 94307 - DNA, 313 bp, Triticum aestivum
  Clone ID: PAT_TA_94307
ctcgtgccgaattcggcacgagctcaaaagtggtgagagcagccgtgttctgatccatgttctttttactatattttattttttttcattctgatccatgttgtctggcaatgatgaagttaattgtgtttctgtcttgtacgttagtttaagttgtggcaggttaatttgtaacctcaatatgtaaaccataagtgtgcttgttcacgttgcggccaagtatactttcttcttacatgtgctgttgagtcgtgcatcaacttgttgttgggtgattgaataaaaggaaggattgacaaaaaaaaaaaaaaaa

SEQ ID NO: 94308 - DNA, 177 bp, Triticum aestivum
  unsure (1)..(177): unsure at all n locations
  Clone ID: PAT_TA_94308
ctcgtgccgctcntgccaaaatcganaacttnaggnttggcncnaggttgctcaggtggatgngaaaatctctgaatccggtccagcattggtngctgttccccttaaaggggggcanaaanccaccngaactgaanantttgcgaaatagattgtctcgcaaangagttaatcaca

SEQ ID NO: 94309 - DNA, 468 bp, Triticum aestivum
  unsure (1)..(468): unsure at all n locations
  Clone ID: PAT_TA_94309
ctcgtgccgaattcggcacgagcagccgcccccaggtctagggttccccctttcttcttctccacgcgaatcagctagatactagaaccagcatcgatggcggcggcagcaccggcggacgcgaaggcggaggccgccaagatggacctcctcgaggacgacgacgagttcgaggagttcgagatcgaccaagaatgggatgacaaggaagatggcaacgaagctgtccaagcaatgggaggatgactgggatgacgacgacgtgaatgacgatttctcactgcagctgaggaaagaagctggagggaaggaacactcaaaaagagntnaactnactttcccaaccaaatcaaangtgtnntacaactttatcctccattaaggaactgtntnggcaatgctcccctnaacctnggaaanttncctaacaatatcanagcctntgaaacctaacntcncgtttcaatg

SEQ ID NO: 94310 - DNA, 429 bp, Triticum aestivum
  unsure (1)..(429): unsure at all n locations
  Clone ID: PAT_TA_94310
ctccgctcccatctgccgcctctgccgagatccaaggcctccgacttgggggccgccgccgccgcggaaccccggggcaaggcaaggcgtggtcgtgttgcgggcagtgaggagcggcgcacggccgtgccctgcatctggttcccctttgctcccctcgttcccctccatcgcctccaacgttcaatctcgccgtcatgggatcgccgccgagccgaggacaaaggcaagtgttctatttgtgcattgtgacgggaattttcttggataacaaaggaagcgagctangaggagtacacgggtgggatgacagatgataaactttgatacgggcatgttgtcatccaaccgacgtggcccaaacatgctacgttttggcatgattggctttctaangtnaaaagacaatttatgcaacaatgttaaatg

SEQ ID NO: 94311 - DNA, 456 bp, Triticum aestivum
  unsure (1)..(456): unsure at all n locations
  Clone ID: PAT_TA_94311
gaaaactctgggataaaccggcgatagaaattcgcaaatccaaggaaactctgtacatcacggacagatcggggggtcggccattcttgaatgcaagccaccttctttggatccatagaaatacctcttgtcgacactatcaggcccagataagtgacttgtgttgtttcgaagtcgcatttcgaagatatctacttgtaggccatgctcacgaaggcgctgcaagacaattctaacatgtttccgatggtcgcaaagattgtccgagtatataagaatatccgtccatgtaggctgtgcagtaagttatccaagagtccgcgggagagccgtgattgatgtaaagcttgaaaagagggcagggccattgcaaaagancaaaaanggaaaaacgaaggggttcaaaaaagtccatatctncaggagggaagaagaaataccnnatttttttnccgt

SEQ ID NO: 94312 - DNA, 453 bp, Triticum aestivum
  unsure (1)..(453): unsure at all n locations
  Clone ID: PAT_TA_94312
tttttttttttttttttaacgactgatgatagtttagtctgtcgaaaagattaggttatagtaaattcatttaagattcataataatattaaaaatgggtgccccgcacacaagatatacctgtctcgagcgtgttcctatatgaaataatataatgaaactcctatcgcttaagcttggtaggtagaagcgctaacatttcccccccttccagtccaattcacatgaatgttttcaccgactttgtatttctcgtttgcaaattctggctttatttgaaaggtgtgcgcgccaaagtagtctctttgagccctggaggagattgggcaaggtanatttttggtacnatatcccgtcaaaaccaaatatanaagccggtgggagaantgcngggaagttgggaatnccccaagaangagcaanccttcgangacnanaatnccctccaaaccc

SEQ ID NO: 94313 - DNA, 455 bp, Triticum aestivum
  unsure (1)..(455): unsure at all n locations
  Clone ID: PAT_TA_94313
ccgccgtagatgagaagttttatttcgtagacatttcataacataatgaatgaccctagccaaggtattcagcgggaacttcttccacacatacatctcctttcaacatatcgatttccccaatttcctcagatacatccagaaaaaatatccgaatggcttcaggctgctcccaaaatatcgcgcgaccaggcacccttttattggacttacctagaccggccacaagatatgactattctgttagttnggcaaagcatggcacttggacctgagtttccaagtgacgggtatatatggactcctcaagaaatggccttccagatccaggtcgatggtggctatacacttgaaatgtaccagcacaaagctggatatgcgcctgggtgaacctatggcaactcatacccgacgtcgaatatcgtctcttgcctccacgaaattcctgggcaaca

SEQ ID NO: 94314 - DNA, 455 bp, Triticum aestivum
  unsure (1)..(455): unsure at all n locations
  Clone ID: PAT_TA_94314
tcgaacgtaatgtttgtgtcatgtaaggaattaaaatattctatggaattaacatggtcccttaatgacaactgtgaagcgaatccagagtatactaccttcctattcgtgaaacaaaagtaaaatcttcaacgatcctttagataaagcgtgcgcttgagccttcttgcggttgagtacttagatggatgataggaagcaagtgccaaggagtagtaattactcaaagtttttgcctcgcaaaaggccggcacttatcattgggcctcagttgagaatacactcctactttaaccggtcgttgattancctgtcaagttttaaggtaaaaaaaattgggttgtccctggcaacttggcaaagtttggcancnnaactcccaatngtactggtcaattnnattttggcnaaaagantgaattaacaaattggntntcccttttgncactccnggg

SEQ ID NO: 94315 - DNA, 241 bp, Triticum aestivum
  unsure (1)..(241): unsure at all n locations
  Clone ID: PAT_TA_94315
ctcgtgccgaattcggcacgancctctcccccctcccacngctcgcacgatcgaccacgcagagtcaaccccggtgcggcggccanggccaagcatggaggccgcggcggtcacggggctccgccccttcgccgcnccgctcggggcagnnacgagggcgggcgcgggttggnggtgcgcnccggnccagcggnggtttgggcggggcgcgcnngtggcggngangctggacngcggcgtg

SEQ ID NO: 94316 - DNA, 449 bp, Triticum aestivum
  unsure (1)..(449): unsure at all n locations
  Clone ID: PAT_TA_94316
cgaaattggaggccgggcagtgcgtctagactacgcaacacccaaacctgatcgtggagcttctggtgggcgaggcggaggtggtggtggaagagggcgaggcggatttggtgacagaggtggacgtggtggccgtggtggatctcggggtggtccccgtggtggtcgtggcggcagcactaatagaggagggtttggtgacttcaaaggtcaaaagaaaaccttttaaaaccgagtggtcaccataacacgggccaaacgcctgtgagaatgggtaattgtacgtgggccgagggttcttcaaaattcctctttggaatagtgggcttggggataatatttgtggtgcttgacatactgtgggtgctgggctcgtggctgtcccttaataagganctaactttttggtttntttttgaatnnaacctcnccantggggcccaatttcn

SEQ ID NO: 94317 - DNA, 461 bp, Triticum aestivum
  unsure (1)..(461): unsure at all n locations
  Clone ID: PAT_TA_94317
cctcctcctatcaagctatatacctacatagtacagccatggcccccaccgtgatggcctcgtcggccacctccgtcgctcctttccaggggctcaagtcnaccgccggcctccccgtcagccgccgctccaacggngctagcctcggcagcgtcagcaacggtggaaggatcaggtgcatgcaggtgtggcccatcgagggcattaagaagttcgagaccctgtcctacctgccaccgctcaagcacgggagggcctcctcantgcaggtcgactacctgntccgctccaagtgnggttgcccttgcctccagttcagcaaggnntgggtttaatcttccgttgagcaaatcgtaatcccctgggnnnctacgatggccggttaatgggcaaatntnggaacttggctatgttnnggggttnaaccganggccaacgcngggtgattaacngangtggtt

SEQ ID NO: 94318 - DNA, 451 bp, Triticum aestivum
  unsure (1)..(451): unsure at all n locations
  Clone ID: PAT_TA_94318
ctcgtgccgaattcggcacgaggagggcctcgtgctggtgctcgtggcatacctcgggcctacagttgtggctccgttgcacaggttcgctcttgggtatgccaagaggagcatggcggcgtgcttgtgcttgatggccgtgtatgctcttctgtctggcgcgcagcagctattctccttggcggcggccacggtgtactactaccaagccatggagagcaaggaggtgatcgatgacttgtggttatgctaagattagattcctaccagcagtggcggagcttgagatgaaattatggggaggcatgggctgaaggggggcaaacatgattacgttaggctgaatttagtcnaaaattagactaaatattaaggcatatttgcatgttttcctaanaactgggggggccaaggcccaagttgggctccaaatagctccgccactgcctaa

SEQ ID NO: 94319 - DNA, 453 bp, Triticum aestivum
  unsure (1)..(453): unsure at all n locations
  Clone ID: PAT_TA_94319
ttaggtcaagaccgccaggaccagttcagcatatctacaatatcatgagttccctatcaccccgtggccttttcaacattagaagtctcatgaacagatcctggtctcggtctctggctccccccaccagtcgagtaattcaaacaaaggcttcgcaaggtgccccaggcgatgagccagctaaaaccaatcttgaccttcacaaactcgcccgcttcgagaaaactagctattttgaatcgcgtaacgcaagcagcactatggaatctgagatcaacaccaatcctatctctgaaatcgcggngcctgctcactcaaatttctcttcaactggagcagcttaaaatatgatgcatcggaacaagaatttgacgcccgaacgttcgtcntnctggctgacnaanttgaaaatatccggcaaagtntgcntccggcgggggaaataacttgtcc

SEQ ID NO: 94320 - DNA, 447 bp, Triticum aestivum
  unsure (1)..(447): unsure at all n locations
  Clone ID: PAT_TA_94320
ctggactgctgtcttcaagttcggaggacccatgtataaggaatgggcagaaagtcaaattaacaagatcaagaatattctcaactccgctcgggctgaccatacagaagctgtcaagagcaggattgaaagtgtgaagcaactcgggggtgttgtggacattactaagaccctctttgaagtctcaaaggaaactgccaaacttgaagctcaggcattcgaacttgaacagaaaactgcactcgctgctgaagccaaggctgtacttgattcatggataagatacgagggacaagtaaaattacgagaacaaaaagaattatctgagaaagtaattgcaaatgttaaagaaagagctccaaaatccaaagttccncaagcagattttgcaacaaagcgntttgggacgtccaaaggaatcctacaagtccaaagggacaatanttn

SEQ ID NO: 94321 - DNA, 265 bp, Triticum aestivum
  unsure (1)..(265): unsure at all n locations
  Clone ID: PAT_TA_94321
ctcgtgccgaattcggcacgagganccgccgagccgggaagagncaccatcccatcgcctccgtttccgaagggncagagatggaggaccgtgntaancacccatcngtcatgcaaangtttgntggacagttccagcttgcctcnagcttctctgagggtgttcgtgcncgcanaatctgcccttctgatgccaacctatgaagaggcgcttcaccacaagcaagccacattgagtcagaancttggcatcagtgtcccaatta

SEQ ID NO: 94322 - DNA, 458 bp, Triticum aestivum
  unsure (1)..(458): unsure at all n locations
  Clone ID: PAT_TA_94322
ctcgtgccgcgttatcacacaaaacatctagctctgccaaaatagagttcgaagcttttcaaaatgaccaattattccccgaacccactattgaatcacaggcattttcatgcttaccaccaaaatcaacgcatccagggatcccaaactgggcctcanattttcaacaattatccttagtacaaccgcagctacatacctctacatttcaggtttctcaaacgcaaggatatcatggcaccgatnaacagcaatttcttaacaaaaacattccaacatcaacangcttaaaaggattcagaagtatggggctatcttcnaaactacgggtttaattttgggcgaaatgaacccgtgaaagttattacactnttcctatcaaactatgggggaaaacctacnaagcaaaaaanatttggcaaaangttttggtgaaatnactcctttcntaatcaaaa

SEQ ID NO: 94323 - DNA, 256 bp, Triticum aestivum
  unsure (1)..(256): unsure at all n locations
  Clone ID: PAT_TA_94323
ctcgtgccgaattcggcacgagganagagagagagaggggaaggctatttgggcggcgaanataaangggggtgataangggctcctctggaggctgcccctngtcacttcaatgnanctcntgcatcatcnttcnctccttcggnctcgntattangcntncggctccgnngaccgttgtcggncttcttcgtctcgtntatgattaggttantngttttcctntactcanatttatgcttcanangttagtttc

SEQ ID NO: 94324 - DNA, 343 bp, Triticum aestivum
  unsure (1)..(343): unsure at all n locations
  Clone ID: PAT_TA_94324
gaactagtctcgagtttttttttttttttttttttttttttttttttttttttttnagggggcaccccttcncccnaanttacggggctattttgccganttccttagagagagttgtctcgcgcccctangtattcnctacctacccacctgtgtcggtttcgggtacaggtacccttttgttganggncgttcnaggcttttcctgggagtatggnatcanttacanacctcagcgcccgtaacgcctggtatgangccctccgtnggagaancaatnctctangtccaacgggggcttaatacttcantngcntgcaaccctttggtcantccgggaccc

SEQ ID NO: 94325 - DNA, 358 bp, Triticum aestivum
  unsure (1)..(358): unsure at all n locations
  Clone ID: PAT_TA_94325
tcctgagggtgcattttacatggtgggagacatcgacgctgctagggccaagggagaaaagatcttggctgaattgtcggacaagtaatcgctcggatgaaatcggactttatgtgatcaggaagaaattttttgtaatgcangcgatatgtaaaaagaataaaagtgaacggacctacagagcagataattgcatatggggaaaatgcctgggttcggcggagatacatcccaacgactagcttgtaacatttgaaaatattttcattttcttatacttcattcgaatatttcggttactaatccttcctgaaataataannttaacctgatttatcccaagttcacaccnaacccc

SEQ ID NO: 94326 - DNA, 296 bp, Triticum aestivum
  unsure (1)..(296): unsure at all n locations
  Clone ID: PAT_TA_94326
ctcgtgccgaattcggcacgagctgggccaaagtgcaaaagttcaaggaagaagtggctagactggagaatgaatgggtagaaaaggttgtgcggtgagaatatcagcgcgcatgtatcatcactaaaactcatgtcattgcgaaaaatgacatttgaataattgtaagttgtaactttggcgccgggcacggtctacctcgccatactcagctgagcggttagggctgtaggaattgtgctcaattacccgaggcggggtttccgatataaanaanaaanaanaaaaaaaaaaaa

SEQ ID NO: 94327 - DNA, 344 bp, Triticum aestivum
  Clone ID: PAT_TA_94327
tgcggcaatacttacaatggttgggatgatatggtcctgaaaggtaaccctgaaatttccaaatttattgcttattataccaagggagaaactgtggtagctgtggccacgatgggtgtggatcctgtggttatgcaggcgagtgagctgatgaggattaacgccatgcctagtaagagtgaactgttaaacgatgtagatattctcaaaataggcatttctagggagggaaagatgtaagctccatcttatggagaccctaggaatatttggtcacgcacatagtgatggtttatttctcattccacaatttgccataatcagattgaaccattccagcatcc

SEQ ID NO: 94328 - DNA, 501 bp, Triticum aestivum
  unsure (1)..(501): unsure at all n locations
  Clone ID: PAT_TA_94328
aagctatatacctacatagnacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaanttcgaagaccctgtcctactttgccaaccgctcaacacgggaggccctcctcaaagcaaggtcgaactacctgatcccgcctccaaagtggggtgcccttggccctccgagttcaagcaaagggttggggttcaatccttcccgtngaggcaacaaacgcaatccccctggggtnactaatnattnggcccggtactgggacnattgtngnaagcctggccnaatgnttncnggtggcaaccgaacccccnacaacaaagtggatnaancganggttgganggaangtcnaangaaaggan

SEQ ID NO: 94329 - DNA, 537 bp, Triticum aestivum
  unsure (1)..(537): unsure at all n locations
  Clone ID: PAT_TA_94329
caagagcggcaagccgctgcactacaagggcaagcgccttccaccgcgtgatccccgacttcatgtgccagggcggcgacttcaccaggggcaacggcaccgggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaaagcaggtcgtcatcgcccgactgcgggcaactctaaattcgcccgcccgccggtcgccgtcgtcgtcatcgccccgtgtgtcccgtgtcgtgtctcnatttaaataagaaaatcnngtgtcctgtcctcccctggtccgttcgataaatttccgtggttgggttaaganggnttagtgggcncttgggccgct

SEQ ID NO: 94330 - DNA, 543 bp, Triticum aestivum
  unsure (1)..(543): unsure at all n locations
  Clone ID: PAT_TA_94330
gccgagcgcagcaacgcggacgacgtcgcgcaaaggtctcgcgtaagaaataaaacttgccttggtaccaaaggattacagatgatttcagtccatcacttcatgagacttgatatgctgcacggacaagccctttttctctatcacgcaggtcattattttgatccaataccgcgacctttactcgttcgagacagttacgggtcgattcccacagttccagtgctttgacctatcctagacagagtcgtaataactgaagcaaaaaggacgcaaatttgagatcgagataggtttcaaacacgatatgattgatgtcgatttgctacttagttggaggctaatttangtgttggggattaattttacctcaagcacgaggtatctatatcttgggtcaactacccctaatgatgtctaacaanccttactcaacaagaaaatccaaattcctaccccgctccgtcncaaagcccttgggaataacnttttcaagccaaacgggggtananttncctacccaaattttttggggcaatnngg

SEQ ID NO: 94331 - DNA, 511 bp, Triticum aestivum
  unsure (1)..(511): unsure at all n locations
  Clone ID: PAT_TA_94331
ctggtgccgaattcggcaccaagcatatttgtcttcgcggatagtattccaaaaattatagactagctttggagggcgaatcatagcgaaaaatttatttactataataagacacaggtttgcgcaatctctaataccctcaatttccgctttttcccncctccaaggnttaaagatcctgttggntattttttcaagatttaaaagtttatgaattcaaaccaagaataacgaccaaatttacaacttatatttctcctcaacctcnaaatgccttgcactctacatccaacaagttacggggggtaattttaatcaaaaaagatnaagggttaattaaatcctagagctacaanatgggaactatcctaccaaaggatacaagtttttggggcaaaanaaaaagtgctgcaagganaagctgggttttcaanacctgggnatggntggggtacccagaatcaatcactngattcaancctanccgagggacaaatccggggtntcanaa

SEQ ID NO: 94332 - DNA, 179 bp, Triticum aestivum
  unsure (1)..(179): unsure at all n locations
  Clone ID: PAT_TA_94332
gagagaganacagcacncccntgttttggcatcctcccggccacctnantggcttgcagganctcttgcagcanattgttcctgagttcanactcttnactgtngtancatcatccattccnctgaatccatttnccgtcccnggagacnggatccctcgctgttcnccaatgctccat

SEQ ID NO: 94333 - DNA, 547 bp, Triticum aestivum
  unsure (1)..(547): unsure at all n locations
  Clone ID: PAT_TA_94333
gcagacagggcttccaacttgacggatgcagctgttgatagtctggtccagtctatcaacgtggccgacggtgtgaaggccagatttttcaccaatatcctggcacttgcggaatctgcaggagagaaggtccttgctttcagtcagtacctacttcccatgaaatttttggaaaggctactggttaagacaaggggctggcatgtaggaaaggagatgtttgtgatccgtggtgatagtaaatgtactatggaagaaagagaactgacagtggctcagtttaacaactctgctgatgcaaaagtcctgtttggctctatcaaggcatgtggggagggcatctccctggtgggcgcatcgagagtggtcattctagatgttcacttgaacccctccgttacccgtcaggcaatcgggcgggcgttcaagcctggacagcaaaagaaagtttttgtctacagggctcnttancaanctgactcccggggggagaacaacccataaaactgcggtccaanaaggaggnataccnaaccctgtgggttta

SEQ ID NO: 94334 - DNA, 407 bp, Triticum aestivum
  unsure (1)..(407): unsure at all n locations
  Clone ID: PAT_TA_94334
ccctatcgcatcgagcctttctacaaatcaagtaaatctcgaatctgccccaaagaaatgtctgagtctttgctaagacctgctggcagccatggcggatctattgaacttaaagaaaataccataattgtagtacttggggcatccggtgatttagcgaagaaaaagacctttccagctctttttggcctttatcgaaaccaagttcctcccaaatgatatacaaattgttggatacgctcganctaagatggaccacgaaagagtttctgaaacgagtcagtcctacattaagncaccanctaanggagctaggaacaacaagctgggaagaattctgcnagtcnctggctcctacgttcncaaggcaaatatgattagcgatgnatcctttcnngcgtttacga

SEQ ID NO: 94335 - DNA, 570 bp, Triticum aestivum
  unsure (1)..(570): unsure at all n locations
  Clone ID: PAT_TA_94335
ctcgtgccgaattcggcacgaggctggaagcatagtgtcccgaaatcggaatattgtattacgagctactctacccctggctattggattaactgctggatgggcactactgccaaattctttacaaaatatttcaaatctagcctggaaatatgagcaaaagtttccagttattgctgaaagtcatattcgcagcagagaagcagtcgaaaagacctggatgattgctagggcgcgcagtcaacaagcttccgatatcgtgaatgagggagttagtgcgactcgaaacgccgtggagggatgggtcaaaaaagggaaataancttgttgtttaagcttactgcacaaacccccgtaaagctgttcatactcatcttcaacatatcctggagtcaagtgnattcaaaagacgtgcccaggcccttgtcctcaaaaaagatttttatanacggtagcctacataaacctacngtcntttaatatcnanttngaaatgcgnaatgccnngtntttgtaataattaangnaactgggangccaantanactataaattccaattncttaaaaa

SEQ ID NO: 94336 - DNA, 302 bp, Triticum aestivum
  unsure (1)..(302): unsure at all n locations
  Clone ID: PAT_TA_94336
catggcggagacggtgtancgctgcttcgtgggcggcctcgcctgggccancgnnagacanaaacctccancaggccttcagccagtanggttagatcctcnacgccaagatcatcaannaccgcganacggngaggtcccgtgggttcggcttcctcacgttcggnagcgaggantcgangcnccangccatccaggagatnaacggtaaggnnctcgacggncgcancatcaccgtcantgaggcccantccncgccgctctggcggtnagncgcgtancgcngcggctacggnttcagc

SEQ ID NO: 94337 - DNA, 552 bp, Triticum aestivum
  unsure (1)..(552): unsure at all n locations
  Clone ID: PAT_TA_94337
attttgtgggcattctatacttttattcaaggattattcgctacaggcctatgggttcttgcacacgagtgtggacatcaatctttttccacttccaagatactaaatgatacaacgggctggatttgtcactctgctttactcgtcccttacttttcatggaaaatttcccatggaaagcatcacanggctactggaaacatggagcgtgacatggtatttgtaccaaaaacacgtgaagtattcgcctcccgtgttggaaagtttctccatgaaatagacnagttaaccgaggaggctcccatcatgaccttattacactctattgctcaacaactatngggatggcctctctatncttttcgcaaatgttactggncatgactttcacgaacgccaaatctgaagggtcnttggtaaaggganagaanaatggattccggcaacggggtnaatcaatttgattcaangtngnccactattttgaatccaaacanggcngggcctantanacctacnngacaattgcancgcggaanannggcaagatnn

SEQ ID NO: 94338 - DNA, 567 bp, Triticum aestivum
  unsure (1)..(567): unsure at all n locations
  Clone ID: PAT_TA_94338
tcagtgttgtgtagcttcacaaacatctcctgcccatcacaactgagattgaattttggcctgcaacctttgctccggtccctttggtcaatgatctcatgtccaggggcacatgcacaagctggcctaggtgtatacacacatattccattcataccacagagaccacgtatagagcaggtccgaggatatgccatccatgtgaccgaccatcttccatctgacttatttagactgtataatctaaggttgccatcataattcaatgttagcctcctcataaccttgagaccccaagtcagtcgccttaaatgttaaattgtcacttccaaggaaataacctgagctatctaggaccccaattgtggtgggtattaaccgagcttctttgcttttcccagatattcttattaggattggccaataagataaaagagatatccgtctgatnataaaacagtgtgagtaaaangttgatcatcaaaatggaagctggtngcggcccaagnaanaagttaccctattaccaaatccaanttttggtagcaanaagtnattgtttgattg

SEQ ID NO: 94339 - DNA, 493 bp, Triticum aestivum
  unsure (1)..(493): unsure at all n locations
  Clone ID: PAT_TA_94339
gtctgatttaactatcttaagattcattagtagtcgtttcaatattttcgtgttattattcgtcagtaccacatgtgctccgcaaacataaaatacttctgctattgctgcagttttcgatgcatcgaatttgcttcatttcaccgaagttccagaacccgccatgttatgagatgacgaatgatatgatggaaatgagctaactaacggcgagaaatagaaattccaaacaaatcattcaatttttcaagtacagagttccgaggagattttcgtgagaagtaatgatttgatgacttaaaatgataaacgaaatacttgaaataaactaacagatacacctaatagtggncatctctaccaagattctaacactcttcctagttnatttgagttggtagtcnagccgtgatgggcnggngatttatcaatataactttgaacaacaactttattaactcctttgatacctttcgcaacggaanatatccta

SEQ ID NO: 94340 - DNA, 322 bp, Triticum aestivum
  unsure (1)..(322): unsure at all n locations
  Clone ID: PAT_TA_94340
ctcgtgccgaattcggcacgaggccttttggccgagtggttgtgctcctgtcccatgcatgatgtagggtggcaacttctttcctgagacatatatcatgttcattatctatggtttgtgttctgcacactggttgtgacagcaactcactgtcaggttttcaatgctagcacatctgtacagtaaagtanagtgtgaagaaatgtcctgtttaggctaattgagctgatacttctgttaaggcactaacaattgcctttatcactgcaccaatcttggttttgacccaggcaaaagaatttttttaaaaaaaaaaaaaaaa

SEQ ID NO: 94341 - DNA, 451 bp, Triticum aestivum
  unsure (1)..(451): unsure at all n locations
  Clone ID: PAT_TA_94341
ctcgtgccgaattcggcacgagcgggacgcgctgcagccatccttgtcgtcggcggcggccctcctcgtcgtcgccgccgacggcggcgacggtgatgcatcaggatccaacaaattttaaatttctgctatgtagttcatttagcgtgcgcgctgagtgcgtacgtcgttggttcaggtcttgcgacgaacgagggaggcgaggagcagacacctcctgacaaagtaatggaagcagagaagccgtgggcgtgctgcagcagcaccgtgtgcaaggagtcgctcccgccggtgtgccgctgcctggacaaggtgaaggagtgcgccgcccgcgtgcaagctgtgcganccgtccggggtcaagccacgtcgtctgcaacgactgggtaccgtggncgacccaagggcccatgtgngccnaaggangagtggncgtgcaacnntgntgcga

SEQ ID NO: 94342 - DNA, 553 bp, Triticum aestivum
  unsure (1)..(553): unsure at all n locations
  Clone ID: PAT_TA_94342
ggtcaatgaatcattcgtattaactcattaaagaatcataatatctaagccgtttaacgatccccttcattagaaacaaaaacttcttatctgtaaatgactatgactgaagatcatacagtaggacatacttcctcggtgcgcaatgcatcggcaaccagagaggagatgtcacaggctagacttcctatacagtaccgcgatggttgcgccgggcttctaattccactcaatcgatgtcgattcaaagaatattacctaccatggaaatgtgagaacgaaagacatagctacgagaaatgccaagtacgatgaatttttaatgcgagttgccaagatggatgaactaagagctgcgaaaggtggaaaaagaagcaactagcaacctatgtgactcactagcatcaaagggcaatttcaatagcaacaagganggattgggttttttaaatcaattaatgnggggggtttccnccngaggtataaaggccaaaancngttatttatgtttatgggaanattccaatgtngcaaaaagacanttaaaatntgg

SEQ ID NO: 94343 - DNA, 405 bp, Triticum aestivum
  unsure (1)..(405): unsure at all n locations
  Clone ID: PAT_TA_94343
catataaaatatacaacttagctctttttcaatcgatgaaaatcaatggcttcccatctatctgcgctggtgcgaaagccaccaaagcttggaaacaaaaaagtatacttacctgactttacaatcacccttctcaatacgccccatagcccgccaacatttgcatcctttgttgttccactaanaatttaacaagctcgacatgcgtgactatctttggaatatgtacaacattcnatgtcttgatgtgcgatcanttatcatacaacagaagctccaattcgattgcccttggangcgcngcgacctcntngaagagccatttagaccaaaatccggtcaangcgtntggacantccagaatgggcaaaaggggtcntctgggcccaanactgggggggantt

SEQ ID NO: 94344 - DNA, 452 bp, Triticum aestivum
  unsure (1)..(452): unsure at all n locations
  Clone ID: PAT_TA_94344
cgagaacctaacccaaaccaagagctccggcggtggccatggatnccctcgccgtgctccgggactacgccgcccgcggngacctgtaaaagatnatnttcaacggcnacgacgtcctcttcggngacgactanaccttcccgggcaacgcccccaccgccttcanctccaagcagtccggncgnccctaaccgctctccgccgccgttttcctcgcccancanaacgacctcaagcacactgaattcctccaaggccgcccgcctccgccgggattccggcccgtntncctcccccgaaacgnaagaacttcctcgactttctccanttcgggggaaaagntccctccccttccggcggaggccctcctnccctcctccttnggggnaaggaaagccccggcccccggcccccgcccgncnggaaggaacaaggaaggggggaagggcccc

SEQ ID NO: 94345 - DNA, 496 bp, Triticum aestivum
  unsure (1)..(496): unsure at all n locations
  Clone ID: PAT_TA_94345
ctcgtgccgaattcggcagaggatcttaaatgagatccactcggggacatgtggtcaccatgcgtcctctcgggccatcgtgtccaaagcataccgagcaggattctactagccgcgtgcaaataagatggcaaaagatatagtcgacaagtgcgaaggctcccagttctattcaaacatgtctcacaagcctgcatctgccttgaagactattccactcgtctggccgtttgaagtttgggggttggatatggttggacccttaaagaccggcaagaaagtggtttcactcatttgctcgtggcaagtcgacaaattcaccaaagtggatcgaanccaagcctaacaaagaaccttgattcaaagaaactgtcaacaagtttcnatcaagagaagnctgatactcaaaatattgggagntctggtccggngtcnaaaccggcgggntttcggggtanngggggtccccgaaactgttccntccaaaaggaagatt

SEQ ID NO: 94346 - DNA, 456 bp, Triticum aestivum
  unsure (1)..(456): unsure at all n locations
  Clone ID: PAT_TA_94346
ttttttttttttttgnggnnaaaaaatgcngcaacccaagangagatnanaaaaacggggngcgcgcgcgcgcacacacacacacacacacacgaatgggactaataaaactanaacgtcntttttcgtcatccaacctgatcggtgtaacgtcncggtcaacaaaanancgcancggttttanatgccggggngggcgggcgtgcccacttttgcccttaaaccgaaccantgcctnngcgcgggggtcnccccccccccccaacgggggcnccggaangctgatcttcncgnggggananaanttcccctgggagcccccncgaaagggggttaaantccaancttcccngctcngcccaanttncctttntttgcccccgggatcnggcggccccctttgatttnaantttcaaaaanttctccaaccnccccccccnnggcngggggggcgg

SEQ ID NO: 94347 - DNA, 405 bp, Triticum aestivum
  unsure (1)..(405): unsure at all n locations
  Clone ID: PAT_TA_94347
ctcgtgccgaattcggcacgagctcgtgccgaattcggcacgaggcaagaaaatcctccangttcatccacagcataggaagcggggagatggaagggagcancagccggacgccggagataaccatcgtcccggcgcctaggccggcggcggccggtggcggtggcgccgtcaggcggtgaangcggcgagcaangagcccatcagcccgggctcgccttccccggccagcaaggagcgccccggtgccgtctcccctgcccggggtggaaagctcgactnccctctgcnacgggagtccagctccgccnaccgnccatnatgggcgccgcttcccctatttncngaaanccaangngcgttcttttgtcaatccctttcnctaaataatttcccgggctgggt

SEQ ID NO: 94348 - DNA, 488 bp, Triticum aestivum
  unsure (1)..(488): unsure at all n locations
  Clone ID: PAT_TA_94348
ttttttgggttcatcagatttggaggatgtcttgcaactgtggatccggttgcagctgcggctcagactgcaagtgcgggaagatgtaccctgatctgacggagcagggcagtgccgcggcccaggtcgccgccgtggtcgtcctcggcgtggcgcctgagaacaaggcggggcagttcgaggtggccgccggccagtccgngcgagggctgcagctgcggcgacaactgcaagtgcaacccctgcaactgttaagctgcatgcactcgtgtgatggtgtgagagtatacnttgaataacgaagcgtcccctctgatcngatggagtcgagcaagggtgcgtgtgcgtgtgcgtgtggtttactttgctcgctctcccgcctatgctccttgcccttgggagtccctttgtgtgtaagtggtgtgcnacgtgtccccggtaantgcttnaaccnacctccaactatgggatggnagtnaatcaaaaan

SEQ ID NO: 94349 - DNA, 473 bp, Triticum aestivum
  unsure (1)..(473): unsure at all n locations
  Clone ID: PAT_TA_94349
ctcgtgccgaattcggcacgagcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcaagcacggaggccctcctcaagcaggtcgactacctgatccgctccaagtggggtgccttgcctncnagttcagcaaggttggggtttatcttccgtgagcacaaacgcancccctggggtactacgattggccgggtactnggacnaatgttggaagctgcctaatgtttcggggtgcnaccggaaccccaacgcaaggtnaattaaangaaggtggnaggaggtcaaanaaaggnntttncctggacac

SEQ ID NO: 94350 - DNA, 197 bp, Triticum aestivum
  unsure (1)..(197): unsure at all n locations
  Clone ID: PAT_TA_94350
ctcgtgccgaattcggcacganatanaagcaaaatanttgtgattaactttactaanaaagtgagcatanatgcttatttttaactnacttagntacaattcatnaaataaatacaananaaaatagttgtgattancttaaccaaaaaaatgancatagangcttatttttaatgacttactacaatctcagaact

SEQ ID NO: 94351 - DNA, 493 bp, Triticum aestivum
  unsure (1)..(493): unsure at all n locations
  Clone ID: PAT_TA_94351
ctcgtgccgaattcggcacgagcaggaggaaaaaaggtactttcataatgggaactatatacgttgacactacccttgggttagacaatgaaactgcttcaggctcagaaactaaaccatataaatctttggcctatgcttacattagggagggtggaattgaaggcaaaacttgtcttgttcgcgcttctaatccagctacagtgattgatgatcctaaaatcgatgacggacatatttggaaggagcctgctaagagcgccatcaaaaaagcacaaagcgctctagacgctcacaagaaaaaacttttaaaacaacaacaaggtcgccacacaggaagctgaaagaagaaactacccgattaaaanaaccttgaagatgcgaagaaaagtgggtcatcgaaacaaanaactcgtcgttnnccggaaagcttataaaaaatcacaatcccgcgaacaaaaagtctgggtgtttaggcgaggggtnattacca

SEQ ID NO: 94352 - DNA, 473 bp, Triticum aestivum
  unsure (1)..(473): unsure at all n locations
  Clone ID: PAT_TA_94352
gacgacctgcgggagcaagaatacgaagtggactcaatattaacgagcaagaacagtgagacgcggccgtggtaaatttanacaggccttggttaagtggactggctgggtagagccaanatgggagccnanngaatacgtctcagacacggaggctttgagaatatttgaggacacctatggtccaataacaaccaataatggcccttcanagaataattcaggtcgatatgttggtcangcagaacctcatgtccagaggtcacggngagaacgtcggcaaggaaatacaaggagatattaanaataaaatananaatatatatntancatatacttgangcccttcagangaanaggggggattgtgacnggcngttaaancccaaaaagaactcctggtngccaacccctggctncccgtangccatncgccancatgggggaanngtcctccgggnacgcnacaacaa

SEQ ID NO: 94353 - DNA, 307 bp, Triticum aestivum
  Clone ID: PAT_TA_94353
gtgatagtcattgacttccacgcccagcccatcatccacctccctcccaatcggatccacccacccacccttcctcacctccctccctataatttctcttcccccgctcccaactgcttcccagtctgacgccgtccccctcctcggttgttccaccggctcactccgctgcccgccgcccccctctgtccgcccgcccgccggcgaagggttcggcgcttgtttttccggcgagcttgctctggggcgtgtggaggctgcggaacatggcggggaaggggaagggggaggaggtgtacctggcgtc

SEQ ID NO: 94354 - DNA, 494 bp, Triticum aestivum
  unsure (1)..(494): unsure at all n locations
  Clone ID: PAT_TA_94354
ctcgtgccgaattcggcacgaggccaccgggcgccgatggcgtcctgctggggccgcttcggcctggcggcgctgtggcacaggctccggcaccttttcctggcgcggcggagggcgcggcacggccgctccatcctcggcgccggcgggctcaactacgacccgctgagctacgcgcagaacttcgacgacagcagcctcgagctccacgaagccggacttcacggncaagttcgcgcccgcccgcaacgcctgctcgcccangcgggcatgancaagaacgaacgcgccaattcctccggggccccggtggcaatacgggaggatnccttttgccaattcccngggcctttgtgcgcccctttnagtggtaaaaaggntttaattaatccacgtattttccgnaaaatgtacatgtacnaaatgtcaagcggggtganncaagtantttttcctttttattcccgggtgtaaaaattccctgtggggtttcn

SEQ ID NO: 94355 - DNA, 501 bp, Triticum aestivum
  unsure (1)..(501): unsure at all n locations
  Clone ID: PAT_TA_94355
ctcgtgccgaattcggcacgagcactcccacactaaccagcatgccacacacagctgaagctgaaagtgatgagattgtagaatctaggcttgcggtctctgatcacaagatttctggaccagataacagcaacagagcacatctagaactcggaatcacattagccctttttctctggccatcactcactctcgctgtttcggctgcatggggtggccccgattccgcatcaaagcgtgaatggttcgcttcagagacaattgatctcgttgctgccaaccctgacgcttatnttgaatggattgaaagaatttttggtaaatgttatgctagattaattttgaaagttgaatggncatnaataaagtgctcaatgaagttnnccaaaccaatggggcgcttaatttaagggttggtggggaacnggaaaactggggcttgagggtcctaacaaattaaangngnaaaatnggaatcnaanggganaaaaggttnaaatt

SEQ ID NO: 94356 - DNA, 476 bp, Triticum aestivum
  unsure (1)..(476): unsure at all n locations
  Clone ID: PAT_TA_94356
cacctccttgataatcaccataagtttgccatanatctgcagaagaatacatggccgataatgatgaagatacgttggcacctaattcggagccattggacttagtccgtctgtgtttggacgaagttgtctttgtcaagctacgcggagatcgggagctcaaaggcagacttcatgcctatgacagtcattgtaatctggttatgggtgatgttgaagagacagtttatgtgatggacgatgacgaagacgatactctcaagaaagttcacaaaaagcttgaaatgctgtttgtcagaggtgatagcgtcgttctgatctcgccccgagggacctaagatnaactagaattaatangaagactccatggcattaaatgcatgtatcaagggacttgagattttaaacgtggattaactacaaaaaganctgcacattttaagggatgaacntaagacaagggttgtttcaatttn

SEQ ID NO: 94357 - DNA, 496 bp, Triticum aestivum
  unsure (1)..(496): unsure at all n locations
  Clone ID: PAT_TA_94357
ctcgtgccgaattcggcacgaggcttcattttctcttcataacgtcgttcttcgtcacgatatcccaaatagcgctaggggtaccgtaagcgaatcatacccgcatcttatttttgaaggttttacgtccaaacttggtcttcggatcgtcaaaatactcaaacacctcttccctccccgagaggccattacaaatagatcaaaaatgggaagcagggtggtaactttcaaaaatgttaaagatagtattgaactcaggcatcacgtttttgtcaagaccagctatcaaaagcgtaaaattggcggaggtaggccccgagaatgacaaataagatgttttgaaattcgggggtggtacctttgggagaaataaagggatggtgatgtaanaaatgggcgnttaaaatcaantacaactagggacaaagtccgaaaaaaaaagatttactaataaaataaacttggtttaatccaattaagccgaaggaagttaagt

SEQ ID NO: 94358 - DNA, 453 bp, Triticum aestivum
  unsure (1)..(453): unsure at all n locations
  Clone ID: PAT_TA_94358
gacttttcgtccctctgctcactgccttttctcttcctgctcctcgtcgccaacggcaaggccaccatgctaaacatcaccaaccgatgctcctacacggtgtggccggccgccgtgcccatcggcggtggcgtgcagctcgacccggggaagacgtggatcctcgacgtatccggcctcacctccagaggacgcctgtgggcgcgcacgggctgctcattcgacggcagaggcgacggttcatgccanacgggcgactgcggcggtacgctcgcctgcacggactacggncanccgccggtcacactggccgagttcacgactggccatgggcanacnggacgatttcttcgatatctccctcgtcaaaggggttcaaacgtgccatggattttctgccngtgccaacaaaaggagggncggggtgttacnaaggggcncnctgcgaaacaa

SEQ ID NO: 94359 - DNA, 300 bp, Triticum aestivum
  unsure (1)..(300): unsure at all n locations
  Clone ID: PAT_TA_94359
ctcttgccgaattcggcacgaggtcancagctacctttctcccatccatcctcgacnattcttccttcgctctcgtatcgtgcagcgtcttcggaggcgatgaagttcctggtggagtcgggcgacnccnaggggantgcngggncgtcgtaccggatacgtgctggtcaagganaccggnctgctgcantccccgcccggngtcgactgcctctgggacctcttccncncttccgtggagaatgtaccccancaacccgatgctcngtcaccnggctacttgttcgacngnanggccgg

SEQ ID NO: 94360 - DNA, 455 bp, Triticum aestivum
  unsure (1)..(455): unsure at all n locations
  Clone ID: PAT_TA_94360
ctcgtgcccttcccgcagatccaaaaccacggcgacggttgtgcggatcgaaaagccatggcagcggacctcatggatccatctccctcaccccctcagccccacgcacccacgcccgccacccccaaccctcttcctccgtctgtgatctcgatcggccgtgctctccaccgcccgcctcgacttcgccggagacagaggcgtcgccgcccagcaaccacggctgtcttgctcaccgacgagcacggcgctccatcaatctggccggacccggcgcgcgcgtggcctgtttagggtcttcggccaccaggacggcacaagcgccatcggctccctcggctccggcgactgcgaccgcgnccggnnactggcagcgggcgtctctcccagtttctgggacgagccgggnagcacnaagtgctttgggctgttcggcaactccgaggngatttacg

SEQ ID NO: 94361 - DNA, 287 bp, Triticum aestivum
  unsure (1)..(287): unsure at all n locations
  Clone ID: PAT_TA_94361
agaatacgtttctattttgcaatggatgtccttcactaacggagagattgcttcctcattctccggctggcttctcccaatatatggccgaacccaatacaacaaaaaggtagtagatgagtctcttaaagcaacaaacagggtactagaaactcttgaggaacatctcctccacaacacctacttgattggagatattctgtctcttgccgatatattctgtattggaataatgtcnaaagggtttcaatatcaatttggnaaanaatggngggcancaaatccca

SEQ ID NO: 94362 - DNA, 473 bp, Triticum aestivum
  unsure (1)..(473): unsure at all n locations
  Clone ID: PAT_TA_94362
cgacgacgaccaccggggctcggagcttgtcggcgagggtgcaggaggaggcggagcttgacgctgggatgtccaggaggtcggcgttgacgctgcggaccagacggtgtctaggatgaggaccgaaggagtctgccggtggctaatttgatggtggtgcgccatgaccgaggttggagagcaaggtcgctgccgacggctatggcgtgtccctggctcagtcaatgaagcaggagtgagagggagacagggcgaggcggatgcacatgatgctgaagctcgtggttgtctccagccacatcaacgacaagcgacggccatgggggtgctcggtttggtccgatnttcctgatccaaaggtgtacgaacccgangcccggtngcggaggcnaggtccggccctcctaatgcccanggagtgttttttcantttgaccgcgggttgttccttttttnaaaaaaatnaaggggaa

SEQ ID NO: 94363 - DNA, 230 bp, Triticum aestivum
  unsure (1)..(230): unsure at all n locations
  Clone ID: PAT_TA_94363
gaggaactcaagccagtggtgtaatgtgttgagtatggctatgtggtaaaacagatagatagggagataatttgttccatgtggtaaatgaagatgcaaccaagaatttttgttggtgcggtatgaatatgctctccctcccctccccaagaagagggacagggagtgtcgtcgatnaaaaaaaaaaaaaaaaaaaaaaaaaaaaaaaaaaaaaaaaaaaaaaaaaaaan

SEQ ID NO: 94364 - DNA, 341 bp, Triticum aestivum
  unsure (1)..(341): unsure at all n locations
  Clone ID: PAT_TA_94364
ctcgtgccgaattcggcacgagctcgtgccgaattcggcacgaggtttgagtatgtaaatagtaatacattttttctgcagtcttcatcaaatatagagaagtgtaacataggacaaaattgtgcgccatcgtatttgaaatataaaaatatgtgttctgtctacatgagcattgaacattccacccattttgtgttgcttcgtgtttcccagactatgggacccgaacggtggaaagaaccttgtcactgccgagcatttgtccacactttatgcatcggccgctgtttgatgggagaggatgactaaangacggtctgtgcccgtncccagcnatcccc

SEQ ID NO: 94365 - DNA, 505 bp, Triticum aestivum
  unsure (1)..(505): unsure at all n locations
  Clone ID: PAT_TA_94365
gccaggagcctcatttacgaaagtataagattcaaaatgtttaaatacccaaggtcaaagcccatttcgactttgatcagtgacctcagacaaaaatcacaagcacgaaataatccaactacaactacagaattaacatcaaaaaagtttatttcagctaaaagaagagtcttctgggtaccaagtcctagcaagtttgttcctgatgtccaagacattcctatctttaattggtcgtaacatgagcgaacactgttccaaaataccaggctgggcatccctattcaagattgaagtctacagaactcaaaaaccctccggcattgaaccgccaagaaagtcgacgccttnctcctnacgccttgggcgaagaaaaaatatcnggcaaaggnngatntcggntcctggggtgnaaaatttttaaaatntatcnaaagatnggnggtnactccttcctanggaattagccaaaggtnaccaaaaagnccccnnaagctcaattaag

SEQ ID NO: 94366 - DNA, 472 bp, Triticum aestivum
  unsure (1)..(472): unsure at all n locations
  Clone ID: PAT_TA_94366
cgaacagctactgaccgagatttcaaccttggcctctgtctaccacaagccgccggagacatttatcggccaaggtcgatatggagctgatgctattcaacacgccgctatccaagaacaacgagagaacgctgttgaaaacccaattgcagccagtacggttgtctcttctcaaaataatgcagacaatctcctggacattgactttgatggtacggtaccagtatctccggggattcccgttagtgccaatagattcaaagcagaggcgctggcagtaactactaagggtctcagtatcccaaagtcagaggccgcaccagccagcagtggcttgaacgatatgatgggactttttgacttaaatgtccacaagcccccctnataccaatgctcctatgtccaagtgtaagtcctaggtnatttgtcncaatggattcaagtggggcnaaaagctagggggtcanaccgt

SEQ ID NO: 94367 - DNA, 253 bp, Triticum aestivum
  unsure (1)..(253): unsure at all n locations
  Clone ID: PAT_TA_94367
caattgtcacttaaaatcgagtaacgtcaaacgcataagcttcggcaaagtacttaataaacatagacaacctattattgtcggccggacgtccgcgcaatgaacgaacatatttgttccaaaccgaaattactcctancatttctctctcaananaaatcgggnaatattcgtccaagacacaaccaatctgcattcatcttgtgatattacatcaacctgagaaagattcatcnatgctgtnntggttctg

SEQ ID NO: 94368 - DNA, 462 bp, Triticum aestivum
  unsure (1)..(462): unsure at all n locations
  Clone ID: PAT_TA_94368
ctcgtgccgaattcggcaccaggtcaagtgcacgcgtgccaagcgatatgggcgctgtagtgtcaagagcgagctcgacactggacccttcgaccacaactactagagcgccaaccgcggtgagcttttctcagctgatcaccctcacagcttcgcaactcccaagtggctgggcgggaggctcgttaaacttgcgtaagcagagattaatgtcgtgcgtaaagccagcgccttcaactcccgcgatacgacgtcaaagaattgtgacagcctcagctcaggccttaggtgtcacgtacgtcaccaagcatcatctgacttggaaacttccaaaagtcacgtggattagaccancancgcttaaaagtggtaacaatcgtgtataacaactgttttcagctttattggtgccctaagccaanatttccttccttcggttaanttttccttaaattaaagggg

SEQ ID NO: 94369 - DNA, 485 bp, Triticum aestivum
  unsure (1)..(485): unsure at all n locations
  Clone ID: PAT_TA_94369
ctcgtgccgaattcggcacgaggaattgtattacttaacgacgtcttcaccanaaaaactagtctaagttgacgatttccaggcgtataatttccaatccattcatcaacctcaatagcaatattgtcggcgtcgagtcagcgaattaaactgcaacatactgtaactgagggataaccacttgcctcnaaagagatccaacggtgggctggtatgtttttcagtcatttaaaagcttcgattcacaattgtagttnaatttcctccctgaaataactacaagtgggaaatccacgatgacctcccacngtccgtcgttcttcanactttcggggccggggaggccaaaatcnaaagtaacccaaaaccaaagtanttangcntaaatttttggaagaancgtgttaaaaatttgggtcctggaaacctgcntccgtaaggaatttggagggncaatangttaaaccacctagatttatcacaan

SEQ ID NO: 94370 - DNA, 417 bp, Triticum aestivum
  unsure (1)..(417): unsure at all n locations
  Clone ID: PAT_TA_94370
ctcgtgccgaattcggcacgaggcgaaggaggagagaagcttcggagctcgggatcggcgatggagaccggagcgaaggcgccgaanaaggccgggcgccgggccggcggcggcggccccaanaagaagtccgtctcgcgctccgtcaaggccggcctccagttccccgtgggccgcatcnggcgctacctcaagcacgggcgctacgccaagcgcgtcggctccggcgcccccgtctanctcgccgccgtcctnnagtaactcgccnccngagctcctcnanctggcngggaatgcngcgcnggaaaacaanaaaaaacgggatnatccnccnggangttcttgntccccatncncaatnaaccaatganctnnggaaagctnnttgnccggggtcancaatcccctaagggaggg

SEQ ID NO: 94371 - DNA, 199 bp, Triticum aestivum
  unsure (1)..(199): unsure at all n locations
  Clone ID: PAT_TA_94371
nctcntgcngaattcggcacgagagcgtgaagctatgcggaacttcgtttcgtgtanctgaaccnccaaccgtgtctatttatctcatgttgccttggcggatccgggtnnatcnctatcactttgnggggngaggatccgtcaggggtaannaatncaatcnacgttttcancnctcgagggggngctcggtttccca

SEQ ID NO: 94372 - DNA, 413 bp, Triticum aestivum
  unsure (1)..(413): unsure at all n locations
  Clone ID: PAT_TA_94372
ctcgtgccgaattcggcacgaggagcattctaccaccgcaccgcacgagtgaagtgagagctttgcacgaaaagttcatcancgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacnagccccgaaatgtggcgctgcgcggntatgaaatccaccgtccacgggacctggcggtgggccctgccagaaataatgatnggnncaaggcancatgatatnttnccgctaaaatgaaatnaaagcttaaacca

SEQ ID NO: 94373 - DNA, 440 bp, Triticum aestivum
  unsure (1)..(440): unsure at all n locations
  Clone ID: PAT_TA_94373
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaaatgtggcgcttcnccgnttttaaatccaacgtcgacnggaaccttgcggggggccctggaaagaagtattgattgggctcaatgccnacnatgatatnttnccgcctaaaaatgaaatnaaaagcttccanacccanaatnancaagngtcatcgnggnccnaatc

SEQ ID NO: 94374 - DNA, 439 bp, Triticum aestivum
  unsure (1)..(439): unsure at all n locations
  Clone ID: PAT_TA_94374
ctcgtgccgaattcggcacgagattttttccaaccgcctcaaccattcacagttactcccctacaaccccctttctcattcggccgtcgatagggactccgagtttcttcatgaataccaacattaatccagctacttcatccacgctacactctcagcacagtcaactaccgaaagaatgggatagaaggcgaggctctaacgatccacaagagcaagattcgatcccggtggtgtatcgctccacaccaattgcgaaatcatgggcgcactttgtcgctggaggaataggtggtatggctgcggccactctaaccgcgcctctagatgtcttgaagacgcgtctacaatccgacttctatcgcgcaaaaatcagccggagccgcgtgggccccgaggaatccttggcaaggcggcgcaaggcctcanccctaaggca

SEQ ID NO: 94375 - DNA, 314 bp, Triticum aestivum
  unsure (1)..(314): unsure at all n locations
  Clone ID: PAT_TA_94375
ctcgtgccgaattcggcacgaggcctcgccatttcgcctcccgtcttcgcatcgcgcgccccgccgccgccgccgcctcctccacacccgtcctgcgcggcgcggccgcgtcttgctccgtgcggcgagaggcgagatctcggccgggctttgctgcgcgcgccgcccgttantggaaggangcngnggggggggttggtnggccgggagccaagtnngcctaacgggttcntggtcccngggagttaaaancaaggaacaaaatggggaattctcctnntccccccnggncccnggggggcaattttatatnc

SEQ ID NO: 94376 - DNA, 442 bp, Triticum aestivum
  unsure (1)..(442): unsure at all n locations
  Clone ID: PAT_TA_94376
gaaaccaccgtggctgcaatggcgtcgcccgctcccgcgaccgcgaagcccatcgctctccggcggccgccggtcccagtccgcggcggattctgcccggcgcgtccctccatggctgcggcggcaggccggttcagagtctcggcctccgcttccgcctcggacgtgcccgacttcctctcctccgactggcttgaaacacgcaagaagaagcctttgggccccaggttgaattttaatgcagaagaagcagtggaagtaccagcttgaggccttgaaatacaatgacaaaccccgcccggattatggggtagaggtcatgttcccggtttgcaagggcttttgatccatttgaaaaggtcaaacttaattttgggacgnacagttttgatntttggggaaatttcgagcnttttcccggggggaatattttnacnaatcc

SEQ ID NO: 94377 - DNA, 407 bp, Triticum aestivum
  unsure (1)..(407): unsure at all n locations
  Clone ID: PAT_TA_94377
tcaataacactcantggaaaaagacaaattcttccgctacgcacaagctacatcgctactttcagcactctttgttcccgtcgtacaaaatttcaaaattctctcagtgagcgattgcctgcaaggacgcgattcgcgccgtcaccaacagggaatcttcatcttggttccctacgtacggccctcttcaattacctgattgcaaaagctacacgcggtaaattcatcctacgcatagaggacacagatnagtcaaggactgttcctggtgcgattgaaaaactctgcgctgntttgagatgggggggtttaaaaagggataaaagggctggtccccaatngaccgcaanngggcctttcaaaaatctcaaaagacttttaangttataaaaaaaaacncnccataa

SEQ ID NO: 94378 - DNA, 474 bp, Triticum aestivum
  unsure (1)..(474): unsure at all n locations
  Clone ID: PAT_TA_94378
cgcacatgcacatttaacaaatctattccgttcccaaattacagtggcactcgtggctaggaagaatatcgactagcgtagggattatcaagctcgtgaaaactctgcatgaatagcctgctctatggcaaactgccgacctttccattcnactaggcttcgagaggcgatgtatcaagtccgggacagttactttgtcactcnctcatgctgccacgctgtcaatccacataagccaaaaatcacagcaatcttcattgccaaacaaagcattatccttgatagatngaaaaaaccccagtaacctctctactcctaagcaaacttaacatttagagcttatacgaagtattcgtcaagttcantcaattccgggccntaacaaacgcccaaaaanaagggtgctnccaaaggttccaccgtcctggggtgncgtttggcaagaacttttccnggtngntttacccaaccngg

SEQ ID NO: 94379 - DNA, 350 bp, Triticum aestivum
  unsure (1)..(350): unsure at all n locations
  Clone ID: PAT_TA_94379
ctcgtgccgaattcggcacgagatcctcctcagccgcactcgccttactagtccctttgagagcagctctcgcgccacctttcctcagctagctagccatggccgccgcacggacctacgtcgacttcgtgccgtcgcacgagctggtcgaggacgccgccaagcagaccctcgtcgtcaacctccccgggttcaagaaggagcatctgagggtgcatgatcgacaactacggccggctganggtcagcggcnagcggccgcctcgagggcggccagtgtgagccnggttccgcannggagttccaggtccccgagggctgcgacnccgtgcggcatccnnnccaggttc

SEQ ID NO: 94380 - DNA, 498 bp, Triticum aestivum
  unsure (1)..(498): unsure at all n locations
  Clone ID: PAT_TA_94380
atccccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaacattgatattgccctgtgggaaatttcgaaaaccaaccaaagtaactanctgcnccgtncattggatncctccctgggtcaccnttgacttcaatcaaagaaacaatggattaactgggtaccctnccaaggcctngactggtggctgttggctcaatcaatttnactccaacnacttggggggtttttggagggntggnaaccncccaaagggtnggncaanaacccgtg

SEQ ID NO: 94381 - DNA, 184 bp, Triticum aestivum
  Clone ID: PAT_TA_94381
ctcgtgccgaattcggcacgagggccaaactcagcattctttgtcgagtgccagtacactctctgctacgtcatctgtcagagattgcccgccaatgacggtaacctacagactacagggtttagatggtgaagcaactgagcccatgattaaagagctagactcgtgccgaattcggcacgag

SEQ ID NO: 94382 - DNA, 555 bp, Triticum aestivum
  unsure (1)..(555): unsure at all n locations
  Clone ID: PAT_TA_94382
tttacacggaagttaaagcagttttatatatgcagctacataagtttcctcgcttaaaaattttgagatttttgctaaactcttcgtttctcacacatgccgcaattaaaggatcgagagttgaatctaaatttgtatattattttctttcagggacccttgggctgatttcaaatttgtaatatcgcaatagggagtatatcataattcttcaggtcttaccctacttattaataaggggtaaatcacatcaagcatgagtcattgcatgatatttctcattggaattcgagatgggctgctattattgcctgatgatccgaagtgtcgtttccaaaagctcctggtatgcttttgcgtttaaaggcataaaatttacctggaaaaatttaaaactgatatcgctgggacggccccactaaagcctatcgaaaagtaatggtgaagtccacacaagtttcccggtctaatccaaagcctcgctcaataacttaatgatctaaaacaaaaagaaagtgtaattttatgacaccttctagangggggctacaatng

SEQ ID NO: 94383 - DNA, 499 bp, Triticum aestivum
  unsure (1)..(499): unsure at all n locations
  Clone ID: PAT_TA_94383
agccgccgccgcctcctctcggttccttctccttcctcggagctccaaccatgggttaggagaagactcacatcaacatcgtggtcattggccatgtcgactctggcaaagtccacaaccactggccatctnatntaaaaagcttggaggtattgacaagcgtgtgatncaaangtttgaaaaggaaaccgcttanaataacaagaagtctttcaaagtacgcctgggtgctttaaaaacttaaangccnaaccntgaagangggtatcaccaatnaatatttnccctgtgggaagttcgagaccaacaagttatactggcaccgtcctttgatgccccctggtcaaccggttgactttcatcaaagaaanatgattactgggtacctcccaaagctngaactggngctggtggctccatcaattgaccccaaccaacttgggtgggtttttgaagggnttggtatcccccaaagggattgnccaanaccccgtttagn

SEQ ID NO: 94384 - DNA, 552 bp, Triticum aestivum
  unsure (1)..(552): unsure at all n locations
  Clone ID: PAT_TA_94384
ctcgtgccgaattcggcacgagccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcaagctgattgacataactgatgatgggatatgtcagccttctaactgagagtggcaacactaaggatgacctgaagcttcccactgatgatgttctgcttgggcaaattaaaactggattttgctgaatgcaaaggacctgattctgtctggtgatgttccgccaagggtgaagaananatt

SEQ ID NO: 94385 - DNA, 313 bp, Triticum aestivum
  Clone ID: PAT_TA_94385
ctcgtgccgaattcggcacgaggcaggaccagcatagccggcaaggatctctgcgtgcaggctcaactgactccaaccatacgaaattccacagaaagcatagaaactgacaagaaatccattatcaaaaacttgaattgaattgaattgaataatttaacgtatcaggctaaagccctacacccaggaggcttgacatgggtgcgtgttcccggggggacccacaaacaccactgatgctggctttatgtggccagaaattaacatgatctaataaagacaaaaatttcatcaaaaaaaaaaaaaaaaaaaa

SEQ ID NO: 94386 - DNA, 467 bp, Triticum aestivum
  Clone ID: PAT_TA_94386
ctcgtgccgaattcggcacgagactacacttctacaggctaataaggtatttcctcttctaagaagaaatcctttctaccttttgctatcgttttcttagttgtaataatgaaaactcagtacgttccagtgtatcttctgtactaatggtctcagtaggcaccagtgtatcttctgtactgatggtgtaacactatgttccctctatatggcttcagactgttgctatttgatctgtaatgccaatatgactgccatgtgtactctatgaattgcacaagctaacttacttctacctatccaaccctacgaagtttcaatgtgatgctagaaagttaaaactacaagaaaagtgatttgcttcaacaagtacatgttccgtgtttcaagtaaccactccttgactgagtgttccatctataaaaaattgctgcctcgcttgaaaggaaaattcctttttggtccaa

SEQ ID NO: 94387 - DNA, 473 bp, Triticum aestivum
  unsure (1)..(473): unsure at all n locations
  Clone ID: PAT_TA_94387
ctcgtgccgaattcggcaccaggccaccttctctcctccaacaccatggcccccactgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgaagttcagcaaggttggcttcgttttccgtgagcanaacaagctcccccggggtactaacgattgtcgatactgggacaatgtgggaaagctggctatgttccggggtggaacgacgctacaaaaggtgctcaaccagggtgggagggangtnaangaaa

SEQ ID NO: 94388 - DNA, 261 bp, Triticum aestivum
  Clone ID: PAT_TA_94388
cgcaggcactggcgccgcaccaagctcggattctaatccggggatgacggcgatgacacccgttgctgccgacgggagaagggtctagggtacctagggtttatgatgtctcgttgtttttgcatgctagcaagtgactccgggatgccagttttaagatttcgcttgtgttgaaagatattattattattactgcttgtagcctacctgggataccgtcaaaaaaaaaaaaaaaaaaaaaaaaaaaaaaaaaaaaaaaaa

SEQ ID NO: 94389 - DNA, 283 bp, Triticum aestivum
  unsure (1)..(283): unsure at all n locations
  Clone ID: PAT_TA_94389
ctcgtgccgaattcggcacganatcgcatcccattagcattctacnattttcctcgganagaagtagncagaaacancancnccatggcnggcatcatgcacaagatcgaggacaanctccanatgggtggcggcagcnacgancacaagaaggacgaggagcacaataaggcggnggagcacaanaagaaggaccggggagcacaataaggacggcnagcacaangagggcatgatggnnaagatcaaggacantatcancggnnacggccactncnacggc

SEQ ID NO: 94390 - DNA, 539 bp, Triticum aestivum
  unsure (1)..(539): unsure at all n locations
  Clone ID: PAT_TA_94390
atggcaatgaggatttggaaagctgctatcttaaagatatagggaaattatttcagttgagatacctaaggattcgagcaagtaacaacattacacttccggaacaaataggagagctgcagttattggtgatattggatcttctcaactgctatgatataagcgaactgccttcaagtattgctaaacttcggaatttgaaatggttacttgctcatcgcgtcaaattgccgaatggagtctgcaacatgcaagctctagagtccgtgtcactggtagttgtggactacactaccccagtaaccgcgctacaagagctgggcagcttgaccaaactgagaagccttggattggattggcgcatcagtgatgcacacaaggataaaatgacatacgcagatnatcttgtttcatcgctcgggcaaactaggcaactctaaccttcgatctttaacgctcatcancccatggccactggacttcctgccgggattcctggtggcctcctcctcaccaaccttcaaggaactaacaatcan

SEQ ID NO: 94391 - DNA, 357 bp, Triticum aestivum
  unsure (1)..(357): unsure at all n locations
  Clone ID: PAT_TA_94391
ctcgtgccgaattcngaacaaggtgccgaattcggaacgagntatacncagnangttaccatttaaactaataattatgactttgctcggtcccanggatgagtantatcctgatatggatgtanctgataagttcaccatgtcacacatacaaaangggtttaaaatatgtgctcggnnactacccatttccacatcaanttcgatagataanangtctgaaanacttcanantcctgtccaagaaanganatttggcganaattacttctcgattgaacacatcancacnnggttggangattggttttaccgcttttgangnattacnccanngttgaaaagacngataaanat

SEQ ID NO: 94392 - DNA, 459 bp, Triticum aestivum
  Clone ID: PAT_TA_94392
gtctggttgatgctcaccggcacggcggagcctaccaaccatgctgcccccgccgccgccgcgaaacactcgaacttgcccatcccccgccgccgaccgccccacacttccgatgccgccagccgcgccgagcccggacccgtaccgcgactgggccgacctgccggagctgccgctggcggaggtgctccgccgcctccttccctgcatccgctcgctctacgccttcgcggggacgtgccgcccctggcgacacctgctccgcgcctccgccgccgatctcatccgcccccgcatcccgccgctcctcctcctctgccccgacttccgactggtgcccttctccccgctcgtcgtcccccaatccctctcgtaccccatccccgccctggcggagggcgccacgctcctctccgcctcaagcggccaactaatcctccctccggcggggctccttca

SEQ ID NO: 94393 - DNA, 418 bp, Triticum aestivum
  unsure (1)..(418): unsure at all n locations
  Clone ID: PAT_TA_94393
cttctcttctttatctttagttttatctacttatcaatagtanctaccggctcgaactcgantttgatcgccttccatacttcacaagctgcggctagttcaggactccatttgcaagctgctcggataatttcattaccttcgcgagcaagatcgcgcccttcgttacgagcttgtacacaggcttctaaagccactcgattagctgctgcaccaggtgcatttccccaaggatgtcctaaagttcctccaccaaattgtaatacagaatcntccccaaagatttcggtcagagctgggcatatgcccacacatgactaccacctgaagctaccggtataacacctggcatggctacccagtcctgaatgnaaaagataccgcgagcacgatctttttcaataaaatcatcgcncaa

SEQ ID NO: 94394 - DNA, 455 bp, Triticum aestivum
  unsure (1)..(455): unsure at all n locations
  Clone ID: PAT_TA_94394
atggaaggggcatttgtggtggtcggtcgcggacggcatggtcatggaacggcgactgggcagacgagcggtggcagcaccaggcggtggggctcgcgggaaggacacgaccgcgtcaagttggtgctcgccagcatcctcacggatgggttgctgtccgctgcgtccgtgaagccaagactgagagtgtgcaagcgccgtcctcaagcacatcccggcgactgccaccccagcaagctgcatcaccgccacccatcccccgtgccccgaagtgatggcgtttcaactnatgtttcccctnaacggaaacgcaaaaaggaaactacncgtcatctgncaatnccnggccgaatnaaaaggatgattcttaccgntttgntctcttttttccggggttnntcccaatttgggcctaagggggtgccttccgccnttctccggaaaccnngaacncc

SEQ ID NO: 94395 - DNA, 476 bp, Triticum aestivum
  unsure (1)..(476): unsure at all n locations
  Clone ID: PAT_TA_94395
ctcgtgccgaattcggcacgagattagacaagagataaactatttaaacaaatacgaatgaaacggttcagaatcaagaatattcgggttaccgtcttgaccatcgttctacgatttgatcacgccgcacgtttctcgtttgaagttcatgcagatctaaggtcgccagtttatcctgcaggtttctgatgtcttgctcaagaagttcttctgcattttgaagatcggggtcgaccattctgattgttccgtaggcgcttttgtctagcaatgagtcaagaagcaagtttaaggcaacgtgagagtccaaaaggtgagatgctaatacaagattcctgtggtagactgcaaggctactgggcggtgtataagcaaagnctaacagttttttcactttatcaatttttcccaatgaaagctaatgctaagcttcaattccgaatnaataatattccggtagtgttgacnaccaaggt

SEQ ID NO: 94396 - DNA, 551 bp, Triticum aestivum
  unsure (1)..(551): unsure at all n locations
  Clone ID: PAT_TA_94396
cggaaatggttattagacttcaagagcgaatcagacaactcggtgaaatgaagacttacctgctcattaattcaaattatctgaaagcagaggactctgaagatatacagactctcgaaagggacctcaacaactgtacaaatgagttattctttatgatgaaagctattacgacgtctcagcgaaaatatgattcatcaaagactagtggcttattaaggtggaatatatcttcacaacagattgtatggcacttaattcgagaaaataacgaaccccttttggaatttcaacttcaaagagccgagtacgaccgaacagacaactctgatggctctcacatcaatctaatgcaggttggtaagatcatagggctcaaccttttaccaagatgccatatatccctgaaatttttgcgccttactcagatntcgacggcaaatcaaatgactgtgataaagcaancaatgttacgagtatattgggatatgcttgaatcgattgcaagcatancagttatgggccactttgagggcaacctgantccatta

SEQ ID NO: 94397 - DNA, 459 bp, Triticum aestivum
  unsure (1)..(459): unsure at all n locations
  Clone ID: PAT_TA_94397
gcagctcccagcttggacgacctggtcaagaggatgccccggcactagtcaactatctggttggtgagaacccaataacagctgcagctggccgtgttcattccattgttctcatgtcgaaaggagaagtttgggcttggggatctggccgaaatggcagactaggtttgggcagttcantggatgaggcagagccttgtctcatcgataccttggaaggagtagaggtcttacaagtcgccacagggatggaccataatctcatattggttaaagaataggctgggctgcttctttagggaaggatattgattgttgcagtagtcactgggaacagttttgctatcaactggatgcgatcttcaaacatagttatgaacttatgaatgctaactagtactcacacgccttcagaattgtgtcngtcacctttcacttccaagttaatgtttccatgtt

SEQ ID NO: 94398 - DNA, 464 bp, Triticum aestivum
  unsure (1)..(464): unsure at all n locations
  Clone ID: PAT_TA_94398
gcatcttcgtgttgcttccttgttccatgggcaaagaaggcatcttcgtgttgctgtgcaagcggacggccccgcgctgctgcctcggcctcggtctgcatgctatctgtagcttctactgcactcccgggctcttcatcccacctcttcgatcttccctccccagctctcctgtcctttaaaaagctccctccctccccagctttcacttcacaccacagctcgactcacgcctcttccttggcgccagtccaatccttggcttgcttccccactttcttcctttgggcaagttaaccaagattcgatngatttgattcnatncaataagctccaagngccaacggncggnttccttcaantncaaaaggtcaatccgcccctcaatccaaagaaaagatncaagggagaaaacgaatnagggggcaatctcccaaggctaaaagaaaacccgtncngtgttt

SEQ ID NO: 94399 - DNA, 459 bp, Triticum aestivum
  unsure (1)..(459): unsure at all n locations
  Clone ID: PAT_TA_94399
ctcgtgccgaattcggcacgagaaaagaaagacaaacgatacggtggactcagaagacttcgangacgtgcgaggaaacagttgacgctaaagaacaagaagaacaacttcatatttcgtctacatactgtaccgcaagcagactataaaaatggatttaccaanaatatctatcgttctcaacgagcattgcgatctaatcgacgtcgtacctatcaagatnaggaggagaagaattcaagctttcatctgaggagaaatacaggccccaagtactctcgatggcangtatattgggncaactnnggccaaatngtgcacccccaaaggccngaanantcaattgnctctaantgtttggnttttcaaagaacaancaccangcacccantnggtnggggaanncaaacnattgggncacnacccccttccnggtttctncantttancaacaccacc

SEQ ID NO: 94400 - DNA, 449 bp, Triticum aestivum
  unsure (1)..(449): unsure at all n locations
  Clone ID: PAT_TA_94400
aaaagccaacttagtgcgcatctcccccgaaccatatcgctaacggctccgtaagacagaattattttgacactagttgctgggagataacagtctgcagctggtttaaatttaataaacgcaaattcagaatttgactactcttccgatctgattcctgggcctgagctggcgaccaagaaccaaaagccctttgcttcaaagatatcaagaaatactgttaaaagcttctccatctctgtacacgtggctagcagagcccaagctggatgtaagctagaaacaatcactagttcatcctcttcacatgcgcattcagcggnccttgaactaaagatttcgctgcatctttgttggcgtgacaaaaccttgaagcgcaaacaattacgcgtttttcctgcgcccgtttcggcnctatttaaagccattcctgacgcaanagngcngcc

SEQ ID NO: 94401 - DNA, 487 bp, Triticum aestivum
  unsure (1)..(487): unsure at all n locations
  Clone ID: PAT_TA_94401
ctcgtgccgctcgttccctggccagaattggccgngaaatcggtaaggaagaaattcctaccctatctccttctgagaaggagatcctccttatgtccaataaggagtacgccgcaagggcgtcggtccgcaaggcggaccgtaccgtgaatacggttcctgcgaatgcagggtcctccatggaggacaaagatgccttaattaggcaactccaagctgctctggnagccctaccccctaacaggggtgaacgggaaattccaattcccgtccctacccaaagacaattcttgggcaagaagaggtagaagaaagactctacctgtnggcaagtttacccccaaccgggaccccaaaatcggggtcccaaccgaaagcccctcggggctccgggcnggttngcaaggagaaatttcctcctgnctcccgaacaanaaancccgggaaactaggtancttnaatttgtacctgggttccttgccnttt

SEQ ID NO: 94402 - DNA, 353 bp, Triticum aestivum
  Clone ID: PAT_TA_94402
ggaacgtgaggaagaagtagttaaagatcgaataattcgtaccagcagtcttctatccccttcaaattgaaaataactgtaataaagactataaaaattgtcacagcctctccaagcgctgaaaagtggatggtccatggctgccattcgcaaacttggacctagggatttatataatattagtacgatactcgagtcggttagtgcagaagtaaatcatctagcctgttctcatcaaactatatattgatcaaattcttgtcttacatgagatagatgattgttgaaaccaatacgacaagaaaaaaatagttgcaattcttctgatagaacatgaaaggcaagctttgatt

SEQ ID NO: 94403 - DNA, 465 bp, Triticum aestivum
  unsure (1)..(465): unsure at all n locations
  Clone ID: PAT_TA_94403
ctcgtgccgaattcggcacgagcagaaagcaaaaccaactcgagccaccgcattccatcacttcgcaccactgctctgaaagcactagccatattctcgagatcaaagcatgccggcaaagtacccacagtttattctcttgggggactctctggtggaatactcgagctatctccaagatggattttgcttcggtgcggctctggccaaacattgtgctcgaagactcgaggtcgttaatcgaggtttgtgtggttacaacacggncatcgagctacatattttgcacgaactcatgcccagcccagacgaagcgcgcgtaagactatgtgctagttttgttaggangccaacgatgnctgtctccccggacgacgcgaggcaaaangcatattccccgttcgatnagcttcaaagcagaacaatcccgggggcnatttattacccaatgcctcccantcaaca

SEQ ID NO: 94404 - DNA, 432 bp, Triticum aestivum
  unsure (1)..(432): unsure at all n locations
  Clone ID: PAT_TA_94404
catacgcatcattctcacaaggttgcaatggagactgctttgaagtcctgggaagctgaaaattctatcggtctcatagacccccatcgagatgccctatacacatatgattctgccgaacaaaaagccataggtctttccactccatggacgaaggatccctcgtacttcaaaaatgtccgcatctctgctgttgcccttctcaagatggtcatgcatgctcgatctgggggatctatagaagttatgggtttgatgcaagggaaaattttaggcgatacttttatcgttactgatgccttccgccttccagtagaaggcacagaaactcgagtcaacgcacaagatgaagcaaatgagtatatngttacctatctacagggcctgccgagaacagggaaaattggagaatgcagttggatggtaccacat

SEQ ID NO: 94405 - DNA, 186 bp, Triticum aestivum
  Clone ID: PAT_TA_94405
ctcgtgccgaattcggcacgaggagaagtagtttatagacggcgacgaacgagcgcggcccggcttgctgctgcggctgcgcctctcgggcgcacggagaggcgagcgacaggcagaggcagggaaccgcgaccgagcgagcgggcgagcgggggcggatggatcaggaaaggggccgcggaggct

SEQ ID NO: 94406 - DNA, 445 bp, Triticum aestivum
  unsure (1)..(445): unsure at all n locations
  Clone ID: PAT_TA_94406
agcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaaggggcaagcgccttccaacgcgtgatccccgacttcatgttccaaggcggcgactttaaccgggggaacgggaaccggnggggaatccatctaaggncaaaaattcnccnacgaaaagttcgtccaaaagcaaancaaagcccgggattctccncaatnggcaacgcnggggccaacaacaanngggtcccaantttttnn

SEQ ID NO: 94407 - DNA, 541 bp, Triticum aestivum
  unsure (1)..(541): unsure at all n locations
  Clone ID: PAT_TA_94407
ccccaatctcctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgaggccgccaaactcgcgcgctacaacaagaagcccaccatcacctcccgcgagatcagacctccgtccgcctcgtcctccccggggaagctcgccaagcacgccgtttccgaagggcaacaaagccgtcaccaagttnaactcctctaggttcgcccgcccccctcaatggtgaccgctgttt

SEQ ID NO: 94408 - DNA, 432 bp, Triticum aestivum
  unsure (1)..(432): unsure at all n locations
  Clone ID: PAT_TA_94408
cgagcatggcatcgcgctgctctgcgccatggcccggaacgtcgcccaggccgacgcctccctcaaggctggcaaatgggcgcgcaccaagtatgttggtgtgtctcttgttggcaaaactcttgctatccttggatttggaaaggttgggtcagaggtcgcacggcgtgccaaaggtctaggaatgcacgtgattgcacatgatccatatgcttctgctgatcgtgctcgtgcaattggagttgacctaataagcatggaagangctatgacaactgccgacttcatctcactgcataagccccttaaccccttcaaaaaacaaagatncttaaccaattaaanncctttgccaaagaattaaaananggggtgtttcngggattaanaaattntttccccgttgggggggtgttaattnaangaaaaaat

SEQ ID NO: 94409 - DNA, 240 bp, Triticum aestivum
  unsure (1)..(240): unsure at all n locations
  Clone ID: PAT_TA_94409
ctcnngccnaattcngcacgagaccaaaccctcatttcacccagcacctaccatggtcaagcanccacgccagccagagcgcgctgcacccccacctcgccgccgagcaagcacccagcgcacgannccggcccggccatggaggtggaggcgttcccgatcgggttcacgaggggcgtgcgcggcgcactgntgtccngcgcaatgtntcatcngcctggaggcccngcccagggcttg

SEQ ID NO: 94410 - DNA, 406 bp, Triticum aestivum
  unsure (1)..(406): unsure at all n locations
  Clone ID: PAT_TA_94410
tttttttttttttttacatacaactatacangggatttcatttttcgtatggactatcgctatgtacggctagatatttacaccacttcaccctgatgaacaggatggatgctatgagatagatgatcctgtcatcgccttccaccagaaccaccgtcgaaagttactactggtcgccgccgccgaggtcgggctccccgcagaaggcatcgggctcgaacgacctcacggncggcgtcactgttcaccccggggatggncctcccgccggcggggttctccagcggatcctcgngcttctcggctgttggcgtannaggaggatngcagagggtcagtgcnnaccgncacggcccaaccaagggtnnaacctcactctggttcaagcaancgggctttcncatca

SEQ ID NO: 94411 - DNA, 389 bp, Triticum aestivum
  unsure (1)..(389): unsure at all n locations
  Clone ID: PAT_TA_94411
ctcgtgccgctcgtgccgaattcggcacgaggggaggagtgaccggggacggcccgctccgcctccctcagctgacctcgtacaccgatgtgttcggggagtggacgcctgggaaggggcctatatgtggcttctgcggcgacgagtgcaaggacggcaaggtggaaaccttgaaggatggttttaaagtatgttcaacgtgttgcaaaaccaatagtgcaaagaaggaggaagcaaataaatgctctattgttaaaaangaaaactctgacaaccaagcttncaattcatggacanattcanagacgctnctccttttanaaggtgtnctaaaacatgganatgactgggattttattaaccaacaagtccncacaaagaataaaaca

SEQ ID NO: 94412 - DNA, 419 bp, Triticum aestivum
  unsure (1)..(419): unsure at all n locations
  Clone ID: PAT_TA_94412
ctcgtgccgaattcggcacgaggcgcaccaagcgtttccatcgacatcagtcggatacgtacaaatgtgtcgatccaagctggagaaaacccaagggaattgataaccgagttcgtcgtcggtttgccggtcaaattgctatgccatcaattggatatggatccaataagaaaacaagacatatgatgccttccggtcacaaagcttttcttgttcacaacactcgagatatcgacttgttattgatgcacaacaagacatttgccgccgaaatttcccattcagtatccgtcgaagaaaagagaataagcaatcattcagcgtggctaagggagctcaagtgtttaaaanttaccaacctcctaaaagcncgcaatcaaccaactngaaagtaaannaatttaatataagtttttggg

SEQ ID NO: 94413 - DNA, 280 bp, Triticum aestivum
  unsure (1)..(280): unsure at all n locations
  Clone ID: PAT_TA_94413
ctcgtgccgaattcggcacgagctctctcgtgtctttgagaaattcagggtaaacagtgtgagtcagtcagtcaggaataatctcttgtcttggtgtatgtcctcaattatgaatgcttctattccatggtcaagattgatgtttgtaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaanccccggggggggnccgggncccaatttncccccaaaaagg

SEQ ID NO: 94414 - DNA, 431 bp, Triticum aestivum
  unsure (1)..(431): unsure at all n locations
  Clone ID: PAT_TA_94414
gtcatcttctccattgtttgccaatgcaccacctgagaagaaaggtgtcaagaactttgcaattgacttcctcatgggaggagtgtccgctgcagtttccaagactgctgcagctcctattgagcgtgttaagctgcttatccagaaccaggatgagatgatcaaggctggcaggctctctgagccatacaagggtattggtgactgctttggccgcaccatcaaggatgaaggctttggctcattgtgngagaggaaacactgctaacgtcatccgttacttcccaactcaggctttgaactttgcattcaaggattacttcaagaggatgttnaacttcaagaaggacaaagggatggttactgggaagtggttcggtggcaaccttgccttctggtggtgctgcctgggtgcttccctcgctcttctt

SEQ ID NO: 94415 - DNA, 428 bp, Triticum aestivum
  unsure (1)..(428): unsure at all n locations
  Clone ID: PAT_TA_94415
ctcgtgccgaattcggcacgagcggcacgagagcaggtccgcggtccaatgtatgggtccagcaatgacaatggcctgagaccgtcgggcggtctgggccagatgtccttctacgagaacgtcatgtcgaatccaagaattgaccagttcttccagtaccggacgggcgaaagcttcgacatgtctgggtgacacggcatgttgtttggctgacaggaattggggtctgagaagctttccttagtgtaaaaagcagcatgcgttggttatcagggtcttgtcgacatcctcctgagaagtagtttagctcgaagtggaattggtttgattttctcgtggaaatagnttgagaagctgataaaatacagtatttgcccttagcccaataaattaacttcnaagtgttggtatgcaaaccccggggtttc

SEQ ID NO: 94416 - DNA, 314 bp, Triticum aestivum
  unsure (1)..(314): unsure at all n locations
  Clone ID: PAT_TA_94416
ttttaacagtactangtagcaccatantatcattantcaccaagtcagcaaaacaagaaccanctgctgcctggctnatccanaccggctgtanttgctangagatctacnactggtaggtangtagcagcctgccgctgtacagatnaanctgctgcgtcttctcccctctccttgcgcattgccacctctggtttagctgagtgacnaaaagattgaggtagccccggncggactactgagtcanggaaaanggaatcatgctannatccatntgggcttttacangggaacgatgacgngnctncttcatc

SEQ ID NO: 94417 - DNA, 414 bp, Triticum aestivum
  unsure (1)..(414): unsure at all n locations
  Clone ID: PAT_TA_94417
cgagcatccaccacaccatacaaaatggaacaacttccttacaccaaatagccatgtccgcatcttgacaacccgaatttaactctggatacctaagttgtttgacaaagatagcacgttagcatatcaggtgtgttcaaagttccggccagatctgtgcctttcctcccaactccgctgcctgcagcatagaaattcctgtagggatgaaaggtgtcatgacatatctggtttcttttaacaatatgtttgatctgcatcgagtcaacttgggagcgtgaacgttgcaatcatccgtggagagaacaaccaaaattttgnctccctcatcaaaccccnacaaaaaaaatgcataaccttaattcccccttggaacgcaatctcaatcccangtgggggaatgggtttttccgc

SEQ ID NO: 94418 - DNA, 367 bp, Triticum aestivum
  unsure (1)..(367): unsure at all n locations
  Clone ID: PAT_TA_94418
atccccaggtcataaacccaagtcggactcgccttcctcctccccaactactcctctcctctcctccgcgcatcgcaccggggtcacctgagatcacacacacaatggtgaaggctgtggctgtgcttactggcagtgagggtgtcaagggcaccatcttcttcacccaggagggagagggcccgaccaccgtgacgggaagtgtcaccggactcaaggaagggctccacggcttccatgtgcacgctcttggcgacaccaccaaatgggctgcatgtcaactggaccacacttcaaccccgctggtcatgtncatggggcaccttgaaggatgaaaatcccgccaatgcctgggttnatncntggg

SEQ ID NO: 94419 - DNA, 461 bp, Triticum aestivum
  unsure (1)..(461): unsure at all n locations
  Clone ID: PAT_TA_94419
ctcntgccgaattcggcacgagatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccaagcagcgtctcatctttgctggcaagcagctcgaggatggccgcacccttgcggactacaacatccagaaggaggtccactctccacttggngctcaagggctccgttggtggtatgcagatctttgtcaagaccctcaaccgggnaanaaacatcacccctngnagggttgnggtccntcaagaccnccatttcacaattnttganagggccaangattcaaaggnacaanggaaggg

SEQ ID NO: 94420 - DNA, 453 bp, Triticum aestivum
  unsure (1)..(453): unsure at all n locations
  Clone ID: PAT_TA_94420
tggacgtcctggcgccgctgtcccgcgcgcatgtcggctcgccggccgcggcggccgcctccgctcgcccatacgttctccatcgtttcaactggcggaccatccgccgccgaggcgccggcctgcgctgccgccggcgcctgctcagcgcgcggggagagcgcccggctcccgatgacgatnaggacgacgaggagctggctgggttcgacgcagcggtggcgctattcaacggcggggagtaccacgcgtgccacgacgtggtagaggaactctggtacagcgccgaggaccccgcccggancgctcctccacggggtcctccaatgcgccgtagggcttccaccacctctttcaaccaanaaccaaccgcgggcgccatgattggaagctcgggggaaaggctctgcaaggctnccggccgncctgcgcctcgnaggacgacnaacnant

SEQ ID NO: 94421 - DNA, 448 bp, Triticum aestivum
  unsure (1)..(448): unsure at all n locations
  Clone ID: PAT_TA_94421
ttcgataaagcctcagcaaattgaagataaagcatcggggcgagcaaacgcaaggaaccctgttcgctaaatttggatttaaatcagctagtcttacaaaacacgaataatctcaaaactatccaagtaattaatatggcagatgagcagaatggatcagcancttggcctgtcgccgatgctgcacttcggcaagagattctcgatattgtgcagcaagcctctcactatcgccagctaaagaaaggagccaatgaagcaaccaagactctcaatagaggaattgcagagctaattattctggcggctgacactgcacctctagctattctattgcatttaccgctnttatgtggaagataagaacgtaccctactgctatgttccgtctaaaactgcctctagggacgaacttggtgggtgttangcaaggggcccgttaatttgg

SEQ ID NO: 94422 - DNA, 432 bp, Triticum aestivum
  unsure (1)..(432): unsure at all n locations
  Clone ID: PAT_TA_94422
acggaacgaacgaaaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttgctgactacaacatccaagaaggagtccacccttcaccttgtcctccgccttcgtggaggcatgcagatcttcgtcaagacgttgactggcaagaccatcacccttgaggtggagtcntctgacaccatcgacnacngtcnagggccaaagatncaaggacaaaggaggggcattcctccg

SEQ ID NO: 94423 - DNA, 426 bp, Triticum aestivum
  unsure (1)..(426): unsure at all n locations
  Clone ID: PAT_TA_94423
ttcaaactacctgtatcctcttggaaattcacaactttttagcctcatctgtactcttttcatcgcccagattatcctctcattatgggagagtcaaggcaaganttggtggcatggctcaataacctactttctctaaatattacaaaagtcgagcaatgnggtactggtgctgccgctatgtcaggtcttcgacagcatttacctagatattcctatgtctcgagtcaaatttaacggttaatacctgaatacncatatctacacnaactttaanagtncctacanaaactgtttttacngcgccaatgggtatcnaccgnacttgtcnaatgtttgaggcangtttngatcaaaatgncnacgaatgcacagatanatttgggagntccttancaaggtggnnccaaaaaaanttttggggaa

SEQ ID NO: 94424 - DNA, 444 bp, Triticum aestivum
  unsure (1)..(444): unsure at all n locations
  Clone ID: PAT_TA_94424
ctcgtgccgaattcggcacgagaccgaagtggactcaaatcacattaaagccacacacagccgacaagatgaggatgcactcacacgccttgctcgtcgtcctcctctgctctctcctcgccggcgcgggcaacgccgagccctctccagacccgacctacaaggactgccacccgggcgacaaggcggcgctgctcgccttcaaggccgccctcggggagccctaccacttgtcggggtggacatccgacagcccctgctgcgactgggaacggcgtcacctgcgaccacttcaccggccgcgtcgtcagcctcgcccgtcttccaggacgccaacatcacgggcaccatccccaagcgccctcgccgggctccctnaactgcaggacctcaccttgcnccacctcccattgctgtcgggccctataccgccgggcgatgggg

SEQ ID NO: 94425 - DNA, 368 bp, Triticum aestivum
  unsure (1)..(368): unsure at all n locations
  Clone ID: PAT_TA_94425
ctcgtgccgaattcggcacgagctcgtgccgaattcggcacgagcatggcccggatgctctcggcgcgctccttcttcgccggcggcgtcatcgacggccgcgtgtacgtcgccgggggatacagcacggaccagttcgagctggactcggcggaggttcttgatccggtgaacggcgtctggcagccggtcgccagcatgggcgccaacatggcctcctcggactccgccgtcatcggcggcaggctctacgtcaccgaaggntgcgcgtggcccttcttctcctcgccgaggagggcaggtgtaccattccaaggccgaccgctggggaggngatgccgcgccggggaatgcnccgagggggtggg

SEQ ID NO: 94426 - DNA, 438 bp, Triticum aestivum
  unsure (1)..(438): unsure at all n locations
  Clone ID: PAT_TA_94426
ctcgtgccgaattcggcaccagaatcattaccacttctacttgaaaccaaggtgcctatactagcgacaggctacacacaatacgacatggagcgagattacgattgggtaaaaaaaaattcacacggtgaagttgatattttaatggaaccgggtgagaacagatttaggagcctaagatgggacatcaatgatctagatcctcaagatataagttgtgggaattgggggagtttggggtttcanaggtaaacgatatgaagcccaacgaaaaaatattgaaagtctaaaagccaatttctaaacaactcaagttttggtggncaacttaaaaaagctttcttcaacccananatatcctgctgggactgtataantntgttacaagtaaaatcctaatanacctggnccaatancactgcagcttaaaaaaaaaaa

SEQ ID NO: 94427 - DNA, 445 bp, Triticum aestivum
  unsure (1)..(445): unsure at all n locations
  Clone ID: PAT_TA_94427
cgccgtcgtcgaccaaatcagcagcagcctcgcgagcccgcgaccaggtccatgtccatgtccaaccattcagctccaacgcagcacaagcaggcgctccatttccttctctaggcaaggagcagacgcagttagcgctccagttcgttctctgcgcacgcaccacgcaggcgcacccgatccctcggagcgccgccatgccctccctgtacaagcagctgggcctgggcgccgccggctcgccggtgaacgcgtcccacctcctcatgctcgtcctcggcgccggcttcctcgccttcaccgtcttcggtcggncancccaacgaattccgcctccagtccttnttctccagcanctgccccgggctccccancgagcctantcncgccgggtaacgccacgggnangggggcaacangccgggnaaaggggggncggnaacan

SEQ ID NO: 94428 - DNA, 437 bp, Triticum aestivum
  unsure (1)..(437): unsure at all n locations
  Clone ID: PAT_TA_94428
ctcgtgccgaattcggcacgaggttagtgctcgcccgtacttggcatccgtcggcacaagaaccactccttcacatcacactcaaattcttgatctatggatattcgtattaattcatttcaaccgtcatattgtgtgtgtataccagcgctttcgtcactcgaattgaggccattgaggcctcaaatccagcacataatctatttaggcgatacgggcgaattggcttgctcaacttgatcatcaaatttgtccacacctccccgggactactagatgccaggctcgcacaatataatgtattctcgcaccagttgctgtcataggcttacaatcactctgtttaaaatcgttttcctttatcgagaagtttctgccgcanctacagcatactggctctgagattaacacctcaaatgaacccangcaataacagg

SEQ ID NO: 94429 - DNA, 412 bp, Triticum aestivum
  unsure (1)..(412): unsure at all n locations
  Clone ID: PAT_TA_94429
ctcgtgccgaattcggcacgagctcgtgccgaattcggcacgagcagcatggttctacgcatccgtctcgcgcgcttcggtcgccgtcgcaatcccatatacaatattgtggttgcacaagntcgctcggcccgcaacagnaaaccgctagaagttctcggcacttacgaccctctgctcaagacgacgccgtatggcagcgatgcccgcttcaaagatgttaaacttgactcagcccgcgcccagtactggctcggtgtcngcgcccagcctaagtgatccagtgtgggcgtctgcctttctatgggctggnccttatgcaagcnctaaaatttccgccccctcannattcgntgcnttagaaggtcctgcaaaccngttaaaatcatttccaaaagtctcatangcctaa

SEQ ID NO: 94430 - DNA, 441 bp, Triticum aestivum
  unsure (1)..(441): unsure at all n locations
  Clone ID: PAT_TA_94430
ctcctagcaagctatatacctacatagtacagccatggcccccaccgtgatggcctcttcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaaagcaggtcgactacctnatccgctccaagtgggtgccttgcctcgaggtttcagcaaggttgggtttatcttccgtngagcacaaacggaaccccctggggtactacgatggcccggtacctgggacaaatgtggganngctggcctatgttcgggtggcaacggacngccacgccagggttg

SEQ ID NO: 94431 - DNA, 445 bp, Triticum aestivum
  unsure (1)..(445): unsure at all n locations
  Clone ID: PAT_TA_94431
cccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgatcgtgagaggggtatcaccattgatattgccctgtggaangttcgngaacaccaagttactactgcaacgtcattgatgccccctgggtcaccgttgacttcatcaangaaacaattgattactgggtacctccccaaggcctggactggtgcttgttgctccatcaatngactcccaaccanctgggtgggntttttg

SEQ ID NO: 94432 - DNA, 507 bp, Triticum aestivum
  unsure (1)..(507): unsure at all n locations
  Clone ID: PAT_TA_94432
ctggtgccgctcgtgccgaattcggcacgagcagacctcgatgacttcttcacactccgccgctttccaaggaacttcaagcccaaaccagatcagggcgaatttaccggcgtcgaaggggaacaacacatttttccagtcttcaaagatggagacgtcttccaaaataacaggttatcgggcagcattcgcgtcgtaactacgggtcttgatacaactaactgcacagtaattggtctcgtcaaggaanaaataaaagttgatgctgatgttgattttaatgcttcggccaccgatgttgatctcgattccgatctcgatgttggtaaaaaatttactaagtgcgagccattancacagtgaaaaacttaagttggtccgtctccaangacaatttatggggggnaagcccatagaagttaatcattcctaatcacaagggnttgaatttgggtggtctcaatatttaagatcntcctagggggaatnccgcctcagggtttttac

SEQ ID NO: 94433 - DNA, 437 bp, Triticum aestivum
  unsure (1)..(437): unsure at all n locations
  Clone ID: PAT_TA_94433
aaaacgggttgtgacttgattccgttgtaagcagccatgtcgtcctccgtcacgagtaatcaagacctcccagtttcccaatataatctaaatacttactggggacgggttcaacactgtgccgcaatctcagaccctagaactctttttgtcagcaatgatgagttaagaaagcgccaagaatctgatcgcggcatacaggcaaggcagtataagagatttggatgaaagggtgtggaaggctaaaaagattgttgactcaactttgcacccagacactggggcgccagtttttcttccttttcgaatgtcgtgctacgtgatgtcaaatctaagtggtaacggctggaatgctaacaccaaacctgancaagaaggggaattattttctggcaagattgctaancaatccccttaatngntcgccatcaaccatn

SEQ ID NO: 94434 - DNA, 439 bp, Triticum aestivum
  unsure (1)..(439): unsure at all n locations
  Clone ID: PAT_TA_94434
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcanggttgggttcatcttccgtgagcacaacgcatcccctggggtactaatgatggccggtactgggacaattgntggaangcttgcctnatgttccggggtgcaaccgaacgccancaccaaggtgattaancgatg

SEQ ID NO: 94435 - DNA, 409 bp, Triticum aestivum
  unsure (1)..(409): unsure at all n locations
  Clone ID: PAT_TA_94435
gacactatcatcgacgaagcggtcgagatggacatatgcaatggtagtgctgctaaggccaccgttgacacgtgttcaccgcctgcactaagctgtcaagaagattcatttatcatggatgtactaaacggagtagaactggactgattctttattttgcgtatgaaattgcatgtcatgtataataatactcgaagcaccaaatgctaatggtaagagatgggagtttgtgttcattcattgggaagtggcgttctcctacttagttagccctcgtcatacaggtttgcggtatatgttggccatcctttcangatgaatttgtttaagtatattaacacgatcattttcggtatccaaatcnatatccacaantattaaatcttttccanaaaaaaaaaaaaaaaaa

SEQ ID NO: 94436 - DNA, 431 bp, Triticum aestivum
  unsure (1)..(431): unsure at all n locations
  Clone ID: PAT_TA_94436
ctactcctccacacaagtgaagtgagagctttgcgctgaaagttcatcatgcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgttgccgcgtggtgtcgacgagccccgaaatgtggcgctgcgcggatatgaaatccaccgtcgacggcacctgcggtggaccctgcaagaagtactgatcggttcatgccggcatnatgatatgntccgcctaaaattanatanaaagcctcggaccaanatnaagcancgtccatccgtgcccnnangcgttttgtntttt

SEQ ID NO: 94437 - DNA, 433 bp, Triticum aestivum
  unsure (1)..(433): unsure at all n locations
  Clone ID: PAT_TA_94437
tttctctcctcctcctcctgccaccgatcccgaaccagggaggaacccggcgcgaggagggcaaaggaanagaataggagaccaccgatcccagcgcgcgcacacgacagcaggcgccgcgatctatcgcaggagcggagatggggctcacgttcacgaagctgttcagccggctcttcgccaagaaggagatgaggatcctcatgggtcggtctcgatncggctggtnatgaccaccatcctctacaatgctcangctcngagagatngtcaccaccatccccacantcgggtttaatgtcganactgtaggantacaaggaacattangtttcacccgttntggggatgttcgggggtcanggacaagattaggcccctngttggtgggcactaatttctcanaaacacccaagnggtcncaattttttgt

SEQ ID NO: 94438 - DNA, 464 bp, Triticum aestivum
  unsure (1)..(464): unsure at all n locations
  Clone ID: PAT_TA_94438
ctcgtgccgaattcggcacgagtggggatgtgttaaacatgtgggcttcgcaacatacacgtagcgaagtgttggctgccgctactatgttgtctcaggaagagcttatgccagatcaatatcgtgttatgacaaaggatgttcctaaaccaacaatggacttgtcggcacaaggagagctcgcagttggccacaccatagtgttccacgggaaggacgtgatagccctcacagcaggagcattcaatctgtacctgactagagtaatttcactatttgacacaaacattanatttgcgtttgggcctgattgaacatacgtcggggtgattgggcangattcctattttgggatatttccagggcaaccgttagttactggaaataanacgttgcccaaaaattcgacaantncgcancgaattgggatggtgttttcngaacgngattccttccatatgatg

SEQ ID NO: 94439 - DNA, 426 bp, Triticum aestivum
  unsure (1)..(426): unsure at all n locations
  Clone ID: PAT_TA_94439
ccacctcctctcaccaccgcggacttgtctcgccgccaaccccgtggatctttcctagatcgactctgccgccgccatcatactgccgcagagcagatcgagatgcgagatgctggacacgatgcgggagcaggcatcttgaattggaccgagatccagtgcgtcgacctcacacagtctctccgggaaggagttcgcagctcgcgtaggtgttcggttgctgaaggcaccttcaccacattgtcattcatttgtgagatgtttctgtttctctatgttggcatggatgcattggatatagagatttggaagattgttagcggaacacatatacaggcaactgcggggactaccaacaggcggcgtacctgctacgtgtttggtgaatgangcaaagctanccaaaggggggcaagcataagtttg

SEQ ID NO: 94440 - DNA, 439 bp, Triticum aestivum
  unsure (1)..(439): unsure at all n locations
  Clone ID: PAT_TA_94440
ggcagactggcagactggcgccctcacaaagccaacaggtcaatatagaaatctccatcaatactctagtcctgctgatcctattcttgggtctcatgtctgggggatcgtcggcggaaggtcatccttccatccgccacggcatggcatggtgacaccttgccccgcggctacgtgcttgggggaaggacntccatttctccaaagcttccagccaccccagccttccgtccttccctgcggatgtgagatggcccggcaaatgccaccatcanttggcgntgaaggccgngtgtncngactaggccttccaagatatgattggnccgttgtatggctagttgggacagcctcttttcccccgactcanagnacgttggcctctantcanccaangccctggacctggcgtccaangtgcgncgccccaacgtatcnt

SEQ ID NO: 94441 - DNA, 426 bp, Triticum aestivum
  unsure (1)..(426): unsure at all n locations
  Clone ID: PAT_TA_94441
atcgccagctcgccacgcccacgcccacgccggcgaccacacccgcggccgcggagctcaccgatggaggacgtcctggactcggcggtgggggcccacttcagcggcctccgccgcgacttgcgccgcctctcctcctcctcctccctcccctcctcgccctcctccgccacctgcaacgacgcctccgcggccgcgcccagcgggctcgcgtcccccgcgcccaggcagcccttcgtgatcggggtgtgcggcggaacggcgtcggggaagacacggtgtgcgacatgatcatccatcagctgcacgacnaccgcntnttgctcgtcaancaggattcgttctaccncggtttaactgnggaggaatctgaancantgtggaangagtanaanctttnattagccccngatgcattttgatntg

SEQ ID NO: 94442 - DNA, 507 bp, Triticum aestivum
  unsure (1)..(507): unsure at all n locations
  Clone ID: PAT_TA_94442
attctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagangtactgatcggctcatgccaagcatgatatgttccgcctaaaaatgaaataaaagctcagaccaagatgangcagcgtcatcgtgcctatgccttgtgtggtgtgggccananaaatatntataccaagtatgcccgttgtcttcgtcgcctgtngttttnctcccctccgannaanaagttg

SEQ ID NO: 94443 - DNA, 399 bp, Triticum aestivum
  unsure (1)..(399): unsure at all n locations
  Clone ID: PAT_TA_94443
ttttttttttttttttcagacgacagatgctcatagatgctcattcatggggtgagtaagctcgtttgcatctatacngtgttcaaaaagagttcaaaatcttatcatataaattgacttggtgtgtggaggggtaaagagtgaganacttgtcacaaaaatanaaatangttggcataacacataacagggcaactgttanggacatacttccaagtttcaaaggatcctaanaatcaggaaccaganatttactaacagatanccatcgctccgatanccaaaatacanagattgttaantcttcactccactanaaaacccctggattacccaagataacantnttgcaattcatgcttcggttccngcnccccccaanccaaanggtttctgtgc

SEQ ID NO: 94444 - DNA, 435 bp, Triticum aestivum
  unsure (1)..(435): unsure at all n locations
  Clone ID: PAT_TA_94444
ctcgtgccgaattcggcacgaggcttcctctgcgcccgtagccgcggcaactgaatctgcgcctgcagctgaggctgtcaaggaagaggaaaaggaagaagaggaagaatcaggcgatgaaggattcggtggtctattcgaataaatgtcctctattacgcatgtcagaaaataaaatcttcatatctgtccgtaaaatcgattgattgtaacaccgagtacatctgtctaaatgacttttcgaaggagaaatctgagcagaagattatcgaaactttcaaaactagagaaaatttttctatgtaattaaaatttatgtgataatgttttgctccttcaaaacctcttgtgcaatcgctatagacttttctggtagtcctgcaagtctcgccactttgagtgcgtgacttttgcttgttnacaaccctctccttn

SEQ ID NO: 94445 - DNA, 443 bp, Triticum aestivum
  unsure (1)..(443): unsure at all n locations
  Clone ID: PAT_TA_94445
tgagtttatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcaaagtccaaggtgttctatctgaaaatgaagggtgactaccacaggtaccttgcggagttcaaagggcgggtgctgangaaggaaanaagcagctgagnaaactctttgttagcantacaagtcggnccaagnaacatccccgccttgctgnacnttgcctaan

SEQ ID NO: 94446 - DNA, 383 bp, Triticum aestivum
  unsure (1)..(383): unsure at all n locations
  Clone ID: PAT_TA_94446
aagcacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccgggnggcatggagatggcgggccganaaccggngggctgcggctgcaccccagttcanggtgncgggcaccaagctgncnggcttgctncctgcttgcaagctgcctngatnatttgnatcaatncgattaattncattgcaccgncgccggtgcaagcatccgattcatatcg

SEQ ID NO: 94447 - DNA, 426 bp, Triticum aestivum
  unsure (1)..(426): unsure at all n locations
  Clone ID: PAT_TA_94447
tcagtgtggttgtgggcagctctgaagcaaaatgagttaccaggctgaagaagacgaccaggagcgaagaagccgcgcagcagagagcgtcgtcttcggaagaacagcagcaggaaaaggtaattgacaagtcttctctctgtctgaattccttcctgctggccatggccatggctgcgtgttgtgtttccgttgtatgttttcgatccaatctgtaagtcgcancttttgtgggtggaactgcagtacaattctcatatatagtgtactctgtttgtggaacatataatggacactgcaaatccatgcatgtggatctgatcttcaagtgangctcgaattccgttnccagaacattgtncaatcacttctgaataaaacaanggnttnaagatgcacccatttantttttggaaaggtnattta

SEQ ID NO: 94448 - DNA, 233 bp, Triticum aestivum
  unsure (1)..(233): unsure at all n locations
  Clone ID: PAT_TA_94448
ctcntgccatttttttttanaatgataaaacatggattctaactgtanaagataaanaagtatctaagctcagtgaaattattcttcgaaataaagangagaaatcagacttcttatcgtaaaangtgtcccaaactggtagatgttctctggctctgacatttgatagtagggacnataatnaantacatggatatttgaancatcttctgtgaatcctggccanaaataat

SEQ ID NO: 94449 - DNA, 301 bp, Triticum aestivum
  unsure (1)..(301): unsure at all n locations
  Clone ID: PAT_TA_94449
ctggtgccgaattcggcacgagctcgtgccgaattcggcacgaggctgctcttgctcagctgcctcacgccgttcnaggaggcggcagccgatgcgttctgcgacaacgttaaggtcctcgccgccaccctccccaanaaaacctcctcctccccggtacacttcgccaccaccaccgtcggccaagcccctgacatcgtctacgcgctcgcgctctgccgtggtgacattctcaacganactgcctgctcccggagcgtcnccaacangttcnngcatatntgcggaatgccactccacc

SEQ ID NO: 94450 - DNA, 433 bp, Triticum aestivum
  unsure (1)..(433): unsure at all n locations
  Clone ID: PAT_TA_94450
ctcgtgccgaattcggcacgagtttttttttttttttttcgactcaagatacaaatttactctgtggcaagtcaaaccacccagtgggtgtacaaatgcaaaacgaagattgatagaaaagatccctcaaggaaagttttcaggtagcatatcctaacaaaacaagcgacaagctaaaagaaccagtcggtgataagcctacctagacattgctttggagagctgagctggcatcgtaagcagcttggctggcttcccggaccaccttcatctgctccatcatgatgcccgcttggcgtatagcctccttggcagcacccacttggtcctccgggacgtgatgtgcagtaaagagtgaaggtggatcggctggagtctgcgcggtccgatgctgagggctggggcactctccgtgcccgaattcggcacnaag

SEQ ID NO: 94451 - DNA, 275 bp, Triticum aestivum
  unsure (1)..(275): unsure at all n locations
  Clone ID: PAT_TA_94451
ctggtgccgaattcggcacgagagtggctttagaagcctgtgtacaagctcgtaacgaagggcgcgatcttgctcgcgaaggtaatgaaattatccgagcagcttgcaaatggagtcctgaactagccgcagcttgtgaagtatggaaggcgatcaaattcgagttcgagccggtagatactattgataagtagataaaactaaagataaagaagagaaggtataaataaaaaagaaacgaaataaanaaaaaaaanaaaaaaaaaaaaanaaaa

SEQ ID NO: 94452 - DNA, 534 bp, Triticum aestivum
  unsure (1)..(534): unsure at all n locations
  Clone ID: PAT_TA_94452
ctcgtgccgaattcggcacgaggatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccaagcaggacatcaccaagagggaagggcatcngtggactccctcttccangcgcccacgggcnacggcaaccacgagggccgtcctcaagctcctacgangtacgtcagccaagggactcaaagaagtacnaactttcgacaacnacaatgggaaggctttctacatcgctcctggcnttcaatgggacaagccttgtttgtccanctcctccaagnaaattcatgnacccngcccang

SEQ ID NO: 94453 - DNA, 504 bp, Triticum aestivum
  unsure (1)..(504): unsure at all n locations
  Clone ID: PAT_TA_94453
cgcaactgcacaagatataccaacggcattgcactccagcctcggagcttcgtcacgacggagagtatcctcatctcttggaaccgcgtttgcaggccaaggtctgcttcgcgaaattaatgcaacactaaaacagctcaagccttttgacacacaggatatcaaaattctcttactcgaaaatatcaaccaagctggtcatgatatattagagtcacaaggttatcaagttgaagcgttgaaaacttcgctcccagaagagaagttaattgaaaagatacgagatgttcacgtgattggcatcaggtccaagaccaagttgaatgagcgtattctacgcgaagcgcgccacttagttgtgattggatgtttctgtattggaactaatcaagtagatgttgattttgctgcaaaacaaggtattgctgtgttcaactcaccttttgccaactcccgaaagtgttgccgnagttanttgatttggtgagatnaatntgccctacc

SEQ ID NO: 94454 - DNA, 534 bp, Triticum aestivum
  unsure (1)..(534): unsure at all n locations
  Clone ID: PAT_TA_94454
ctcgtgccgaattcggcacgagaacagcgccatggatgccgccccaagcttcgtcgccggtcgcttccgtgccgttccggtgacccagcacactggtgtcccgcgactggatccgtcaagctccgcccctcgccaggcctcgttcgctgcgccgcctcgcaggccctctgctctcccgcgcctcgtccccgacaccggcaaattcgcccgccgccaggaccttgcctcgccgggattcgccccccaccgccgggaatcggttcccgacggcctccgccctccctgccgtcgtccgcgccaagtccctgccgccgccctgcgtcccctgcttcccgtcgcgaagctccaagcggccgctgttccctgctgcggtgttccttcttcagaaaccaacagaaacaanctcgggaaacgaacgcctcgaanngtcggtgggtttgacccggngcaaggcgttgganatngagggcctcnnatngcactccaancaaagggcncgggttgngnccccccnaggcgngannccccttcaan

SEQ ID NO: 94455 - DNA, 410 bp, Triticum aestivum
  unsure (1)..(410): unsure at all n locations
  Clone ID: PAT_TA_94455
cgacgactcctcgccgtccgccgctcctccagtccagaccagatcgccctccgccgcgaagcgatggtgaaggcggtcgtcgccgacgaggcgcgcgtcaaggccttcgaggacggcgtcgcctcctccggcgtccttcgatcgcaggtggggctggtggtcgggaagctcagcgcctcctccgaccgcgccctcgtctactccctgctccccacgccgcccaccgatgccggcgagcccgcttgctccctccgggccgctgcnccctctgctggcaaggccaagtccaagggcgggaaaaggtngcgccggggcntctaatgatncgcncgncgnatctccagttcgatntcgacngggtcnctcgaancagnncccgncaggtcttcnaaaggntgcttccttgggag

SEQ ID NO: 94456 - DNA, 374 bp, Triticum aestivum
  unsure (1)..(374): unsure at all n locations
  Clone ID: PAT_TA_94456
ctcgtgccgaattcggcacgagtaaaagtctcggattgtagtaccgtcttaccgaaacgatgtgattctgtccatgtgttcctgattgctcggatggcgaattcttacgtccaaacttcgcccgatcggtacctcgctctgacaaatctgaatgcatggatggaattatgtcgttccggtgaggccgcgctaaacttttccgatgtatttaatcaaacgcnctcctaccaacgactaatgcaacttgcaaagcaaatttgatgtaancattctcaacttaaaggcccacangaaatcccatccccaaacttggtgccaaaaatgactacgggattaacatatctcaacacggcaagtccanggctttttggact

SEQ ID NO: 94457 - DNA, 452 bp, Triticum aestivum
  unsure (1)..(452): unsure at all n locations
  Clone ID: PAT_TA_94457
ataatgtgttgcttaatttgacttttggaaatagtaccactcaccacaccaagatttccatgcntataggttctcatggtaaaaggcggcaaggacacatacagcatgtcatgttgattattggaccaatagttgcccgctcttcttgtcatgctggtggttttctgggtgtacaacaagatcttcaaagacaaactaaagtggaaggttttnctgggggtttacacttaanncacaggctcaaganaactacaanaaaatttctcccgacaaactcgggcnaaaggaggctttggcaagtgttttcagggggaacaagttgcaaggtccaactgccgtanccgtgaaagaanctttaaaagcttcggggcncaagagatnaagcaatttcggancaaaaaantacaaaactcctgggcctggatcaacnacacaaatcttgtgccccnttt

SEQ ID NO: 94458 - DNA, 271 bp, Triticum aestivum
  unsure (1)..(271): unsure at all n locations
  Clone ID: PAT_TA_94458
ngcaaaaacaccgcacgaaggcggacggcaccgaagcctccgacctccgatccaccaccaacacgacacgagctcttggcggaggaggaagctgtcggcagcttcgtccgtcgcggtcgcctcgtaacgtaggcccgggaagataggcggagattgagacggccgctcggngcatgcggnnagcanatcagcccngggccggctgctttcctcctgggccgcccgccggcgaatnttgcggcccaaatttcgcccacaaggacctacctga

SEQ ID NO: 94459 - DNA, 491 bp, Triticum aestivum
  unsure (1)..(491): unsure at all n locations
  Clone ID: PAT_TA_94459
tttgtattcttccttcgcattaaaaatactgaactatggacaaactatgtaacacgattgttttcatttaaatttcctctaaacctacttactattcatgaccctgagacatccaacaagtcgcctctcccacccttcacatctaacgggcatctccaagttgataaaagggatttttcatgacataatcaacgtagagctcgtaaatattacttaaaataagatccacatttggttgctgaggttcggtgaataacaaaaatttagtgcctgtaagggtgctaaagcattgcatgcgggaagttttccgtctcaagcacctccatncccgaaaggcngntcccggncctctctgttncgngcccaaccccnggtctancncaaggtgttgaantggattcaanggnttgtaacnaatagccttnaaccccntngaaaantcccnggcnaaaaanaaaaancgtcatttgaggctgaaccttgttncaagg

SEQ ID NO: 94460 - DNA, 402 bp, Triticum aestivum
  unsure (1)..(402): unsure at all n locations
  Clone ID: PAT_TA_94460
caccaacccccaccccccatccccgccgcccctgaccggcgccatggccgccgccggagagcggcgcctcctcgtcggcctcctcctcctggcccttatggtctcggcgcactgcctggacggcgcgggccaccacggcccgcgcgtgaancggcgcctgcaagaagcgcgagatcnactcccccgtcaagacngtngtggtggtggtcatgganaaccncagcttccaccacgttctccggctggctccgcnccctcccgcncccgaacattngancggggctnacccgggcaacngatgtcccaaccggccntcaaacncagttcngaccccctccttccccggggaggattnttncggtncaacccggacnaagggtccgggnttntggntctnaacnt

SEQ ID NO: 94461 - DNA, 388 bp, Triticum aestivum
  unsure (1)..(388): unsure at all n locations
  Clone ID: PAT_TA_94461
ctcgtgccgaattcggcacgagctttcatactctctgcatggcactcagtgtatcgttatttttcttcctcttcgccatacctattttttggccgttgttggtaccgtacatgctctattgcatgtactcgacatcttccacatccggagacttgagccacagatcgccttttctccgatcattatcggtatgggacttatttgcaacatactttcccgcacgactacatcgtagccaaaacctcatagcgacacgaaaatatatatttggttaccatccacatggcatcatctcaatgggggctttcgcaagctttctgtactgagtctcttgggttttgcaaccccttttttccntggnaatcgaaaaaacacncttnctcnacct

SEQ ID NO: 94462 - DNA, 372 bp, Triticum aestivum
  unsure (1)..(372): unsure at all n locations
  Clone ID: PAT_TA_94462
gctttaaggagcaccatggttaaggaggtggtattgcgtggtgactagagattgactaaaagaatgttatcaaccctaacgaaagcagtttcactctttaccattcttgggagcaagcatctagctaccgcctttgtcgtccccgcacagcagtccttagagaccgagaattccaagtaacaaatataaccaagacgataatgatcctcttccactcatcatctggcatggcttaggagacagttatgcatctgaaagccaggcttccgttgccgccgccgcccaaagccgtccatcccgggaacctacgtctatcacattagggctcaattgatgantgccaaaggtccgattcgcagcttatcccntcct

SEQ ID NO: 94463 - DNA, 280 bp, Triticum aestivum
  unsure (1)..(280): unsure at all n locations
  Clone ID: PAT_TA_94463
cccctctctcctttccccaacccaaaccaggagcgccctccctccctccccagncgcccgccccctccccacccagggaaaccnaccacccatgaagggggncaaatccaagggcgccgccaaggncgacaccaangttggtgngtgaagagcaagggggcggagaatccggnggnncaaggngaanangggcnacggncggtaatgagnccaanaatcncaanganggctccgcnccgcnttcntcgncttcngnggggggagttcctcgnggagttca

SEQ ID NO: 94464 - DNA, 459 bp, Triticum aestivum
  unsure (1)..(459): unsure at all n locations
  Clone ID: PAT_TA_94464
ctcgtgccgaattcggcacgagcacccattcccctcaccgccgccgccgccactgcgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgactttccgccacccgttcangtacaagcaccangaaggagctcttcgtngccgccgagggtatgtacaccgggccaagttcgtctactgcggacngccggcgccaccctctccgtcggcaangtcatcccgctncngntccgttcctgatgggaaggggtnattctggcaacgtcgaagcaanaacgnccggncgaccgcgg

SEQ ID NO: 94465 - DNA, 492 bp, Triticum aestivum
  unsure (1)..(492): unsure at all n locations
  Clone ID: PAT_TA_94465
cgggaatttgccgctcagagacaaatgtgaattatatgaggtcaatgtccatcaattcatctgctgagaatccggagaacacaattgatcacccagccgagccaagggcaacaaccgctttattgcctcctgttgtgtcaaaattaatccacaaagatcctctatgctggttaggattcaccaaggaatctatactaacatcttgtcgttctggtcacataagaatctgggaacggccttcaaacttgttcgaaaccattaaggtttcggtgtantagcttgactaactgatccctattgataatcagctaaggtgngctcgtatanctctaaattgaatagctcatataaaaagtatgaatattaggacttggccctagttaatgatgtanagcccnagttgtgctaggttgccacggctaccattacaaactaattccaggaatttgggaaaaaaanaaaaaaaaaaaaactccnagggggggggccctg

SEQ ID NO: 94466 - DNA, 509 bp, Triticum aestivum
  unsure (1)..(509): unsure at all n locations
  Clone ID: PAT_TA_94466
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcaagcaacggtggaaggatcaggtgcatgcaggtgtggcccatcgnagggcatcaagaagttcgagaccctgtcttaactggccaaccgctcagcaacggagggcctcctcaaagcaggtcgactacctgattccgcctccaangttgggtngcttgcctcgaattcaagcnaaggttgggttcaaccttccgttgagcaacaacggcatctccctgggtactancgaatgggccggtattgggacaatgttggnaagctgncctntntttcgggttgcaactgaacnccaacacaaggtnnataaacgaacggtgggnggaggttcaaanaaaggattaacccttaacccgtntg

SEQ ID NO: 94467 - DNA, 476 bp, Triticum aestivum
  unsure (1)..(476): unsure at all n locations
  Clone ID: PAT_TA_94467
atggccattaccccccgaaaatagtctcaccactaagaagatcatgaggggtgaaaccttctacgcgaaggagccgaaatggcctgctgagacatcttctaaatatcgatgcccccaagatattagtcgagaaggaatgccttgcaaagcgtccgatttctcctatcgaatgttcatacctatatttttgatggagaatcaagataagatggagaaactaacagccaaggaagttgcttccgcttttcngtttgtgtgtaaccacattttattctcacatccactgggtacacaagaaaatgtttcacaccgtgtatggaggagaaacgattgtagaagaggcgaaagctcaaatnaaaaagtctctcgttcatcataancaagctacgactacacctaaacccgttnaaaaaggaacttngntttcttcgggaaanaaattctgaancccgantngcaccaanccngantaaggg

SEQ ID NO: 94468 - DNA, 499 bp, Triticum aestivum
  unsure (1)..(499): unsure at all n locations
  Clone ID: PAT_TA_94468
gcgatgtagagcaaatgcaggaatatcaaaaattcgttgccgagtccgaacctgcagccgccaaataggctatttactgcaacgtacgggagttacagacttcctatcaaagtggtttcggtcgccaggtcaaaaattcaaaatttattgaaatgtcatcggcaaaaaatgcacttgagctttacgccatacttgtcgacgaaacttatggagaactaacttctagaatattcactgtattactccgtcggggtaggcaacaaataccgttaattgccaagcacacaaggctcaatccacgacaagttgcggtcacgggattagtcgtcctcatacaacaagaanctcatattcnncangtaccgaatncccgatacggggagtaacacaactatgaaagcaaatcattccngccggcntaatgcccccctttagnggtctgggaaaaggannatgggngaacagtttggaangattaaatttggggcccgttanccng

SEQ ID NO: 94469 - DNA, 401 bp, Triticum aestivum
  unsure (1)..(401): unsure at all n locations
  Clone ID: PAT_TA_94469
ctcgtgccgaattcggcacgagagagagagagagatattttcccccggccttccatgaaacctccttgacataagcttgtccatgactgtcccgtaaaatatcgcacccgtcataattttatgaacaaaatctaagctcaattaagtcnaatcaacgcttgactttatgagctctgactcgaccactaatccaaatcgctatggcctcggtcggagtaaggcccggtaatatcttaatttgaanccttttgatttcgtgctcatcttttcgattgagggnacgcccacggcttttattatngtatctgacaangataaaagcctctgatagctatnannccgtgctcgctcctgaattcgatggcgntanattcccgggcggacnaatgcgaacnggctag

SEQ ID NO: 94470 - DNA, 388 bp, Triticum aestivum
  unsure (1)..(388): unsure at all n locations
  Clone ID: PAT_TA_94470
ctcgtgccgaattcggcaccagatcttatcggtggtagtgctacaagcgagtgacactagttcttgcaccgatcagatccaacttctgcacaggatgctggacaagctgtgggacgacgtggtggccgggcctcgcccggagacgggcctcgacaagctccgccgggccgccgccacccaacccctccgccatcaacacagctgcagggggaggcgattaaccaagtcgccgtcgatgccggacgacccccgaccacgcccgggtgactcccgtcgtcgtccaacgccggcccgcgcgggcggcagcgtngtgggcgggagcgttttcccaccccggggaagcaanccctggccaccaaagaagcctcggggggccaanccttcctnt

SEQ ID NO: 94471 - DNA, 252 bp, Triticum aestivum
  unsure (1)..(252): unsure at all n locations
  Clone ID: PAT_TA_94471
ctcgtgccgaattcggcacgaggctacctcgagcgtggaggaggtggcctcgactgggccggggatccgcttcttccagctctacgtgtacaaggacaggaaggtggtggagcagctggtgaggagggcggnnaatgcttnttcagngccatcgctctcancgtcganacnccgcgcctcngtccgccnncagggcgacatcaanaagaaggttngtnctgccgctgggcnnnacgctcatataanttngat

SEQ ID NO: 94472 - DNA, 261 bp, Triticum aestivum
  unsure (1)..(261): unsure at all n locations
  Clone ID: PAT_TA_94472
acaagagccacgcgagagagangaagccatggccatgtcgctctccctcgcgcgcctggccctcccgccggtcctccangccctccccggcaggaggcaggcccactccgccctcgccttcncggccaantcattcttcggcgcgccgctgggccgtggccgccgccggcgccgcngcnctctccccggcggccccnctcccgcgctccctcgccgtcgtcgccgccgggaaaggggtacnaggatggannnacgccacaa

SEQ ID NO: 94473 - DNA, 158 bp, Triticum aestivum
  Clone ID: PAT_TA_94473
ctcgtgccgaattcggcacgagggaaagaggacagggctcgccgcggctgccaaagagccggggctcaaagatcgacgaggaaagcttcagggtgccgctgatagagagcaagaaaaccggcagccgggcgccggcggtggtcctcgggttcgaagtg

SEQ ID NO: 94474 - DNA, 379 bp, Triticum aestivum
  unsure (1)..(379): unsure at all n locations
  Clone ID: PAT_TA_94474
ctcgtgccgaattcggcacgagggtcaaggccggctacaaaagttcgccttcgtttccaggatcatatatatcttctgtttcactccattcggtgttttctagtgctagctctgctgacctttgcacctcggccagaccacttatttgtgaaacataagtttcatctgaaagagctctttttacaaactcccacccatgctttttatattcatttataatcttcggtgaacatgcagaagcagcagtcatatgactttccactgataatcntgttttgaaatgtggcgcaaaatcccccggatttggtgtgggataattcctaggggatgatcaggtggatctcgatcataactangtantttgagctaatttttgggg

SEQ ID NO: 94475 - DNA, 383 bp, Triticum aestivum
  unsure (1)..(383): unsure at all n locations
  Clone ID: PAT_TA_94475
cccatccccaggtcataaacccaagtcggactcgccttcctcctccccaactactcctctcctctcctccgcgcatcgcaccggggtcacctgagatcacacacacaatggtgaaggctgtggctgtgcttactggcagtgagggtgtcaagggcaccatcttcttcacccaggagggagagggcccgaccaccggtgacgggaagtgtcaccggactcaaggaagggctccacggcttccatgtncacgctcttggcgacaccaccaatgggctgcntntnaactggaccacactttcaaaccccgctgggttcaatgtgcatggggggcacccttgaaagatgaaaattccgcccnatggctgggngatnctttggggaan

SEQ ID NO: 94476 - DNA, 496 bp, Triticum aestivum
  unsure (1)..(496): unsure at all n locations
  Clone ID: PAT_TA_94476
ttcaggtaaaattctggtcacgattcacaacgccttaccttcatcaacccgctatccggatatccctcttcgttacattacacccgctccagcgacgaaccaaccaccacatcaatcttttaggatggggcacagctcttgccctaaatgtggggctgctgctagtggcattaaaacttgtgcttcctgtggttcgacctgtcccgtataanactcgattagtttcctgcaacttgaanactacttgtcanagtacacgaanctgagnganttggcttttatcanaagttatcatgtaattatgttgcttacacagggcaagaggtcactgggggaataccaaangaaactgaaaatctggttatggggacaanngtgatgtggacaanagctggngccaaagaatcnggnggcanattctggaatgatcttnaaatgtcnnagggatttaattcgttgccctcaacngcggcanatagtncgcccatctttttca

SEQ ID NO: 94477 - DNA, 153 bp, Triticum aestivum
  unsure (1)..(153): unsure at all n locations
  Clone ID: PAT_TA_94477
ctcgtgccgaattcggcacgagtcaccatccattcccattcctatcccatcccactccagtgagctcgaaaccgagaggggannatgtgtggaacgatgnngttgttacngggncgccattggatntggtngactggcnagcnctctgtgcgc

SEQ ID NO: 94478 - DNA, 489 bp, Triticum aestivum
  unsure (1)..(489): unsure at all n locations
  Clone ID: PAT_TA_94478
gtggtacaccttaccagctcaatctgaaccaggtttccaaagctacagagtctcttctcgctcatattcaagcaacgcaaaaatctaaattgggtgaagaaaagtcaacattgctcgacgaagatcccctcgaagattctccaatatggtttcaactcacaaccaaattacacatcactgctaacaagcgactcaaacccataaaaatatccttgcctcacccacttcacacgcatgctaattcttctatttgcttgataaccgcggatccacaaagagcaagttaaggatcttatttcacacccttcgtttcccactgcctctttcaggtcgtataaccangagttgttggcctccataaattaaaatcgaaatgggtcacaatacgaangccgcaaagaaaaactttaatgctggaaacatggacatcttccnttgccgancaattcgtgtggntaanangcaaccttcccggcgantcgtcgggag

SEQ ID NO: 94479 - DNA, 466 bp, Triticum aestivum
  unsure (1)..(466): unsure at all n locations
  Clone ID: PAT_TA_94479
acgaagtgcagcacttaagctcgactgggcccaagtgaccagctctctcggtcttcgaggacagacagccacagctctacaggcttttaaaaaacgcaatgaagacgcacggcgccgtgtgcagcaacttaaagcccagccgcagactgttgactttgctcattaccgaggcctcctcaagaaccaggcaatagtcgatcagatagaacgtcattgtgctacctttagaccctctacctacgacctgtcgcgccagttaaaatccattgaagcctttgaagctcaggccctaaaggacgctacggctaccaagggccgcgttgatctcgagctccgcgacttagagaagaccctcaaaaatattgaggaagccaggccatttgaggatctcacaagttgacgaagtaagcggcgggaacgtcctgacattgaaagnanaagcccagccgtttaatcccaaaanggg

SEQ ID NO: 94480 - DNA, 224 bp, Triticum aestivum
  Clone ID: PAT_TA_94480
tttttttttgagtacatgtcaaactggagcccaattcaagtacacaagagacgtacatatatatcaagtgatacataacatgacatgatcatttctagaacttgatcagcgagacagagtatgaacgactgaagatgatccccactgaattgcatcagttttgttatatctggatggtacatgatacagaagttatttccttttcctcgagttataagtgcttc

SEQ ID NO: 94481 - DNA, 500 bp, Triticum aestivum
  unsure (1)..(500): unsure at all n locations
  Clone ID: PAT_TA_94481
tgaccatcgcattcttttccatcctcctagtcctagtcctatcagccatttctgtagctgcttcctctcccaaccgcaatggcagtgacacagaccttgccactctgctggctttcaaagcccanttctccgaccctcttggtgtccttgccggcaactggacaaccancacatcattctgccactgggtcngcatcaaatgcagccggcggaggcagcnaagtcacagctctgtcgctgncggatacacctctctanggacccatcacacctcaccctcgaatatggatcncntgggaaaaccatcacgaaagagtgatnttgttcancttacgtcagtatactcccttgaaagtcttcaactaaaaaggggagacccacnggatnncaattttttgttgggaatctnacattnanganaaatggggtttttgngnacaattccccattgaccctgttcanggttngggggngggnganttaacttgggaaggnccttt

SEQ ID NO: 94482 - DNA, 279 bp, Triticum aestivum
  unsure (1)..(279): unsure at all n locations
  Clone ID: PAT_TA_94482
tttttttttttgacgcaaacancaaatctgccaataatatgaccttcncttancaacaggttcangtccatccgatgaggactganacaacaacatcgaggatcttcncgaaattctttacaattanaatagcntgccgccaaccaaaanaggccgggccaatgccaacacccanccaattgcncncgaaacctaaataataaggntgacgcngngtttgttctgtctcnaactcccttcgggctccaagtgggnaaaactcgggtgatttcnccgcca

SEQ ID NO: 94483 - DNA, 393 bp, Triticum aestivum
  unsure (1)..(393): unsure at all n locations
  Clone ID: PAT_TA_94483
ctcgtgccgaattcggcacgagcctccgtctgcccctcgccgtcgccccgctgacctcaaccagccgccggcgaaatggcccctaagcgaggcggcaaggcgccggtcccggcgaagaagaaaacggagaaggtgaccaacccgctgttcgatgaagaggacgaancaattcggcatcggtggcgccctcccgcccaagnaaggacctccaccgcttcgttaagtggcccanggttgttccgcatccagcgccangcgccgcatcctcaagcancgcctcaaggtggcccccgggcactcaccattttacccnncaccctcnacaaagaaccttgccaacaaaacttgttcaagattgcttcttnaagntaancgggccagaaagnanaantg

SEQ ID NO: 94484 - DNA, 399 bp, Triticum aestivum
  Clone ID: PAT_TA_94484
gagaagtgttcaacgttttgatttaaggaccccaaactaattgtggctcgggcaaagatcttcttagtacggaaaactgaaaatcatgcgagcctactggtatgataataaacctggtgatgctcgcctaccacacgatagcgggcgtcaagtctctgccaaatacctcgctgcacttggagtcatgtacctctgcccatcatctgaggaggaggttgcacaaattgcgcgagagcgtcactattgtgaaagtgacatagtgaccatctcaccggagaatctaggcacgagctatgaatcaaaattagacattttttttcacgaacatattcatgaagatgaggaaatacgctacatctgtgatggtagaggctattttgacgtgcgaaatgagtatga

SEQ ID NO: 94485 - DNA, 417 bp, Triticum aestivum
  Clone ID: PAT_TA_94485
ctcgtgccgaattcggcacgaggcagcgagtattatttcaagagaaaaccgtctgtctcgatggggccttatgcgacagtcattctgacggcaaagatatgtcttcgcatctgatggatattcatttagttcgcactcagttaaatgaggctcaattgaaacatcctatatctagtccgacgaagtctcaggttgttcctttgttgagctcaaaatcgacatttaaaaaccaacatatactttcagtcgacaaaatcagccgccaggatctacataatttatttactgtcgcgcaagagatgcgccttggtgttcaagcgagaaggggttttatctactctgaaagggcgtgttctttgtaccctcttttacgagccatcaacacgggcatcggcttcattcgatgttgccaagcaa

SEQ ID NO: 94486 - DNA, 427 bp, Triticum aestivum
  unsure (1)..(427): unsure at all n locations
  Clone ID: PAT_TA_94486
cgagtgctcgctccgccgggcgtccggaaatgcaaaccacctctctgtcttccgctccgtcctctcgggccccctccgcgccgccgtctacacccccgcccccgcacgtcgccttcccctctctccgtcgccgggacctcctcttgctctcagcgtcgcctcttcccctctcgctctctccggnggccgcctcggcgcgcgggctgttccgcatgccgccgccggggctggcgaaccgctacttcctcgtgcgcgctggcgagtcggtgtacgaggggcagggactcctccggaccaaccccgtcgccaagacctcngtcgacaagcggtctctcccccgccggcctccgccaggccgcgcgcgccgcgctcgagctccgccgccttggtgcatgcgaaggacgactgctggatatggccctccatn

SEQ ID NO: 94487 - DNA, 411 bp, Triticum aestivum
  unsure (1)..(411): unsure at all n locations
  Clone ID: PAT_TA_94487
ctcgtgccgaattcggcacgagcggagaccaagcttcctccagtcgccatggatactgnccaactcccttacggaagcttctggctggtggccgtagccaccattcttatgtccttgattctgaggcaggttctgggtggnaaggacaccggagccaagcttcctccaggtccatggaacctccccatcattggnagtctccaccacctcgtcggcacaaaactgccgccccaccgcgcattcctccgcctggcgcgccggcacggcccactcatgcttctgaggntcggcgaagtgcccagggtcattgtgtccacccccgaggcggcgatggangtnttaangaacgagtgncctcaccttcggcnacccggcccgaagcggtcccaacgcttgggacatncntcaatt

SEQ ID NO: 94488 - DNA, 407 bp, Triticum aestivum
  unsure (1)..(407): unsure at all n locations
  Clone ID: PAT_TA_94488
gagtggtgggagtgggtgtcgctggtgtcgcccttcttcttctggggcacggccatggtggccatgaagggggtcatacccaagaccgggcccttcttcgtcgccgcgctccgcctgctccccgcgggcgcgctcgtcgtcgccttcgcagccgcgcggggcaggaagcagccctccgggtgggccgcctggggcgccatcgccgccttcggcctcatcgacgccgcatgcttccagggctttctcactgagggcttgcagaagacatcggctggcctcggaagcgtcataattgactcccaaccattgncggttgctatccttgcagcgctattcttcggagagtctatcggggcgatangagctggggggctcgtactgggtgttgttgggctttttgctcccnc

SEQ ID NO: 94489 - DNA, 343 bp, Triticum aestivum
  unsure (1)..(343): unsure at all n locations
  Clone ID: PAT_TA_94489
ctggtgccgaattcggcacgagacttcccgataacttcactcccacacgttcggccgacactggacatgcatttgaaacatcagataacgcatttaggctatcagaacttatcgtagtagccagccatccaatgaatgtgtcacacgcaagtaaatgtgaggttctatgtaacgatngctctgatgctcagacgaaccaaatcgcaagtattttgtagctacaatggcaacattgcatggtacactacgtgcgtctcattagtcgagattctagaagttcactctggacctacgttatttaaccaacttatgaaatttggcagttcattatgcttaacagaaa

SEQ ID NO: 94490 - DNA, 400 bp, Triticum aestivum
  Clone ID: PAT_TA_94490
ctcaagtcacgcagcaagagtttccaaaaatatggtcgtcttacaatactaccccgaacggatcgccgcctccgatgtcgaactaggagacaagataatcgatttactatactcctattcaccggctggaaagtcagtcagacgcatggaatttgagagattagttcgctcgtgtgtctcgcgtcgagaatctcttcatcttgttcttcccgcttttccgttcaagtctgcaaaccgaactgataaagtcctgggtgatcttccggacattggcgaagaaatggccctggcactcctgaaccgaatatgtaccgacattaataatatttatcctggatcgtatactacagtaaccatcgtttcaagatggactggtttacaacgatattttaggtatctc

SEQ ID NO: 94491 - DNA, 417 bp, Triticum aestivum
  unsure (1)..(417): unsure at all n locations
  Clone ID: PAT_TA_94491
cgcgaccggaacctggagctgtgcagggcgctgcgcaaggccggcaagagcgtggagcaggcgacgtacggcggcgtggggcacgccttccaggtgctccacaactgccacctgtcccagccgcgcacgcaggagatgctcgcgcacatccgggccttcgtcggcgccaggtccagctgacagacacacactcgtccgccgtgtcatgtcagtgtcacccgtcgattataattacttaatccaagtctaatccactaccaagttccaggctttcaagagtagataccgtgtaagcagtagtaacttgtggtactcgcccaagtgaaggaaaagacaagaaaagggtccaatgccgaacttggattgttgtagctagtgctgtcngaaagcaaaagtgtancggaaaaataatctcgt

SEQ ID NO: 94492 - DNA, 442 bp, Triticum aestivum
  Clone ID: PAT_TA_94492
ctcgtgccgaattcggcacgagcactattgatgcaaaagcattcggcggtcatgccgtaaatctcaatctcaaggccgaaaagtttccagctttcgccatacacaatatgaccgacaacaaaaaatatccttacgaccaagaactcgttattgatgccgagacaattgggaaacatgcatcaactttcgtagaggggaagcttgaccccgtcatcaaatctgaggaggttccagaaacacaggacggcccagtgacagttgttgtagccaaaaactatgaggaaatagttttggatgataccaaagatgtaatcttggaaatttatgctccttggtgtggctactgcaaggcactcgctccaaaatatgatatccttggccaactctactcccaagcaggactcaacgacaaagttgttattgcaaaggttgacgcaactgc

SEQ ID NO: 94493 - DNA, 406 bp, Triticum aestivum
  unsure (1)..(406): unsure at all n locations
  Clone ID: PAT_TA_94493
gcgattcctcctctttaattccaagagttcacacacaacactcgcaataacaccaagagaaatttgtaccgaattaagtgaagcataagggatagcctagacatatattgtatctgctggtggacagcatggcagacgattctctcagggatcgattattagggcacgcaaagtcatttgatggtctcctatcactcattccagctaagttttactacggcgaagataataagcaatcaatggaagaaaaagaagcagactaaggaacaagctgctgctgcccggcgggccaaactcgaccctgacgctgccaagagtgctaaagatgttatggacgagaaagcgcggaagcgaaagctccacgaactggaggcggcaagacggcctagatntagaagaaggagga

SEQ ID NO: 94494 - DNA, 443 bp, Triticum aestivum
  unsure (1)..(443): unsure at all n locations
  Clone ID: PAT_TA_94494
ttgaattactgcctttttaccatctcataacatccgattctccgactctaataaataaaatgcctccaaaatcagccgaaaaaaaaccgtccgccacgaaggcgccagccaagacacctgtctcgaaggaggccggtaaaaagacagcttcatccggtgacaaaaagaaacgaacaaaaaccaggaaagaaacttattcatcgtacatctacaaagttctcaaacaagtacacccggatacgggaatatctaacagagccatgtctatattaaactcattcgtaaatgatatcttcgagagggtcgcaactgaggcatctaaactcgccgcttacaataaaaaatcanccatatcttccgagagagatacaaacatccgtgcgattaantcttcccggtgaactcgcaanaacatgcagtttcagaagggaacgaaggctgtt

SEQ ID NO: 94495 - DNA, 404 bp, Triticum aestivum
  unsure (1)..(404): unsure at all n locations
  Clone ID: PAT_TA_94495
ccaaagactattgcaacgagctgtcaattttattatcattgaaatctattttcgcaaagcccaaatgcggcgcgacatgtcgacgtccggatctatggccgatgacacgatgcagcctgattccttagctgttgtacctccggcttcaacgctgcaaacgtctcacgatgatgatctagattccacgcttggggacgacgaaggaagtggtgcggattattgttctgttacagatagtatctatgattatcgtgtcgaaaacggtaggacatatcatgcttacatggatggaaagtatttgttgcctaacgacgagagagaaaaagaaaggctggaaagagtatataaggctattgacacggtattcgntggtaaagcgatctttgctccactcaaaaaccctt

SEQ ID NO: 94496 - DNA, 291 bp, Triticum aestivum
  unsure (1)..(291): unsure at all n locations
  Clone ID: PAT_TA_94496
ngggagcctggtatgtgccgaccacgtgccccgcnaaatcgccgcacgcacctcaccgtcgcggtgtaaactcgcacagaancgcatctcgatgtccgcccacgccgtccccggcgccgcgggagacgccggtgcggcccgagccgacgatgaggngcgcgccctcttccccgcctcggcgcncgggggngaccacggcgacgccggnaccagtagcggcggcnangacngacnaggnccnctangancgtgcnttcgangtntccgaaanggtcctgtctccntcctctg

SEQ ID NO: 94497 - DNA, 414 bp, Triticum aestivum
  Clone ID: PAT_TA_94497
tttctttgctcgaaacgtaaaatttcccggcttggagcatttaaacttaaatgcgcctaatgtagcctacatagggtatggaggatcttatgcaggtggatttgtagctattttaaggaagctttatcctgatgttttctggggttgcatttcatcaagtggcgttatcgaggcagtccacgattactgggcatactttgagccgattcgtgtatatgctgatcaaaaatgtgtctcgaacacccaaaagttaataaatgtcgtcgataatatcatccttggccagaatgaccatgccctcacagaaagactcaaaaatgtcttcggacttcccaatgtcacgcaatgatgatgactttgcctatgctatctcaaaaggcatctactcctggcaaaatcgtaactgggacccgg

SEQ ID NO: 94498 - DNA, 406 bp, Triticum aestivum
  unsure (1)..(406): unsure at all n locations
  Clone ID: PAT_TA_94498
ctcgtgccgaattcggcacgagtttctccgagaagcttcagtggcagggagcctcttggttcgggggccccttggctacatatgtggctgagttcgtccaacactccgcgttagtcgagtgtgcatgtcgtccgagcttcgttttgcctttcgcgattcaggccacccacctccacgaatcgtcaccacttcgattgctaagcggctgttaaatactcacgaagaatggacaagcaaatagtgagatgccatcacgaattgactcctagatacataagaagttaatctgtgaatcattcaagggaaaacaagggcctgcacgtggggttatgggctggcgaaatctctgatatcacaattactcacaacctcgtgccgaattcgggcaccnagggggggggcccgg

SEQ ID NO: 94499 - DNA, 438 bp, Triticum aestivum
  Clone ID: PAT_TA_94499
ctacaatcatatacatgcaacactcgttaatcccaatacaaccctctcacgtcccttacgaactagttccggtataattttacacagttatcttcagattagtacttccaaggctcaacgtatttacaacatcgcccttgctattaacaaagggcgctactttaatttatgcgaattccataattggagcatttggctttcatcaaataaccggcttaactattattgatgttaaaattttaatacctacgagtcatctcagttttgcgaaattctaccaaccctttcagacatgtttcttccgtcatctcaattacttttgaccttcactagcctcttcatatcgattgtcactgctctgacacctcaacgtgcatcatttgctgaaccgatgcaaccactgggagcatcaaacgtttctcgaaagccagcttaaag

SEQ ID NO: 94500 - DNA, 425 bp, Triticum aestivum
  unsure (1)..(425): unsure at all n locations
  Clone ID: PAT_TA_94500
ctccctctcctcatcggagaagaggaatccagatgcgccagcgccctcagtgttgggggattcaactttgacggagttgaggtccgtccagagtccgatctgaanacctcggctgcgctcaatcaaggcaggagacggcatcgggaccacggatggtggtggtggaacagcctcgtcatcgttgaagaagggtggacacccagttcttgccgccctggttggacgacggctgaaacctggcggtgccggtgttggtggtctccaacgcggtgcagtaggttccacctccggtgtcggtgagtaaaggtttggggccgcgactgtggggaacatctcctccatgggaactgcatcaagttgcncttgagaggtgtagtactggcgggcancggtnaaaataacctccaanaagccgggcgtcacnc

SEQ ID NO: 94501 - DNA, 431 bp, Triticum aestivum
  Clone ID: PAT_TA_94501
acaccatggggaaagataagtcagaaaagcgcgataagaaggaaaaaaaatccaaacgcagcgagacagatggagtgaaaaaagcgaagaaagacaaaaagccaaagctcaccgaggaaaatattaatgaagcatttcaagaggctgtgaaagacaccttgcctgatgctccatccccaaagcccgaaaatgccaatttatcaagaagcgatcttagatttgaagccagttggaagtctagttccgtttgcaaatccattggcagatgaaaaagtcaccaagaaagttctcaagagtgtcaaaaaagctgctaaaaataaaacactcaagcgcggcgtcaaagaggttgttaaagcgttaagaaaatctccacaaggggttgatgccacttctgcgactggtgttgttgtacttgcagcagatatctcgcc

SEQ ID NO: 94502 - DNA, 159 bp, Triticum aestivum
  Clone ID: PAT_TA_94502
taagcagaaacattcaaacaacagctaccatctgcagacacattattgtcatctcaattcccagttagtgaaacagcaagaacaggtccatgatctagatctacataggtcagatacaaactccaagtgcaaagcagagtggaaagatccttaagttac

SEQ ID NO: 94503 - DNA, 440 bp, Triticum aestivum
  Clone ID: PAT_TA_94503
cgacaaaatagttttaatcagtaattacacccagactttggacatgtttgatcggctttgtcgcgaacgtggatatggaagccttcgacttgatggcaccatgaacgtgacgaagcgacaaaaacttgtcgacaagttcaatgatccaaacggcttagagtttgtatttctacttagtagcaaggctggtggctgtggtctcaacttgattggtgcgaatcggcttgtcctctttgaccccgactggaacccggcagctgatcaacaggcgcttgcgcgcgtgtggcgtgacggtcagaagaaagactgctttgtctatcgctttatcgcaacgggtactattgaggagaaaatcttccagcggcagtctcacaagcagtctctctcttcaagcgttgtggactctgccgaagacgtcgaacgtcacttcacccttgaca

SEQ ID NO: 94504 - DNA, 446 bp, Triticum aestivum
  unsure (1)..(446): unsure at all n locations
  Clone ID: PAT_TA_94504
ctcgtgccgaattcggcacgaggccatttcatctcccccgccccgccgatgcgcgccgccgatcccgcgcagcagccgccgccgccgccgatcgatccgcgctccgcggtggcctagccatgtccccccacacgtcgtggagccccccgctcccgggcgtcgtcacgctcaactgcacggacagcgcgtacgagtgcctcccgctctgccccggcgccgactgccccgactacgccgcgcccccgccgccgccgctcccgctcgccccggtcgccgtcgaccgccgcctgcccgtacgcctcctcctcaccgtctccctcctctccgccttcctcttcctctcgctcgggctcgccacgctcctcctctaacggcggcggccggcgccctgggccggccgccgccggggctgccaacggcccaagntggctcaaaagggaaggggt

SEQ ID NO: 94505 - DNA, 471 bp, Triticum aestivum
  Clone ID: PAT_TA_94505
ctcgtgccgaattcggcacgagctcagcatgccaaagaatcgcttgagccgttcaaatctctaaactctcctctcgttcaagcgtcatcttagatgtcgagtttccacaatcaatttcgcgtccagatttctacttctcagttacgtgaaccccgcctgatatgatctttcccgccgagactcctgcacccagtgcgaatccaactgccaatccaaaattggagcagaaaaccgtagacgcctcgatatgtggatgggtgggaggccgcgcagatgcaccggcgctgtgctctgccgggtcgacatgtgttcgtgatgtagaacaccagtacgtcggatgttgtgggacatcaggttcttgctcggccggaatctacacgagttgtctggaccgcaatagcaagggatgggtcaagcgccaaggaggcatttcaaagcaatgggcgtctacacatgttcaagcaaacaagg

SEQ ID NO: 94506 - DNA, 440 bp, Triticum aestivum
  unsure (1)..(440): unsure at all n locations
  Clone ID: PAT_TA_94506
nannannggaccaccttggcagctcnantcnanttcaatggctatctaacctgantaccganntcactcctactaanaactatcggtgtacatccatcatctgcacnatnggnccaaaancaaataatgtaaaacccttgaataanntcnggaaagctggactanntgttgttcgggtgaagttctcccatggnatcttatnaataccatcagtctgtcattgataacacacgatgaagctgaaagggttcaaaaaggacgccaggttgcnattgccttaagncaccaagggtccagagatcngaacaggaaataccgtanannangtggatatccccattgctgctggcacagaaatgaacttcacagccgatgatgaaatatgccantatttncgaaggataaaaataagtacgttgtctncacgaacataancatat

SEQ ID NO: 94507 - DNA, 468 bp, Triticum aestivum
  unsure (1)..(468): unsure at all n locations
  Clone ID: PAT_TA_94507
ctcgtgccgaattcggcacgagcagtaatctatttatccgcagtcaaacatctcaatcgcacataattgtcggttactactctcgtttacatagtttctttcttttatcaacttatctcgcctcaattttcactaccttcactcttaaatatcaacaaaatgtctcaattcggagcttactacttaactggattcatgcttgtaaccgctgctttctctcaacaatgccgattacaattcgatgctcgtgtaccgcaaggaactagtgtgggaagcttcgacgtcaaaacaagcttattccgtactacagatgtaattggcaaaggtttaaaattcagtgaagttatagaattacctaaatccggggcatcgctctttgacgaaaaaaaattccatttgaagttactatttctgataaatcaatattcaatgatcaaagttggattcccgacgcgccgaangtcaacc

SEQ ID NO: 94508 - DNA, 463 bp, Triticum aestivum
  unsure (1)..(463): unsure at all n locations
  Clone ID: PAT_TA_94508
tttttagcagcaacaaaacttagcattcaagagaagaaagaaacagctgaaatgtttgacggcgagcaaataccgaccgaccaaccaacccacgtttattgcatagtggggttacaagccccactcaacacacacttcttccatgacccccatccaatcagagaacgacaagtatctacaagctggttctactatctacgcttcactctgccctttttcacatgtccttgcaacatagtatatcccatagcactgagatcactcgctaggctaaccaaaacaacaaataaatcaaggcaaagagaagaaaatccgacactatatggacaatcaaaaaccctcgacgccaggtctccgcatgatgttggggggcgatttcttgaccgagcttaccctggggtaagtccagggtgatggtggaagagcagttccttggggggaagcagcgcaaacntccgattat

SEQ ID NO: 94509 - DNA, 454 bp, Triticum aestivum
  Clone ID: PAT_TA_94509
ctcgtgccgaattcggcacgagacaattaaagcccaaaaattatggtattctattcttgaggctcaaacagaaaccggaaatccgtttatgttatacaaagatgcatgcaataaaaaaagtaatcaaaaaaacctaggcacaattcgtagctccaacctttgcactgagattgttgaatattcatctccggacgaagttgctgtttgtaacttagcatccctggccttaccaacatatgttgattccaccaatggaacttacaacttcctaaagctccatgaagtctgccaggttgtagtcaagaacttgaacaagataattgatgtaaattattaccctgttcctgaggcccgaacgagcaactttcgccatagaccaattgcaattggcgttcaagggttagcccgacacgttcctagctcttcggctacctttccgaatcacctgaaagca

SEQ ID NO: 94510 - DNA, 438 bp, Triticum aestivum
  unsure (1)..(438): unsure at all n locations
  Clone ID: PAT_TA_94510
agcaaatttaaaattagaaactcataagaaatgtaaattttgtgggaacccatgcttcacagatcggaagatactccaatgtacaaagcaaaattatgtacttatacaatacaaataaacaatgctaatcacgtaactgaataaccccgctaagaacaatctctgcaccaactttgcattggcattaatcaaacacgcgattcatgctccgtccttcaagctttatttttctccattcctcaattaccttgcaggaggaagggcgtccttggaaaattcatcgattcccacgattgcaatgcccagggtatgtgcaatggcgaggcttcttatgcccttgatgtatgcaaaacataaaacagggccaaagaccgaaatgaaccgttccctcaagacctgtagattgtggagtccgtggagagaaacaccattgntctc

SEQ ID NO: 94511 - DNA, 450 bp, Triticum aestivum
  unsure (1)..(450): unsure at all n locations
  Clone ID: PAT_TA_94511
gtaatttatctgctacctgtacaattcatatagccttcatttatatgatgggaagattaacatacaatttacaaatgttccttgctctttgaggctgatcccatgatggcactttgttgcatatagctccgtaccatgtctgccagtcaataatgtgagacaaaatttttcactcctcgcatgcgatggcaacaagtacacaaatatcgtcaaccttgccccctctatagttctcctgaggataatatttgtggacctctctcgcaaatggtccatctcggctgacactcatgctggctaccttggattccgtcgtgatgcttactgctagagcactctgcagactagcacctgaactagagcgtaaaatgtcgataagtcctggccaacgcanattccgtctgacgtaagtttccaagcttgggttctcgagcatgatctttngatacn

SEQ ID NO: 94512 - DNA, 479 bp, Triticum aestivum
  unsure (1)..(479): unsure at all n locations
  Clone ID: PAT_TA_94512
gaggcgtgcgaggccgaggactttgagagggccgagaggatcagtgaatcccttgccgctctggagaaggacaaagatcggttgttgactgcgctgcgtgatgcggagcttgattatgattcngtggatttggagttncaagatgtgcttnagtcccgcataaccntggaggaggaaagctgctgcccttctcgagcaatttgcaaaggatgccacaagagcaagctgattccgtnaagcaaacaaagcaaaaaaaatttcctccnaaagaaataaaaaagggnggaaacaacaatgggagtttctacaaataaaagaaagctagaagaatggagggttgaaaacaanaaattggtttttaacaancaaccntttaangggttaaaaagggttcaanttaaagcaaattttgtttaaaagacccatttannaagagnaaaaagggcaatgcttaagnttaaaaaanggggngattaccc

SEQ ID NO: 94513 - DNA, 472 bp, Triticum aestivum
  unsure (1)..(472): unsure at all n locations
  Clone ID: PAT_TA_94513
acgacgagaagccacgaaactccaggcgcagcggcggccgtggacgcgccgaggagccggaggctctgcggtgcgtcgcgacccggcgagtcgcggcgaggcccaggagagcgcgctcgcggggtgcagcgtccgacgttggtggggtggggacgccggccggntggggagaggagcggcgggagtccgcgtgcgagggcaccacatcgccagggcgtgagcgacccctcgacggcggcctgggatgggccaatcgggcaaggagcagtgttgttcttcgcgaacaaaccatgaanatatgctcagcatgctgactgatgacatattattatctatcttggggagagttgacacagccacggtaacactgantagcgtgttgtcanagcggtggagagatttgccattggttgcttcctgtcctcaaccttcgtgtctggaantttctggcggatncaatncccggnanccn

SEQ ID NO: 94514 - DNA, 437 bp, Triticum aestivum
  Clone ID: PAT_TA_94514
cagcgcctctccgcgatccaaatcctcccgggaaagttcttggttgatctcttcctcctcgaccgcctcccaggttcttggtgtagcttttgccactctcaccaggagatttcatgtctgatcttgacgttcagatcccaactgcctttgacccctttgccgaggcgaatgctggggacgctggtgcagctgccggatcaaaagactacgttcatgtacgcatccagcagcgtaatggtcgcaagagcctgaccactgtccagggcctgaagaaggagttcagctacagcaagatcctcaaagacctcaagaaagagttttgctgcaatggtacagttgtccaggacacagaacttggacaggtcattcaactccagggtgatcagaggaagaacgtctcaaacttccttgtccaggccggcattgtgaagaaggaa

SEQ ID NO: 94515 - DNA, 439 bp, Triticum aestivum
  unsure (1)..(439): unsure at all n locations
  Clone ID: PAT_TA_94515
gcgagctgcaacgacactagatggctagtcaagccgaggtagtcgaggcaacggatctaacgctccgtttcaaacacactttttacactttctttctcttcgtcgacgccagcatgtcatgtagacgcatcaaaaatagcctcctcgccatcctctctgaacgctatcccgacggcctaccagttgaccccaaagatccgcttccgaacgctccgaggatccccctgcccgcatcgggccacgacattgtcttcggcgtgccccgcagcccctccgacccagcccagggcttcgatgaactagccgctgcacctgaatccaagctttcgcagccttggcatcgaagacaatagtgtactggcctttgccttcctgtcggcggggccaagagattgaaggggaagctgtttnaggtgaactttcccggacctcgaaacan

SEQ ID NO: 94516 - DNA, 439 bp, Triticum aestivum
  unsure (1)..(439): unsure at all n locations
  Clone ID: PAT_TA_94516
cgagttttttttttttttttttttttttttttttttttttttttttttttttttttttgaagtttgtactttttattgcaagcgcgagctctgatttgaaaagttttattgataatgtaaacagtgctttgccanatgttgccgcaatcattagtaggagattcgattgcaatagtctatcatccacatgaaacttggccattacactggcaggccanaaatttccaacaataaatgtttgctcatgactaagttccctagtttgtancccctcaatagagaagaatgcaattgtttcgaatcacaaacatgggcctcgagctcctctgcatcagcatatgatgcctattatgacttgcccaagtagtccttctttccgaaatctatgcccctccttgcgcaantaagttgtaggcaagtaacnaaatgggaagtantg

SEQ ID NO: 94517 - DNA, 467 bp, Triticum aestivum
  unsure (1)..(467): unsure at all n locations
  Clone ID: PAT_TA_94517
tcncagtagtaaatttatcaaaagantcaggagactgggaattattgaacgagcaaatcctactgctgtctaaaaaacatggccanctcaaacaagccatcaccaaaatggtgcaggccgtaatgggatttcttgactctgcgccaaatctaacgatcaagttagctacaattgaaactctccgaaccgttactgaggggaaaatatttgtggaagtagagcgtgctcgagtgaccaagatactttcagacattaaaaagaagcaaggtgatttgaaagctgcttcagagatcttatgcgagcttcaagttgagacttttgggtctatggaaaggaagggaaaaaacaagaattcattcctcgctcaaagtcgctcctattgcatcgaaaaacgaagattgggttcaaggctgggtatccctaagnccggaaagatnaagcaacnaagttaccttttctaaggaaaa

SEQ ID NO: 94518 - DNA, 445 bp, Triticum aestivum
  Clone ID: PAT_TA_94518
gaacaaagatcgagaatgattcggatcagaagttgtatttaccagattttacagccgactttaaaaataacatcgaaaaaatagaaataaattccaactcaaagccctcccaagcaaaattttcaatcggggtccggcaaaccatacaaacaaaagatgaagtcggagacacgagccaacgagatatcttccctaaagattctaatcatacggagagaaaattaagatttgcacgcaagacgactaaagaggccccaggaagaaataaacgcacatccgtaggaacttctgaacgggtaaagggatcatatagactaaaatcccgaagtttaagaagcttcaataaataaatttcttagagtgttaaaagagtatcaaaggagttaggtcgcttaagaatcaagaaacagtgatgaaattctgggcaaaagttatcgtataatag

SEQ ID NO: 94519 - DNA, 444 bp, Triticum aestivum
  unsure (1)..(444): unsure at all n locations
  Clone ID: PAT_TA_94519
attggagatgccctaagcaatggtctaacagaccacatcacacatgtgggtagcaacttcagaattgatgaaattgagttcaaatcgaaaataaaaaaatggttttatattgaaacaagggtaaaactgtgtaggtccgaaatctaagagtagtgggaaccaaccaagggcatcagcctaaaaaacctaaaatgattgtcctggcatcaaagcggcccatcctgtttcatgcccaacttaccgcggaaaattgtttgaaagacgatgatcaggtcattacgtcagacaccagaatatttatatccggttagctgtttaatcctggcagacctgatcaaagcacggggctggtgatgacatgctggtgacgctggtgcctctttcanccaagcgcgcccgagcaaactcctacattgtgtatatggggggnanaaaaacaatnan

SEQ ID NO: 94520 - DNA, 446 bp, Triticum aestivum
  unsure (1)..(446): unsure at all n locations
  Clone ID: PAT_TA_94520
ttttttttttcggcccacatacgcctgccgcacgaacggcttcctcctcgagcacgaactcgaaccaacacccactcaccagcagtacatcgcggggcattttatacccagctgcacacacatgctagcacacgcacgcacgcaatacccggccaccacacggccactaactccaaacacacagtaatcttgctaactaaccacacgcatgcacgcctcttacttgaccggcacacacactatcttatccatctaccgcatgcatgcacaaccgcacaccacggctgcctaactgatcggctgaagctgttgctcgttgccagctcctctcagaccactcaaccatcatcaagcgttgtggcttactcctgacattctccccctaagccacaacctngccgtcgtcggagttgttacagctcctgtcattgtcgtcgtcacggccg

SEQ ID NO: 94521 - DNA, 453 bp, Triticum aestivum
  Clone ID: PAT_TA_94521
ctcgtgccgaattcggcacgagggccgatccctcatctaatattgccaggcacaaagctagatgccatgttttcaatcctacatctcgtagcaaactctcactatcaaactcttcaagtattcaatttcgggagcgagcaaagatgtccgaaatctgggccgaatcttgaacaaatcgataagcccatgggtacgactgacgaatggcattaccatatgacatccaatacagttaattgaaatccatgcatcgaaccaatgtccaatggttcatttcatggctcagccaactgactgacgacgagactgggctctctttgtggagttgtttcagcagccccacatggaactctcaacacccattggaaacccctcatccttcaagccgacatgtccaacttacgatggcaatagtgaagcagaatgagatggtagacacaaaacttgggccat

SEQ ID NO: 94522 - DNA, 450 bp, Triticum aestivum
  Clone ID: PAT_TA_94522
ctcgtgccgaattcggcacgagggctctacggccctgctcttttcatgcagaggaagaccataactgacatggtggtcggagccataacaatccccaaggaccatgcagttgtcataggcgccccattcatgcaccgggataaaaaggtctggggtgaggatcggatcagttcaacccgatgagattcgcgaacggggtcgccagagcggcgaaggttccacacgccctgctggcgttctcgatcgggccgagggcgtgcatcggccagaactttgcgatgctcgaagccaaatccgtgatggtgacggttctgcagaagttctcgttcgctctctccccgagctatgtccacgctcctgcggatttcctcactctgcagcctaagtttggcctcccccgtcgttattaagctgctggatatatgaaatggaacccggctggttctgaat

SEQ ID NO: 94523 - DNA, 470 bp, Triticum aestivum
  unsure (1)..(470): unsure at all n locations
  Clone ID: PAT_TA_94523
ctcgtgccgaattcggcacgagctgcgacgacggcccaggtgcttcgacgctcgacgacgacnatgctgtgacagtccgcggtcgggttgctccaaatccaccggagctgctgcgacggccgccctgcatcgacgctcgacgacgacgatnctgctaccatccgcggcggggttgctccaagtccaccggagctgcccgcgtcggcatccctgcttcgacgctcgacgacgacgatgctgcgacagtccgcggcggggttgctacaagtccaccggagttgcttcaacgctcgacgacggcnatgctgcgacggtgacgttactgcgagtggcaccggcccgacgatgcttgcaggggctgcgggatccgtgagaggtgcccgtcctcatggggggggctgccgggtggtgctcaaaccactgctngcgaaggccactgggaggctgctacgactaagtgttgttattgg

SEQ ID NO: 94524 - DNA, 471 bp, Triticum aestivum
  unsure (1)..(471): unsure at all n locations
  Clone ID: PAT_TA_94524
gcggcgttcatgtcggggctccaggcggaggacgtgcttcctggagcggcggccaagatggttaggtgggcgacggggctggagaagaggatcgacgtccaggtcgaagcgtgggacaagttcctatccgagataatggccgagcaccttgagaagaagcgtgacgacggcgcactgggcgcagaagaggacttcttggacgtcttgctccggctgaggaaagaaggcaccgccgggctcgagctcaccgacaatcgcatcaaaagcatcatcaaggacatgatcttcgccggaactgagacgtcatctatcacgctggaatgggtcatggcggagctcatccggaaacccgcgggtaatgggcaagctgcaaggacgaggtaacacgaatcgccaacggnnangcccggccatccagggaaagacgattttggaggagggntnggagtanctttaaaggngggtgctnaa

SEQ ID NO: 94525 - DNA, 456 bp, Triticum aestivum
  Clone ID: PAT_TA_94525
agacagttttgcccatggtattgtcagtaatcagcaagccaagatgactgcaaccagacatactggcacaagaccacgggtgtctaacagagttgtaaacagcactagcaactacagaaatggcaggagggataacccaccgagaaattctgaggaaataagggaccaagtttgtggtccccgtgcaagtaaagtgaataacacatcaacaccgactgtgaagaaagatatcttgagcccattggtccgtagagaccaatttaacaaatcggacttctcaatccagtatgagcatgccaagttcttcatgataaagtcatatagtgaagatgatattcataaaggtatcaaatacaatgtttgggcaagtacaccgaatgggaacaagtaagctggatactgctttccatgatgcccagatttttatgaaggaaaagggtacaaaatgtccccgtc

SEQ ID NO: 94526 - DNA, 449 bp, Triticum aestivum
  unsure (1)..(449): unsure at all n locations
  Clone ID: PAT_TA_94526
acattttgaagctagcaacaagtcgagagacagctattaacatacacacatcaagaaagccaacagattcgtgaggagactagccatgccgaaactctggactctcgtcgccgttttaggtgtattttctagccttgacactgcctcatcgacctcacttccacatgttcgccgtgggaattcaaacattaattcgatnaaatacatctgcagcgtacatgtcacattttttggatcaaacatatataatagtgtcaacagtgccaaatcacaggctgggggagtccaactccgtgcaattagtcaatctgctagcaatgtacccnacattcaagttaatcagctgatatcatggcaagatggaacctttctctaccccatagcaagtactagtagctcacaaaaccgaagacacatccagatttttgtcgtcctgaacaacaactggg

SEQ ID NO: 94527 - DNA, 457 bp, Triticum aestivum
  unsure (1)..(457): unsure at all n locations
  Clone ID: PAT_TA_94527
ccggctccgacgacgacgaggcggcggcggcgccgatccactgcctgccgcccgacgcgctgcgcaacgtgctgctgcggctgccgctgcgggacgcggtggcgtgccgccccgtgtcgcgcctcttccgggagaccctcacggggccgttcctcgcgctgctgccggcgctccgcctgctgctgctccgccacccgcggcccgagggcgggggctgcctccacgccttcgaccccgaccgccgctgctggctccgcctccccttcaccgccttcctcccgcaccaaggccttctcccccgtcgcctcctccgcctcgctcctctacctctggatngannactcccccgcgcccctcccctcctcctcctcctcctcgtcgtcctcgtcgcccgccgcaacccaaccgcccaaggngctcgccgttctggcaaacccgctggcgggcaactaacgcc

SEQ ID NO: 94528 - DNA, 452 bp, Triticum aestivum
  unsure (1)..(452): unsure at all n locations
  Clone ID: PAT_TA_94528
tgaaaacattcatacgataatagttaacattgccgttacaaccatccgtatcatacaagatgtcattaaggtctcccatacacatcatgggcagacccagattatcatacacaaaagttgaaatctcactccaaatggcagtagtttgtctatgatagggatcaccatatatacagaccaaacaaaattggncaccagtggttacatgaagtacaatagctaatatatagtggaaggaagcagcatgaatagtgactttgagatcatcattccacattagccagagccctccagaggcccctctcgaaggaacaacaaaactgttggcaacatcaaatctatnaaccagatcaattgatcgcactttagaagattttatttcagaaacaaaagttacctgcgctttagtagaacggatcagattaagccagaaatagcatacgatcattgct

SEQ ID NO: 94529 - DNA, 658 bp, Triticum aestivum
  unsure (1)..(658): unsure at all n locations
  Clone ID: PAT_TA_94529
atgatgatgtatgtgtatgataacagaatacttcaatgaaactagcatgatagccactggagtatcctcgctttctgtaagccggctctcacatgacccaatcgatgttttaacctggataagttcagggtcttgtttaaagattgacttatcgagagtacacgaggtcggagtagcatcatgcaaacaggcaggtttaaccaagtttcaatgaaggccgcttagtagcctgggttcatccccgctatctgtaagccgtgccatcacatgacaaaccggcgttttaaccttaacgagttcagggtcttgttttaaagattgactattaagagttcgccgggccaatcangattacctgatgaagaagcanctggcatacaagcangatgacccggaagagttatgtcctccttgggtgaatacacctatgtttgaacaagataaccagtcaaaagggtaataacctatgttcccttggtgaatacactatgtttgacaggaagccccaagtaccatataactgagccataagaagataccntgtttgaccnanacagggancaantcccgtggaacttatcaactncanaatgatcnttnaccgntgtaacggtatgnactcaagcttggganactcctacggtttaccgacctatna

SEQ ID NO: 94530 - DNA, 660 bp, Triticum aestivum
  unsure (1)..(660): unsure at all n locations
  Clone ID: PAT_TA_94530
tttttttttaggagaaagagtgagtttattccatgcatgcacatgcactttttatgacccactcatacctgtgtatgacaaaaggctgtcaatagtacgcatgtggtggaaaagttgtcagaggaagaaagagagatacgaaattgtgtgaagctgaatacatgcatatacttatgaggtgatgggaccgacgcacacatctgaaagcaaatcaaccgtggatgttccaccggtacatccctgaaccggtaaaaagaggtttctgtctcacacggtccatgaggcagacctcttgagcacagggttcatggccttgtcctcctcgagggagatcatgcccaggtgggacgggtcctccagcatcatcttggccaccaagtaccccgcgatggaccacgtctgggtgctcctcgcctgcttcccgacgtaccggccgagcttgccgtcgtagtactccggcaactgtcctcgccagctcgcctccgccaaatngattgctcgcctcgcgatcttgagcctcccggtcttgatcaagcgccgtcangagcagtnanacagcaagacctcgttgtggnacncactgggtctggggccnaccgtgactctgcaaccggcccaagcggtacaattnacggannccnataggcnccacgtcncata

SEQ ID NO: 94531 - DNA, 663 bp, Triticum aestivum
  unsure (1)..(663): unsure at all n locations
  Clone ID: PAT_TA_94531
ttttttttttttttttttcaaaacacgacccccatggatctcggtctccatttggcattttcgagctcaatgccattgtctcatcaanttgtcccaacttacatcacggaaacatagccatggctgccaagaggtaaccaaagnagagaganttagaaaaggagctcataatcgccaaaactgccttatgaccaaaactacagggcatgcagcttccantccatcanttccacccantatctcaactgcngaancataacttacaatganccagcaaactaatgactgcggtggnggngatggcaatgatnaacgatcactaaactacattattgncccatcttcctgngcacagcacagggtgcattggncacgcatcaggggacactggnggcatgtcagcancaccaactcancgatganagatgtcatcatcgtcaaactgcgaagtccaactaactgagctgnganaggagactgcangattggtctcancttcncttnatcacgacggctggnttctgnattgccncanaaatgcatctacgcggtaatggaaatccntgaatcaggtctctngaagacacaaacgctgngcctcgngctcgntcgggacctttcagcagaaatagtctctgcaatgttctgtcccatagatgcaan

SEQ ID NO: 94532 - DNA, 173 bp, Triticum aestivum
  unsure (1)..(173): unsure at all n locations
  Clone ID: PAT_TA_94532
ccgagtctcctccctcctctcaatcccctccgcctcaacccgcgacgaccccgctcgcgctaggctacccccccccaccncccnccaccncacnccatggacaccgcngaatncaancacgaggnggacaatctnctcatgnttccnancgncttttnnaacatccncnacgg

SEQ ID NO: 94533 - DNA, 355 bp, Triticum aestivum
  unsure (1)..(355): unsure at all n locations
  Clone ID: PAT_TA_94533
gagctttgcgctgaaagttcatcagcaactatgaagggcaccaagctcgcggcgatcctgatcctccangccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccacgtggtgtcgacnanncccgaaatgtggcgctncgcggntatgaaatccaccgtcgacggnacctgcggggnaccctgcaaaaantnctgatcggttaatnccgnnatttgaatntttccncccnaaantttaanaaaanctcggc

SEQ ID NO: 94534 - DNA, 636 bp, Triticum aestivum
  unsure (1)..(636): unsure at all n locations
  Clone ID: PAT_TA_94534
gacagcctctggtgcatccgctctgggcctcgcccctccccctgccccgcccacctccgaatttttaagggaagcagcgtgtggtggcgtccgcttatccctctccctgctcctagataccagccagcctcctgtccctctccctgccgggcgctcgccgtgttcacggggcggcgaggtgcgtacgtgcgcggctggtggcggtgggcgatgccgcaggtcgacctggagagcctggtgtgcggcggcgcgggcgcgggcgccggggacaggaaggtgtcgtgcgagacggtcatcgcgggcggggacagcggggacgcctcgcccccgcggcgcgtgccgccgncgccggaccacgacttcccgccggagtcgataacatccgcatcggcgacgacgcggcttctcggagctgaaccgatatacagcgggacgactccacaanggcagcacaacccaagtcgtcggtgcggcggcggcgctgaaccctcccgctaaagnggtcaactcgcngctccgggcggcctncgcggcacgcacttttggctccggaantnggcggctnaccggcancgtnaggccgtttgcnaaaagttgggaccgnagacaagtncaaggtctcttgaaggntncang

SEQ ID NO: 94535 - DNA, 651 bp, Triticum aestivum
  unsure (1)..(651): unsure at all n locations
  Clone ID: PAT_TA_94535
ccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccaagaggaaaagaaagcaaaagcgatccccgttagtagcggcgagcgaaatggggagcagctaaacgttgaaacgggtttgtgggaagagcaatacaagcgttgtgctgctagcgaagcggtttnatgccgcacccctagatggtaaagccnattacccgaaagacactactttacntcctgacccgagtacatgggacgttggaccccttgtgaatcaacaagcactttcnaagnttatanccctgggtgaccgatacgaatatacgtttaggaaagngaaaaacccccatggtaatggaataaacgtgaacctgctgacccccangtgggaaggaaatgncnctgacgcctgctgtgaaaaatgaccgggatcatagcaatggttggtaaggaacggaccacggnccgtacaaagcagtctataggcattgcacgctatgcccanctggngtnatcatncaagatacnttgtactacaagtccaccnctttt

SEQ ID NO: 94536 - DNA, 630 bp, Triticum aestivum
  unsure (1)..(630): unsure at all n locations
  Clone ID: PAT_TA_94536
ttccgatctgcaaactctgctcctcctccgcgtagcagcagacaagggacgagaggggggagangcctctttctcttcgccggccaaatcgagctanctagccaggcggcggaganatgagcnaggcggtggcggaggcggcgtctacgcggcgccggacgctgagtgctggtgaacctgacgtcgatgctggagaangcggncgaggngctgctgccggcggtgtaccggagtntngcngcagcgctggccgtctcncccanggcgctnggctcactcacnctctgncgcgcgtngncnaggcctctccttcgcgctcgangcctacgcctccgcacgccacgaccgcnccaaagtcgtcgccgtacngtgccttcctctgggtcgccgccacttcntcgtcgccatctcccgcacctactccagatggcactcncgnaggctgaacagatcngctcgcnctagcattcnggcatcaatccctggcgcngactaanggcgacanacaaagncgccttttcgntgnttgaaangactgnaactcggtcatcgtgggggtcctcnggtntctacgcgtcactccngngtnccggtggtgtccgtcaatgnggaanacangtncctgnctgc

SEQ ID NO: 94537 - DNA, 295 bp, Triticum aestivum
  unsure (1)..(295): unsure at all n locations
  Clone ID: PAT_TA_94537
cggaatcaagctcttattctcatccgcataccatcctcaaaccaagggccaaacagaggtgacgaaccatacgctctccactctacttcgcgtgttgatcaagaagaacatcaaggagtgggaggagcgtctacccatcaccgagtacgcctacaaccatgcacgacattcgacgaccggcaagtcccccttcnaggtcgtctacngcttcaaccagttgtcccattggacattctacctcttcctctacatgagcgcaacaacctccaacgcaagtgcccatggaagtacatcg

SEQ ID NO: 94538 - DNA, 641 bp, Triticum aestivum
  unsure (1)..(641): unsure at all n locations
  Clone ID: PAT_TA_94538
cttggttttactggaacgaggcagcattttgggttcggggaccaatggagatatagtatacatacaaaaaattgtggacgtaggttcgaccgaaaggcaatgatgcatgggccctgcattttgaaataccgggggccgcgtgaaatttgcaactctactcaaaaactagtaaggtacacatgcattgaacgcatggagattccgaaaccaaatttatgaataaatacacactatagcatgtaaagttttgagtcatatatgcatgatggtagatgtccgtttagtccttatagtcacctcaattccaaaaccaaagtagttttaataaaatttaatccatggagnttngtgcattggtnaagcataaagtaagaacaaataatggattcattttnnaaaaacctatttataacagnanttcctagaacagggannaatnttgtgtttgnagntttgggcattaagctaatcaaccagganctccaaattgtcagtggcaaatatgnnggangttgatgataccaaggcataaggncgantgcatccgnacaacggttanttcatcacgcatcttcagttatgcancaaaagttctggcanatgnagtttgaaancacanggttncaccattgnaanaaggn

SEQ ID NO: 94539 - DNA, 635 bp, Triticum aestivum
  unsure (1)..(635): unsure at all n locations
  Clone ID: PAT_TA_94539
gtgtcgctggtgcgcgcgctgctctacatcatcgcgcagtgcctcggcgcaatctgcggcgtcgggctcgtcaaggggttccagagcgccttctacgtgcgctacggcggcggcgccaacgagctcaagctccggcttctccaagggcaccggctccgccgcgggaaacatccggcaccttccgtctccgtctacaccgtcttctccgccaccgacccaaacgcagcgcccgtgatcccacncccnagtgctggtcctctgccatccggtttcnccggtgttcaatgggtgcacctgggcactatccccgattaaccgggaccnggatcaacccggcaaggantttgggggctgctggtgattctacaacaacgagaagcctgggacaacantggttttcctgggtggggcattcaatccgggccgcaatngccgcttatacaacaatactgctnaaggcaaccaacaattcggtcgccgctcctttgggaaccctattnaaggcggcgcctcncatggccgaggatgaacgtnantnagagaaaagggctcaantgtctgtgtcggnctgatcgcggcttnaggtccttttcnatccnccctttgggtgtttcacgcagggcctcnggttgntn

SEQ ID NO: 94540 - DNA, 668 bp, Triticum aestivum
  unsure (1)..(668): unsure at all n locations
  Clone ID: PAT_TA_94540
ctaggatgaacgctactgcgcgatgtcgtctgtccgccgccgttcaggatcgaagctgcagcccaccctttgcgccgcaaaagaaatgcttgcaccttggttcgactgctgggaggaggaccacccagcgaggtgactgagttgctgccgccagaccatgcagtgggcaactctgtctgggtacatctgcattctgcatgtgtgtttggtgggcttggtggctaagaatggagaactgtggctacatccacccctcnactatcgcgcaagtgcgattgtggacacctcnatttatttttcctggagtatgctccatccccattccagtgtggntggtttngagaggtccnagangtgatcacttttcaaaatgccacctcatattttttcctcnaccntcctgttttccataatgttttaagnaagagntnaaagagtnaacgtaaacacatgtgtttggaaaattatttaagtgaatattgtgttttagcaaaaaaaggggggcccggtaccattnncctaaaangatcctattagcgcctaacggcgtcntttaaactctgacgggaaaccngngtancaactaacccctnagaanccccttccagtgggaaaacaaagccgacgttgccttcaantnccactangcatggacccccntcggatag

SEQ ID NO: 94541 - DNA, 661 bp, Triticum aestivum
  unsure (1)..(661): unsure at all n locations
  Clone ID: PAT_TA_94541
tttttttgaacgaacagggtcagctattatcagcttctatttcagtttctgaatccagcagtttattgtacagtataacatacatagtacaaagaatggcacgaattattaacacctacaagttaccgatgagtgggcatttcggcgtgcatcttccactcccaagcaccattgcaacgttgtccaatatggcagcctggattactgtcgccagcagcgaaatatgatcggcaaaccacggcgaagacaattctgaattgactgcgatcttgcaacagattacctaggcaggcaggcaggctagtgaacctgaaacatcgtccgcaacgacatggaaagagcacatttgggtaacttgattgaaganggatttacacattggtgcttgcaccaaaggagaanttcctttggcctcaaaacagtcctaangtggttgttggngatnccngtgactgcnagcaggaagaggtttaagggctcctccccnggggctgccccnggnggtggtgtggaaggatcgcgggaagngaanacccgggccgggtccgcgggggacggcatgnccnctgtgcgccgacattaaccccgagaggagccccgcgnggccgggcnttnatcctnacatcgcggaactcntcnccnccgngganaacgntggtnn

SEQ ID NO: 94542 - DNA, 279 bp, Triticum aestivum
  unsure (1)..(279): unsure at all n locations
  Clone ID: PAT_TA_94542
cttctcctccccttccggttcgggttctggttcggttcgggatcggttcgagagagaggccgagtagctancctagtctagggtttcggtagagaggaagngagatccatggcggagacggantaccgctgcttcgtgggcggncncgcctgggccaccgacgacaacaacctccagcangtcttcanccagtacngagagatcctcgacgacaanatcatcancnaccgcgaganggggaagtcncgngggttcancttcnncacgntcgggagcgag

SEQ ID NO: 94543 - DNA, 657 bp, Triticum aestivum
  unsure (1)..(657): unsure at all n locations
  Clone ID: PAT_TA_94543
aaaattatcatatcgtgtttattcagtataagcccttttacagtctataatcaatttctttggtaccggcctgctatatatataaaccttcggtcggtatatgtagataaaaaaaaggaataagaaccacatgtccaaataaataataatcataatcaaaggagaataaaaaacaagaaatgtaaaagaataattgtaccctaaatataggaatttgtttagcttcttgaacaggtccgtgcacttaatccatgatactgccgtgggtcttcttggatgaggcccatgcacttctcacatgcctctcctcctgcagcgacgatccaaacggcgaaacggagcacaaatttgtcaccgaccaccgtgtggggcaagataancttgccancctgttgagatctccattaagcaagcggttgggctcgtcggacctccttcgtcatggtcacttgccttgtcctaaagcacacaagacaaagtcctcgggacgacacctcaaactacancgggtgggtgaanctcaaacactggcaaggngactcacacggagtgtctggacttgcggacatagtggcagacaacaaagntggccaggaantcgcgacgccactgatgcctagatgngccnncaaacatacgcntntgagaaccggtggg

SEQ ID NO: 94544 - DNA, 657 bp, Triticum aestivum
  unsure (1)..(657): unsure at all n locations
  Clone ID: PAT_TA_94544
ccgagcccaccgcagcgtcacgaccacagactttgcaggagaagaccaccttttctcaggataagatgtactacgtgccccccttcaaaattggctactatgggatcccttcccaccttcattttgggggaaagaggactgaggccactataaatatatcttagccgccaccgtggagagggcgctctctctttagattcaaacccacaccggagcagactccgcaaggttattcatcctttgtactacttcatccgtcanccctccgtgaggccatccaccccaaaagcaagagtagggctttatgccgcaaggtggctgaacttgggtaaactgttgtgcctcttcttcttttatcatccagctaggcgtgggagtgacgtactgggtnggtggagaggtttantcctccgcanaccccgaagagttgacctttcctggggccaatggacctgatcccgacaagtacaattagtgggctcaaaattgaacatagccgtttattaannaaataantccagaataancggactcgggcancgcgcaantccatttgcagggaaatgcacacatgtttgttaatcgnccgtcacattagtagaaangagncnttanaattcgangcgcantggcgggccttctgacagaactcacnag

SEQ ID NO: 94545 - DNA, 570 bp, Triticum aestivum
  unsure (1)..(570): unsure at all n locations
  Clone ID: PAT_TA_94545
gcgcgccacgtctcgctcgcacccgtcccccctagccgccgatgagctgccgcgcggctccatggggccgcccgtcggccccccgcggccggcccttccccgcctcggcgcgcctccgcggcccgttcgggggtacgaattcgtggaagaatccagtcctcaaaaactcgtggagaatcggtgatgtcccggcaatgtttgggctgccgtctggactgttcagatgcatggcttcaagtagtccggggatggtgggtctctccgtcctcaatcaatgatgaagcaccgatccgctgtaccctggccggacaagcagcggcacgagtatgcatttgggtggntggtttggtgggctgtatacnctcctgagactaagaactcttgtaatggcctgggtaataacaanctcaagtgatctggttgatcaactgaaaagatttgtatttaaaccatgttgtatgactcctanaagagagtggattctgggaaaantccgtatttaagactacgaagacatagggcaattgtaangaatgtaantctcgccttcgatactaagaaagactgaga

SEQ ID NO: 94546 - DNA, 197 bp, Triticum aestivum
  unsure (1)..(197): unsure at all n locations
  Clone ID: PAT_TA_94546
gccgattccactaggttttccaactctcctgcacccgccgccgccacctcccctcccccacnacacnctcanccanggnggtcgtggngccggtgcccgggggcgacgtgaagctcttcanccgntggaccttcgagngatgttcangtggnggtncatctctgctgaacgactacctcccnggtgacgtcgaatga

SEQ ID NO: 94547 - DNA, 386 bp, Triticum aestivum
  unsure (1)..(386): unsure at all n locations
  Clone ID: PAT_TA_94547
cggcccagacgccatcgacgcgacgacggcgacgacgacgacgacgatgacggcgggtcagcccctccgcgccgacccccagcagcgccgccacagcccgccggccctccaccccgccgtggtgccgtcctacccgcccccggagtccggcaacgacgaatccttgggtctggtccaagataanggccganggcgcgccgcgaacgccgacgccgagccggcgctcgcgtccttcctctacgcaaccgtgctctccaacccctcgctcgaagcgctcctctccttcnacctcggcaaanaagtctgctcctcaaccctcntctcaaagctcctctaanantcttcgtcggtccctcgcnggnaccnacnatccgggccgccgccgt

SEQ ID NO: 94548 - DNA, 663 bp, Triticum aestivum
  unsure (1)..(663): unsure at all n locations
  Clone ID: PAT_TA_94548
ccttgaagcagagtgcaggcagatggcggaactcggtcggtcctagaaaaagcttcgtcttggacttatcagcgatggcgtacattgcgcctggagcttcacaaaaaacagcggcgagcaccggagaagcgccacatagaacctccaagcagtgtctcaaaaacgtgatgctcccaacagaggaacgacgtcggagacgctgtcatcacgccgatccaaccggacctaggctttcgcccagagacactaccaaccaagctcgaggaagatgccgacacacctcggtggcgcctccaaggaggaaaatgacaccctcaggcgccatcgacaccggctcttgttgtgcaggactttcgtccgtatcgtcgcacacctccgcccaanccctacggagctcgtccatgtcgtctctcgcagcaccttgttgttgaagccgtgaangnatgtcaactcccacggcgagcatgcanaggcaagtngggcccgcatcccgcgtctacacggtggagctcctgtccananggtagcctccaagtcnacgnagccataatgtctcgagcctcaatcgcgncgggcagnngagcaactcgggggccacttctncagcanggaacaggggggatcggccccggggaggccaatcggcatnnacgtgacgtccag

SEQ ID NO: 94549 - DNA, 617 bp, Triticum aestivum
  unsure (1)..(617): unsure at all n locations
  Clone ID: PAT_TA_94549
ctactgtcagcctcagctcgcccgaagcaaagctagcgagtacgcagcgcgcgatggcggccgcgaccatggcgctctcctccccggtgatggcgggcacacctgtgaaggcctccagggcggcgcccttcggggagggccgcatcaccatgcgcaagacggcgggcaagcccaaggtggnggcgtccagcagcccgtggtacggctccgaccgcgtgctctacctcggnccgctctccggcgacccgccgagctacctcaccggcgagttccccggcgactacggctgggacaccgcgggcctgtcggccgaccccgagaccttcggcaagaaccgggagctggaggtgatcactgccgttgggcatgctcggcgcgctcggctgcntcttcccggagctgcncgcccgcaacggnttcaagttcggngaggccgtgtgntcaaggcggtccnanatttcagcnaggnggcctcgatactcggnaaccaactgtgcatgcgaacanatctngcanctgggctgcangtggngctganggcgcctgntggaacnntngcggggcccctggtcagatngacgctctaccggcggaattgnccctggctcncnaggacc

SEQ ID NO: 94550 - DNA, 232 bp, Triticum aestivum
  Clone ID: PAT_TA_94550
ccgggactcccagcagtccggttagccggctgccggacatggagaagacaaagggatccgcggcggccggccgtagactagtttatccgtgtcgtgtgagtggagctccacgtgaccgtgcgtgcgcatagttttacctttttcgttgaaaatatgtcgaaaatgtaaccgtttcgtccggttttgtatgaaatccgtcatgtttatatgaaactgttttgggggggggggc

SEQ ID NO: 94551 - DNA, 644 bp, Triticum aestivum
  unsure (1)..(644): unsure at all n locations
  Clone ID: PAT_TA_94551
ccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggcagtgagacgatgggggataacttcatcgtcnaagagggaaacagcccggatcacaactaaaggccctaaatgaccgccaagtgataaaggaggtggggggtgcaaagacagcaagaagtttcctaagaacancacctttaaaagangcgtatanccaatgatcaacgccttccctnaaatgaacggctaacatctccgaactgtggattcaaaatcacggtagggagnntcnccttanaggaacacgcaaacgggtcacaaacgaacnaaattcgctnatacaaanatgggaatcatgccaaaccaggttcncgaggtccaagaggtataggctaatagcaaggnntctgnaaagcatn

SEQ ID NO: 94552 - DNA, 541 bp, Triticum aestivum
  unsure (1)..(541): unsure at all n locations
  Clone ID: PAT_TA_94552
cgcccgccgccgccgccgccgcagagccgcagggagagaaggcaaggaggaaggaaggggaagatgccggcggggcacgggctgcggtcgcggacgcncnacctgttcgcgcggacgttncgcaagaagggntacatcncgctcaccacctacctgcgcacctacaaggtcngtnagcacgtcgacgtcaaggtgaanggcgccgtccacaaggntatgccgcacaanttctaccacngtcncacnggctcntctgcnangtcaccaaacncnccatcngcgttgagattaacaagcatgtctggcaacaggatcatcangaagaggttcatgtccgtntttagcacgtgcaccatccaagtgcatcgaggantcctncaanaggaaatnaacaacganaactgaatgngnangcaaagnttcggngaatcatnacacaanangaagcanaaggtcaagcggagtatggttnngggacacatcgatacgttacccatccgtatgagtctcaagatntaaggtgntacacacgctgctctga

SEQ ID NO: 94553 - DNA, 204 bp, Triticum aestivum
  unsure (1)..(204): unsure at all n locations
  Clone ID: PAT_TA_94553
ggtactcacattctgccacacaaaaactaccaaccgtcatcccatttctagtccacggcgatcaaatgggttttattgatggtagaaatatcgtggagcacgttatgtttgttgcctacctcatcaagtcttgccatggtaggaaggagcaacccatggtcattaagcttgactttcaaaantcgaagggggggggcccggtac

SEQ ID NO: 94554 - DNA, 376 bp, Triticum aestivum
  unsure (1)..(376): unsure at all n locations
  Clone ID: PAT_TA_94554
tttttttggttgatgaactgacagacaatcctgagcatatagattataaatagagtaaaaaatacaaacatggaacacacacgatggatctcttgctcacactagcactactagctagctggtggtgtgtggagtgcgggaggtttagccggcgtagacgtggacgccgacggcgaccatgaagatggcgcagaaggcgaagaagatgacggtgtggacgaacatggcgatgccgttggctgcatgctgtggaactccgggcggccgcggccccgccgccggggatctcgcaagttaacccccggcagcacaccacgaaagaagcgtcgcgatcaanaccggccccatccgcccgacatttcnccgttaacggtga

SEQ ID NO: 94555 - DNA, 191 bp, Triticum aestivum
  Clone ID: PAT_TA_94555
catgcatctgctcctgagcatcctggccgacggcgaggagcaggcgaggcggctcctccgcgagctgccgccggccgacgacgaggggcagctgctcgggcggggaccggcggcccaatgctgccggagcgtggcggagcagctgctgtgcacgttcaggaaggccatcaccgtcgctaaggccatcgagg

SEQ ID NO: 94556 - DNA, 618 bp, Triticum aestivum
  unsure (1)..(618): unsure at all n locations
  Clone ID: PAT_TA_94556
ccgccgcaggctttgaccccatcgcccctccgtcctcttcgtctccggtaggccatgtagttaacagctccagcagccatgggaaaggagaagatccacatcagcattgtggtcattggccatgtcgactctggcaagtcaaccacgactggccacctcatctacaagcttgggaggcattgacaagcgtgtgattgagaggttggagaaggaagcgctgagatgaacaagaggctttcnaagtatgcctgggtgcttngacaagtccaaggctgagccgtgagaggggtatcaccattgatattgctcctgtggaaattccgagaccaccaanatccctgcactgtcattganctcctgggcaccgtgatttcatcaaagacatgatcaccggactccccaagctgattgtgctgtgcttaacantgatcccacactggtgnnttngagctggnactccaaaggatggcaacccgttnagacnctccttgcttcaanctggggtgaacaaatgtcgctgctgcaacaagtggtcacancccagtatcaaggcgttanaagaaatgcaggatcctcaactaanaggtgtanacctaaggttccttgtcacctgtcagt

SEQ ID NO: 94557 - DNA, 644 bp, Triticum aestivum
  unsure (1)..(644): unsure at all n locations
  Clone ID: PAT_TA_94557
caaggatatgtataaggcctcgttatttcagttaaagatccagatagagaaaatagtaatgaaaggacaagaccaacaatacaaatatgccggttattcagtgagtaatgtggtatgtatgcccaagacaaacttattccatatcgaaccccgtgaagatacgcctaaaggtctactccattctagtaaggacctcatggaaaggcaaccagcttgggtccacaatatgctcaagaactatcagcattaaatgcccgagctgtcaagtccgaacctaggacaactcaaatatattgacctcaacacccgcgatggagcattgcatagactattatcccaanggagatatcggaaaaaatgaagatcatgtgagaacccaaatctgangatgttactctccatatggaaanattaaagaatacctgtgagangganccttgccaagtcaccgtcanccaatctgcaaatgtttcatcaggagatggnnatttcttataatcacgnaangaaccaaactttggacactggtccaagtgtgaacagcnagataatcggaatctgangagtagatcattataacagntnggcaccacgtttnccanaggatcaatttaagnaccagctanaaaacctatcngganttg

SEQ ID NO: 94558 - DNA, 591 bp, Triticum aestivum
  unsure (1)..(591): unsure at all n locations
  Clone ID: PAT_TA_94558
ggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaattcgccgancgagaattcgtccacaaagcacaccaagccgggatcctctccatggccaacgngggcccaacaccaacggtcccattcttcatctgcaccgtcccctgcaatttggtccgacggcaanacgtggcttcggcgaagtcgtcnaanggatggacgcctcaaagacaccnagaaggtgggtcccgcaangggactggtccaagaagctcacgccgatgcggcagtctaattcgtcngccgcggtcgcttcgcntnccccgttccgttntcgtttaaataaaatctgttcttcttctcccttgcctcgatantccgtggtggttagaggttagtgatcttggcgtgattttcgggcatgtactctggncgtcactangttataatnacncnatatncaanttgtaaaanaaaaaaaaa

SEQ ID NO: 94559 - DNA, 511 bp, Triticum aestivum
  unsure (1)..(511): unsure at all n locations
  Clone ID: PAT_TA_94559
gcagtcgctgccgtgtttgctcgccgacgacacctccgaccaccctgtgtgttcgntggagtcatggnccttttcctccactaacaagcagctagcgatgtggctagtancgatgcatccatccgtgaggtcttgggttcaagcccagctcttcctccctttttcatttttgttgttgttgtttcagttantccacatgcacactcacccttgccgcatcagcaagtttcgctgctcgttgcgtccagccacggccacagagcaagcatctctgttaacgttttcanttccgtcagatnaacgccatnacatantcatattgagcataaggattccttaagcaaantctatcttanccatctggnttacagccatgcatgtactcganggggngcccggtaccaattcncctatatgancngattagcgcgtaatggcgccgtttanacgtcgagntgggaaacctggngttaccaacttaatcgctgcaaanatccccttcgcagcggat

SEQ ID NO: 94560 - DNA, 572 bp, Triticum aestivum
  unsure (1)..(572): unsure at all n locations
  Clone ID: PAT_TA_94560
caccgttctccagtcgatcacgcacgctctcctcgccgccgagatgttcgggttcgggcaccaccacaaggaccaggcgccgccggcgtcgggccccaaccagatcttcaagatctactgccgcgcctccgaggactactgcctcgccgtccgcgacggngaggtggtgctcgcccccgtcanccccaaggacnagacccagcactggctcanggacatgcgcttcagcaccaccgtcaaggacgaggagggcatgcccggcttcacgctcgtcaacaaagccancggctcgccgtcaagcatccatcggccagtcccaccccgtnnaagctggtgccgttcaaccggngtagangacgcntccntgctgtggacgcnacaaggaatgggcaaggcttccgctgcatcanatggtcancacaccgctcgggttngaccctcaaggnnacatgacacggcgntgaacgacggacacgtntgtctggaatggtgaagggganacatgntgnanttggcctggccnaggganctctcaatcgggcnaaaggaanacccangcanggnggggccct

SEQ ID NO: 94561 - DNA, 639 bp, Triticum aestivum
  unsure (1)..(639): unsure at all n locations
  Clone ID: PAT_TA_94561
tttgtaactaggccacaatgactatggcaacacacatacttttgtaaccatgggcctcctacgggccgtaggatccatgggccttctacaagccgtaggatccatgggccttctacgggccgtaggatccatgggcctcctacgggccgcatcatcatttcgccaaacatgtttggtactattcatggaccataatgggccgttaataggccgtatttgatgacgctatgaaaacagtccaacgggttaacgggccgactatatccacgggctgaattggcccacaaacggaacagaccggtaatggactgtaactaaccgaatctanaaatgagccaagaataaatggggccttaagagggccgaaagntaacacgggctgggaaacggccgaaggaataatgggcgttaatggggtataaagtgatacacgtcattatgggcaatttaactcggtcttaaagggcctagagtacaaaaggctcctatgggcgaaagactcatggtcatacatgggcggaattacatggctggaacatatggcaaccagatacatacgggcaaatcggaggcncacggcgtagtaggncgtaatggtaatcaanagcgtanaggttcaaggcggcgcacttgcatnaa

SEQ ID NO: 94562 - DNA, 603 bp, Triticum aestivum
  unsure (1)..(603): unsure at all n locations
  Clone ID: PAT_TA_94562
gtaacaggagataggggacgcgatgttttacctaggttcgggccctcttaatggatgtaataccctatgtcctgcttgattgactttgatgagtatatgggttacaagagttgatctaccacgagatcgtaatggctaaaccctaattgtctancctgtatgattatgattgtgattgctctaaggactaaaggctccggtttatatagacgccggagggggctaggtttgtacaaagtcggtttacagagaaaggaatactcatatccgcacgccaagcttgccatccacgcaaaggagatcccatccagacatggcggaaanctctatcntgtanctcacggccattatccaaccacgttgcatanctggacgcccgangacccgtatccaagatcctcaaataccccaaacatctcaatgatgatgtgtccggcntgcaaatgtctccgnatngaacggttctctcnaaagttccaaacacngaacaaaggatgtatcggtnnaatctcgtctcgggttcataaagtaaacntanctcgtgcaaccattgagtccagttaangatacaggtcaacatttanaaaaccggcgttagaggtn

SEQ ID NO: 94563 - DNA, 248 bp, Triticum aestivum
  unsure (1)..(248): unsure at all n locations
  Clone ID: PAT_TA_94563
ggaaaagtagggacagggaggaaggtanaagggtccanagnttcttcacagngctcctcttctgctaatcaacactagnccactncgntacctctgtcctcacagctggcacncnaattaatctngtntcagntgctggttatgcaantaatcntttngaatntatcaaccttgacgttgacaacgcacatgatttcttcactgtcaaccagctggaacaccttagtcctgggttcganctctcnttn

SEQ ID NO: 94564 - DNA, 349 bp, Triticum aestivum
  unsure (1)..(349): unsure at all n locations
  Clone ID: PAT_TA_94564
atcgagtccagccttgcaaacgccagcccctccgcatgtgggaattcaacctggaaggaccgcgcactattcagaatttccttggcctgacacatgaggagatgtacaaatcgttcttcggaccccaaatagagtgtccggacactaccgaggatgtgggcctgagcagcaaccgcaccgcggcccaagtaggtaatcccatggccgaacacactgtccttttttttatcatgacatcattctgaagaatcgctctttgaccaggactgggataacaaaggcgaagatgatccggtgttcggccccccttcctgaaggcttgggacaatccgggtgctgggaaaanatg

SEQ ID NO: 94565 - DNA, 383 bp, Triticum aestivum
  unsure (1)..(383): unsure at all n locations
  Clone ID: PAT_TA_94565
tgcaagtgcggcaacggctgcggcggctgcaacatgtacccggaggtcgaggccgccggcgccaccctcctcgtctccgccactgccacccacaaggcgagctccggcgggatggagatggcggcgggagaacggcggctgcggctgcacccagtgcaagtgcggcaccagctgcggctgctcctgctgcagctgctagatcatttgatcatgcatgcgccgccgtgcatcatatctatgatctatctaccatctactaccatgtaacctgctgattcaagggctttggatgtangtaccaacctgcctgcaataanaaanngggtgccaatgcaagcatttnaccccctnaaaaaatccccgnggtttttggcttaaaaaaa

SEQ ID NO: 94566 - DNA, 271 bp, Triticum aestivum
  unsure (1)..(271): unsure at all n locations
  Clone ID: PAT_TA_94566
cccttcccaagctaggatacctcaagtgttcnatcttctccananntgaatacccangaggacacncagactgttctaagcacattacccaaggaccnacctctagacttcttgaggacnatcacagatcaagttctcagngagccgtgntntcagtaaaggtgcatttnnacaggttaaacggantaccntatgcctggatgnggnaaacgattggctgtgaagaactttgcngaaatgcgccgntcgnacgcgacaaaatatttattac

SEQ ID NO: 94567 - DNA, 517 bp, Triticum aestivum
  unsure (1)..(517): unsure at all n locations
  Clone ID: PAT_TA_94567
ctgcccctcgccgtcgccccgctgacctcaaccagccgccggcgaaatggcccctaagcgaggcggcaaggcgccggtcccggcgaagaagaaaacggagaaggtgaccaacccgctgttcgagaagaggacgaagcaattccggcatcggtggcgccctcccgcccaaagaaggacctccaccgcttccgttaagtggccaaggttngtgcgcatccaagcgccaagcgccgcatcctcaaagcagcgcctcnaaggtgcccccggactccaccattnaacccgcacccttcgacaagactttgcaacaatttttcaantcttccttaaataccggccnnaaaaaaanttccaaagaagganagttcnaaaagagcccaagcttaactnnaaggnaaacngttttaggcnaanancaatatttnaantangctttaacaanttcctaactaaccnncaaatnaccaactggttgcaaaccaagagttntcccattgactgttnggngccctgcctt

SEQ ID NO: 94568 - DNA, 611 bp, Triticum aestivum
  unsure (1)..(611): unsure at all n locations
  Clone ID: PAT_TA_94568
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggccattngagggcatcaaagaantccgagccctggtcctacttgccaccgctcaagcacggagcctcctccaagcagtcgactacctgattccgtccaagtggntgctttcctccnagttcaacaaggttgggttcaccttcccgtngagacaacgatcccctggggtactatgatggccggtactgggcaatgtggaantgcctatgtttccgggtgcaccgacncacacaagnattaacnaggtggaggagnccaagaaganaccctgaccctatntccgatcatccgtttnnaaaatcgccaagtgattcgtnaattnatcgctttnaancacggntgnaagatccggnaaggctaaaaataancagacagcatattaatgcatngagtttgtaacctganatgcttgggttccttccaata

SEQ ID NO: 94569 - DNA, 635 bp, Triticum aestivum
  unsure (1)..(635): unsure at all n locations
  Clone ID: PAT_TA_94569
aaccctaaccaccgatccccttcctctccgccgggacctgccgcccgattcctccgcccgccatggactcgccggtgctaccaaccagcgaccgcgggacgcacctctcgctcctagcggacgagatcctggaggagatcttcctccgcctgcccaccccggaaggcgctccgcgtgcgcgtccgccgcctgcgccaccttccgccgcgtcatcaccgaccgcccttcctcccgccgctttccgcaagtccaccgctcncctccttcggctcatcaaacgacaggggcgggcggttccacccgcccnaagcgccgnaccctccgctaagctcgcccgcgcctccttcgacgccgccanttaactatccttttntgccnaagccaaggagggtggtcagcccttggatcccgccacttccgcaaggcgcttctcccttnatgcaagncccggggaaaactttaatcgctcncgtntntgancttttccgggctaatnctggttgcacngtaccnaggacanatnacgccaagaaggaacctgcnaatngggcaatctcgccggtcgtgacataggtaaantcnttaggtntatgatgggncaanacangtttccttgcttcctcttancgaanggt

SEQ ID NO: 94570 - DNA, 627 bp, Triticum aestivum
  unsure (1)..(627): unsure at all n locations
  Clone ID: PAT_TA_94570
gtcgcttcgatgactccttcagcttggcctctttcaaggcctacatcgctgagttcatctccaccctcatcttcgtcttcgccggcgtcggctctgccatcgcctacactaaggtgagcggcggcgcgccccttgacccatccgggctgattgccgtggcgatatgccacgggttccgggctgttccgtccgcggtccgccatccggcgccaacatctcccggcggcacgtgaaccctgccgtcaccttccggctcgccctccggcggccagatttaccatcctcaaccggatcttccaattgggttgcccactcctccggtgcatcctcgggcttcctcctccattntggaacggcgttgggacccctaacacggttttccgcgttggcgctttttaggctcctgaggaattaccncactttggtctctaacgtgtaccnacngcgcnacccaagaagtccttgggacangccccatcgcacggtnactcgggcaaanctcntgccggccttntcgggggtcaataacctgaanctcctnggccncgttcaangggantnacaaatcggnttacggccggcnnnaacggggggctcccgggtctcnacgtacttaatttnananaa

SEQ ID NO: 94571 - DNA, 634 bp, Triticum aestivum
  unsure (1)..(634): unsure at all n locations
  Clone ID: PAT_TA_94571
gcgactcataggcagtggcttggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaacagcggatgattgtggttaggggtgaaatgccactccgaacccaagagctactgggtctcccccgaaatgcgttggaggcgcagcattngactgggcatctaggggtaaagactgtttcccggtgccgggtgcgccagcgggtaccaaatcccaggaaactccctgaatactaaatatgaccccaaaataacangggccaagnccngcaattnaacgatgggggataacttcaaccgtccnagangaaacaccngtttacaacttaggccctaaatgaccgtcaatnataaagagttggggtcaaagcaccaagagttgcctaaaacaccaccttaaagatgcgtataccatgatcaacgcctgcctaaatnacgggtaacatngccaactttgatncaatcancgtaggacgtcccctaagacacccaaccgggtcacaacgaacaaanttgttta

SEQ ID NO: 94572 - DNA, 644 bp, Triticum aestivum
  unsure (1)..(644): unsure at all n locations
  Clone ID: PAT_TA_94572
gtggaccggactagacattttggtacctggtggccaaaaccaagttgttcaagatataggtttgagtaatttaaatgagctagttatccatggatttttcagagaagaggaaactaatgatggtctgcattatgttatgcatgacctattgcatgatttgtgcattgaaggttgcatcacatgattgtcttaagttacatctctctgatgttgggcaagtaagatattcagccatccacccatcacttgtatgtacgcacaagagaactgggtgaatataatgcagtgtcttcctcaaaacattaagagtgaatgggaaagttngaagacatcatttgaaggttgaacattttcaaacattggatgttatttgggnaaaatgggtaaaggttttgcccaagnatttggngtttttttgggggaacaagccctccctgtccttatttccctgacatgactaccccgttgatccagttacanactttccagnctgtccactacgncccnagtctacggacaaaggatggcaaatcattacactnacacctaaattacactaaggtcagattaanngggnaggantggatttccgagaatacaacttcaaatggcatatanccaggataggntcatccaataaaggg

SEQ ID NO: 94573 - DNA, 269 bp, Triticum aestivum
  unsure (1)..(269): unsure at all n locations
  Clone ID: PAT_TA_94573
tacacgcttccaagctatacctcactattgatatatgaagctcaaaattcctggaccaaacggtataatcactctcgtcagtgatccagacatagcactccgcgctgaaaacaaaactgcatccctgggccttggaggcgctatccgaagcctcgccgccgggagaataacccgcactacgctccacagtggacagggacgatgtnctccnaagggggggggccgggtacccaattccgccctatagtganccgtatacgccncgctcn

SEQ ID NO: 94574 - DNA, 381 bp, Triticum aestivum
  unsure (1)..(381): unsure at all n locations
  Clone ID: PAT_TA_94574
aaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggttgcctagaagcagccaccctttaaagagtgcgtaatactcactgatttgagcnccttngcgctgaaagatgaacggggctaagcgattntgcccgaagctgtntggattttccaaaatgcatcccgtaagggagcttccccctttaanaagggaagcaaccccgnaagcngggtccgacnaaancggagcgagatgtccgcttntagtaannaaacatttgggganatccatcccc

SEQ ID NO: 94575 - DNA, 623 bp, Triticum aestivum
  unsure (1)..(623): unsure at all n locations
  Clone ID: PAT_TA_94575
ggcatgaccgtgtctctactcgtgctaggcttgtctcttcgagcgtcgccgacggcacacgcgggcgggagcgccgcgtggtgggccgccgcaacgagcgtgacggccgccgcagcgttcatggcgaccttctcgctggggttcgggccagtaatttggatgtacgggtcagagatcctgccgctcccggctacgcgcgcagggcactgggcatccggcacggcggttaacccgggttgatgangccgtntgtgggaatgaccttccatatcgctgttacgagctgttgggatggcggaactttctacatcttcngcggggtgcgcagcagctcctgggtttccgtcctacgcatccctgccgggaaccaaggggaagacctcccaaggaatngagtctcttccnacattcccncaatccgcannncccgacaccagtgatccataatttgcgatgcancaaaccccgccgcgcgggaaattgttatcttaccggnaaanatgtcccgttgtgttggccnataaacaatttgtggaattanagcaacggatccaatgacagctaaatanatgtatctaaggcncggcattcactaattcattnccaaaatattanncaanggg

SEQ ID NO: 94576 - DNA, 551 bp, Triticum aestivum
  unsure (1)..(551): unsure at all n locations
  Clone ID: PAT_TA_94576
gcctacgaaagatcgtaatcccgggagaaggaaaagtcacgaccatgggctcaatttttcgacaacgaacaaaagagggaagaagatcagtctgaagcatcgtcgtcgcccatgctgacaaactaatccacaatttttgtgtgtttttattttgtataccgccgtttgcggttgaatgatgtaatatatattatactaattattatccggagggtaacagtggtattgctccaacgacataccaaattaaaggaaggaaagtgcaaaagaaagataagaaaaagaaaagtgcaaatgaaagaaaaagaaaaagaaaaagaaagggantttacaaaatgaaatgaaagaaaaagaaaaagaactaataatttgtgggaaaatgaaatgaaagaaaaataaaaagagaaagaaagaatttgtggnatatgaaaaggaaaaataanaagannaagaaaaaagaaaaagaaaantaccagtacgtgtttagctgggcagcctatactaacttactatacgcttctccaagaccgctatactagagaaagaaaata

SEQ ID NO: 94577 - DNA, 630 bp, Triticum aestivum
  unsure (1)..(630): unsure at all n locations
  Clone ID: PAT_TA_94577
cctgaacattctttctttctctgaaaaatttctgaaatttttagtgactcgaaataaaagtgaaacaaactcaacaagattgatagcaactactcccacaagtgcctatgaggctatatcatgcattaaaactacttttgaccatataaatttgacatgtaagctcaagaacagggtcacctaagcagcaaaaatttgcaataaataaagcactagaacaaaaactaatggaccagtggaggggcacatacccaagaacaatatccccaaacattttgtgaatgggacttttgagcaaggaattctaaaatggcagcaagatgagctagacacgggttttagctatggggatttttcccgggaggaaacaaatnaatggggtgctgagnntgaggngggggtccacgttgggtccaacgaagcaagggtnccccctaagggcnttngcgccccttacctcntggcaaatgtggncccctggtgttctcacggcaagtatcctaaatatctacaanaatcatcatanttgagacattggggaantttatttcggtantttttatncaggtaattagaacagcanaaatanaatttgcttattaccatacagaataaagggggtcaggattt

SEQ ID NO: 94578 - DNA, 273 bp, Triticum aestivum
  unsure (1)..(273): unsure at all n locations
  Clone ID: PAT_TA_94578
ttgggacanngcancgggtcttcnncattttcnccctttcccantccccccnaccatgtcttcngcgacgnagcataagcacgccatngtgntgcgccntngtattgggcataccggttnagtgcgcgaggggaccccgcactcncgcgccatctcctgcgtgcacttctccttcngcaggcgcctcttancaacggaatcactctatcgtacggncacccatcactctctcacgncctcgctcaccagtcatctgcaacnatnatatgccac

SEQ ID NO: 94579 - DNA, 436 bp, Triticum aestivum
  unsure (1)..(436): unsure at all n locations
  Clone ID: PAT_TA_94579
atcgctcgctcgccaagatccaaggcagccgcnacggctggganactgggaggacgcncgcgggaggagatccaaggangccgaggaaggccccngcggcgccactggcctacaagcccgtggncggtgacnataacatagagggcgtcnccagctcnagacaccccgctcgccttacccgagggcgaccagtacgannaggtggngntnggggaggactaggccatngccancgcacangacaagtggncgcaanatgacangccacccnccatgagtgatttngnttggcgatcgcgctactccttggttaaactgcacttnttgctgcgcttgngtacattccccnatcanctacaaaccctcancttcgcttatgcccaananttaaccatatttcgggatntggggctcaactaattggtgacacacagat

SEQ ID NO: 94580 - DNA, 264 bp, Triticum aestivum
  unsure (1)..(264): unsure at all n locations
  Clone ID: PAT_TA_94580
tgaggagcaagtgatagataacgcagcanancgatagaacgacncangctggcatagcaatgatagtaatganatccaaggtgacggtcatcttgcctgaaatcccgctaggaagaagaacgagtccatgaagaagatgaagccaggnagacgaacgaatcctcacgatcgcnatgacacggnaactatctaagaacaagcgnacancacggtaaacacnccacacatgancaacgcatnatgctcatcncaagaatgatgcat

SEQ ID NO: 94581 - DNA, 634 bp, Triticum aestivum
  unsure (1)..(634): unsure at all n locations
  Clone ID: PAT_TA_94581
tgaatttcgtcctctttatatgaaatccgttgtgtttgcattaattccgtccggttagttcaaacagtggttgaaatgtatgcgggttctgttggatggacagctcccgcatcagtatccttggacggtctcctctgttcgtggacagatgccggagcaaatttgtcggttagcacctggagatgccctcatcgctcgagccatgccacatggcaggctgttcaaatataggaaacctattacaatccaataactatccttaattagatacaacactttgcgacattgcaagatacgccttaaattaagatatacagttgtancatcaaacatcaaganccgcntgccggtgctgggtgctgaaccattcaaanataatcgattcgntgggaataatggatactgcgtgcccngtcccggtacaatccctaacactanactcaactactccaaggaaggtcaattgttaacaaaanntaattgcggtncatggttacaagaacacaatgctnacttnacaacggtcgcgccgtcgaaatcccggaatacacgganctcacccggcgtcggaanatacagccagnttgcaaattaaaacgaataatnttanacacaaattctatattatagacna

SEQ ID NO: 94582 - DNA, 603 bp, Triticum aestivum
  unsure (1)..(603): unsure at all n locations
  Clone ID: PAT_TA_94582
gcgagccgttagattcatcaaacttcacatctaccgtgtcttcaacctttcgggtgaaattgttgtagacacagtaagtgtgagagtttgagccataaccgagtaggaaaccctcatgagatttaggaggaaattgaacgacgatgcttatcaagaatatagcactttgagccgagcactccgaaagtatccaacttgggggttgttaccggtgangaactccgtatgccgtcttgcccgagtacttgtgaagatatagacgatttgttgcatgacaagtgtctcaaccgcttccgcccaaaagtgtttggcgccttgtaccatcaaacatcgtctcgccacctcaataagantcngtcttcctctcaacaatccattttgttgaggcgtgtacttagccgaacccgttgnacccttcttcaacaaagaaagtaccaattngcttcttgaanccctccttgtcgctgcgaactccttactcaatcaatggatttgggctccantgaaatctgaagaattggccgcgattacacaagaaggacacactaatctgaaaacatcacntncagncaatagttcacagctttaagggtgncaaaaatn

SEQ ID NO: 94583 - DNA, 599 bp, Triticum aestivum
  unsure (1)..(599): unsure at all n locations
  Clone ID: PAT_TA_94583
attgacataaatgtagacgggcaccttgctcttgccggatgcagcaactgaacacggatcgggaaggacgagtgaaccagaaaggtaaaacggacgccgataactcccgaccgttcggtctgggagcaccccgtaccgaacgtttccgttccggaacaggatgggcatccgttcgaattctcaattccggaaggagaacgtccacctgaatccccacgcaccaaggactggctgttcctccgagcaancccaaatggaggggtccacagtgacgacccgttgatacactcccggagcaaaagcaagaccggtgcacctngaaaacagaaccggagcactgcacgcatcgacttctccataaccgngtctcccnaacacgttncgacacgtacaccaacttngccataataccccctctttcaattcccgcgctccanacttcnacactngcccccnatcacanccaaatcngccgccnangccgaccggaaaccnagcacaacggtcccgcgacanctcncgtagatttgtgggccaacgaacncagctntcatcccacgatcccccctgtccgagggntncatnagaggnccatttca

SEQ ID NO: 94584 - DNA, 547 bp, Triticum aestivum
  unsure (1)..(547): unsure at all n locations
  Clone ID: PAT_TA_94584
gtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggccttctccgggggtccgacgtctgcgacgacgcccaccccaagtgtcccaagggctgctccggcgtgccgcgtggtgtccgacganccccgaaatgtggcgcttgcgccggattatgaaaccaccgttcgacggcaccttgcggtggccctgcaagaantactgattcggttcatgcccggcatatgatatgttcccgcctaaaatttaaataaaactccggacgaatgacaggtcatcctgcctagcgtgtgtgtgtgaccaacaatatgtntaccatagtcctgtcttcctcctgtgttttcncccnccnaaaaaatttgtgttcttgttgttcaactacccggatacctccctgaataacactgtatgattgtgcngggtgcaaaaaaaaaaaa

SEQ ID NO: 94585 - DNA, 452 bp, Triticum aestivum
  unsure (1)..(452): unsure at all n locations
  Clone ID: PAT_TA_94585
tgccattcaagcccatggtggtgggattctgtatgatcagaataccgcgacatattattggtacggagagaacaaagatgggccaacctatcaaattcaccctgaaggggcacaacggatagacattataggggtaagctgctactcctccgaaaggacctatggtcatggactccacgaaaggaacctgcttccctgggagagccgttactaatatcacacacgaccttccatatacaaaaggtcttngaagaggctaaaggtgatatataacgaccgtactcccgcattattcatgtnngatcacgtccnacgacggaactacactaaacatccttccgcgttgcgtcacaatttccccaaaagcctttnaactactccacatttcccngcacatggtttttatagcangacatacattttcnaagacnacgacgnatggctcncttcta

SEQ ID NO: 94586 - DNA, 461 bp, Triticum aestivum
  unsure (1)..(461): unsure at all n locations
  Clone ID: PAT_TA_94586
cattaaattattgatggtggtgcttccatgtgccaataaaagataatatgctgcttaattagaattgaaagaaattgtgggcgcatgccaataaaagagaatatattggngtgaccttaattaatgagtgccacgttgaactagagaatacggacatgcangggtttgatccatccttatattgagctagaggcatgtganttactaccccgttgcaacgccacgggatgttgtgttagaatccctaatacganttgtgcccnatgacaccttagcccacttcaccttttttgacccanccaaacatgaccccngttgacctggctaccccgcagttgacccatccaactggccccccacccnacctaccaccnacnggtggtaccccatatgggtataaaaagtaatcccgnattnattcccatttaaatattccaaaatcccanaagttttaactttta

SEQ ID NO: 94587 - DNA, 633 bp, Triticum aestivum
  unsure (1)..(633): unsure at all n locations
  Clone ID: PAT_TA_94587
ctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctgggaggttgatcctcaagacaccattgacaatgtggaaggcaagatccaggacaaggagggacccccccggaccagcacgcctgatctttgccggcaagcactccgaggatggccgcacccttgccgatttacacatccaagaagatccacctccactttngtgctcaagtcccttngtggatgcaatatttggtgaaacctccaccgggcaaacatcacctggagtggatccatctgacacatcgacaactntaagcgaaattccaagacaaggagntttcccccngacaacacgctcactttnccnggtaacactttaggatngccactntggcggctacaactcannagganaacctcactgggctcgtctcgtgnggcaataactctgcaangactctttgnccggtnaaagtcnctctcggtctaagatcggncaagtcgtctncnaaggncttttcaactcaganatgtaccttncgacnn

SEQ ID NO: 94588 - DNA, 649 bp, Triticum aestivum
  unsure (1)..(649): unsure at all n locations
  Clone ID: PAT_TA_94588
cccagacccggccgctcctcgccgccatggcgcctcgcgtgccctcctccctcctcctcgtcggcgccgcgctgctcctgggcctggcggccggcgcggcgcgggcgtccaacgaaggagggggaacgcgctgtacgcgctgcggatgcggctgtcggaccccaacggcgtgctccagagctgggatcccaccctccgtcaacccctgcacctggttccacgtcacctgcgacaccgccagcgcgtccgtgcgcctgggattaagcaactcccaacgtctcccggtccatccggccccgantcaancgctttgtgaacttcaattacctggagtgtncaagaacaacctcaaacggcgagatttccaaaagattngggcaagttgaaattttgtnnacttgggttntgtatgccaataantcaacgggagatcccnatcgcttttcnaantcaactcnctgaatcaagcctttggacaacaacaatngcngtttattcaaagggactnggcaaanctccaactttaatcattgatngtcaaaaatactatttggacatctgtnatggcaatccagcttctctanaantcaganaaagaaatgaaggccgantnaaggttgnttcananttgtcaaagctatgaaaatna

SEQ ID NO: 94589 - DNA, 434 bp, Triticum aestivum
  unsure (1)..(434): unsure at all n locations
  Clone ID: PAT_TA_94589
tgaagaatgggtgccctttggttggcatttctgatataacttgtgacattggaggttccatagaatttgtgaacagaagtacatcaatagagaggcctttcttccggtatgatacttcgactaatttgtaccatgatgatatggaaggcgatggtgtgatctgcttagctgttgacattctgcctacagagttttccaagagaggcctcccagcattttgggagacatattatctagatttgttaccagcttggcctcaagctaagggactgctggagcttccttcccacttggagaagactttgcatcgcatatgctgggcaaactcacccctcctgtatgaagtatatcccccnggatggagaaagactatgatagaatgncaccaactcccaagcgaatcatngcccggataagaatacaccaccctggta

SEQ ID NO: 94590 - DNA, 292 bp, Triticum aestivum
  unsure (1)..(292): unsure at all n locations
  Clone ID: PAT_TA_94590
acttccagttcgagttcgtggccaacggcaccgacgcatactacacgttcctggtagacgacggcggcggcggcggcaacgtggtctcgaggttcgtgctgaaccagtcgagcctgcagcgctacgtgtggctgcagcagcagcangcgtggagcctctactggtcgctgccccgggacccgtgcgacggctacgcncantgcggcgcctacggcgtctgcgacgccagcgcctctccgatgtgctgctgccccgccgggttcacgccggnctcgncgcnggagtgggcgct

SEQ ID NO: 94591 - DNA, 631 bp, Triticum aestivum
  unsure (1)..(631): unsure at all n locations
  Clone ID: PAT_TA_94591
gcctcctccaccacactcgccgcgcgcctacctccccccttcccgccgccgtggaaggagaccggcggctggctcccaccgcttccgcgagggttcggaggcagtaggctcggctgctgccatgctctcaaggatctctcactccggggcgcggctcctgcgcgagaccaagagctgcaggaaactttgtcaagcaatagcagcaattactaccgaggtcaagtcaagccggcattcaacccagcgaaanatcctcttctccaccgcaacaattatcatcatgatgaagcggttnaggacaaggagaatctcctgttacatttttcaaacaaggatggtactgagaagaataatttcctgtccgatgtccatgtttagaactgctccacnaaaatgacatagacttntaagacatntnangtcctccctgttccactntcaattcaaaattatggttaagttngggggcccngtacccattgcccaatatgatcntatangcncctcantggcgtcgtttaaaantctgaatggaaaacctgggtaacaantaacgcctgagaaanccccttccactgggtataacaaaggccnacgttccttcaaattncactaagnaatgaannccttt

SEQ ID NO: 94592 - DNA, 624 bp, Triticum aestivum
  unsure (1)..(624): unsure at all n locations
  Clone ID: PAT_TA_94592
aggatctgttgggtttattattgtgtgaactgacggcggtttacatggatgttggtggaggtgcagctgcaggggaggcgattaagcagtcgccgtcgatgccgacgaccccgaccacgccggtgacgccgtcgtcgtccacgccgccgcgcggcggcagcgtgtggcggagcttttccacccccggggancaacctgggcaccaaagacctccggcgccaactcttccgaccgcccgcanccaatcccccaccgtcctacgactgggtacttacgctactcatgattctatatatcctcaacggtacaaatcacttttttatacacattctactgggaacttttnaacgggttaacatggcaaatgataaaacctgccacttcgttttatntncaagcttttacaangaccagacnaggacaagacaaccaccgctnattaaccntcngcaaagactgaaggaaggtnccaacaactgttcnagccccngttgcnctcttggtntcaacctctacntacttctgtcaaggtgattggttgccnacttctanacgtcacatgctgtacttatttctgncgagcccgatcacattagggnattttccgtacccagttaatccccn

SEQ ID NO: 94593 - DNA, 550 bp, Triticum aestivum
  unsure (1)..(550): unsure at all n locations
  Clone ID: PAT_TA_94593
tgcagatcttcgtcaagaccctcacggggaagaccatcaccctcgaggttgagagcagcgataccatcgacaatgtcaaggccaagatccaggacaaggaggggatcccgccggaccagcagcggctgatcttccgccggaaagcattggaggacggcccgcacccttgccgactacaacatccagaaggatccacctccatctctcctcaagtccgttngaggcatcatcacctcctttgcagtccttcccgcaagtcaaccaagagaagattattctgccgcaaatctacccgctgcatccaaggctgtcaactgccgccaagagatnttggccacanaaccaactnaggccaagaagaaatttaagactaaatgctgctatcatttcaatggccggtttatccacactgtgtcaaanttaatctataacctcccgttgtccttgacttatttacttgcttcaactcctaacnttgtggtgatgataatgacaatatggtatatggtacaaactatanttgcgtacccccngtttgattgctttcggt

SEQ ID NO: 94594 - DNA, 295 bp, Triticum aestivum
  unsure (1)..(295): unsure at all n locations
  Clone ID: PAT_TA_94594
tcgggttcgggttctggttcggttcgggtccgagagtagctagcctagtctanggtttccgagaagaaggaaggaggagaagnaaaagaagaagaatcaatggcnggagaacgnagtaccgctgcttcgtngggcggcctcgccctgggccaccggacgacaacaacctccaagcaaggccttcaagccaagtacggcgaagatcctcgnacgccaagatnaatcaaacgaccgcnagacggggaaggtcccgcgggttccggcttccgtcacgttcggcagcgangatccacaa

SEQ ID NO: 94595 - DNA, 418 bp, Triticum aestivum
  unsure (1)..(418): unsure at all n locations
  Clone ID: PAT_TA_94595
gcgagggtccctgggtgtgctgtatggcctgcctatgggatgcgggcgattctcgtggncgggatccanatcgggggaaacccgggtcggctccgtccggccgcgacnacaacgacgcccgcgggcgcgatttcttnatggagacgtctgtcaaggtctgcccttctactccccaccacctacttctcgggtgaaaacctaatcccggtgggcggcggcggcgtctttggcgccgcgaccttccttgaagggccccttnaanggctgggttgntggcggcgctgttttgggggccggtgacactgccgacggcttcccttcctncgccnaacctccgctttccctccngaccatnctgtnccccctggggctcctttttggataaatgttgnntggaagatgntgnaccgncccaacc

SEQ ID NO: 94596 - DNA, 498 bp, Triticum aestivum
  unsure (1)..(498): unsure at all n locations
  Clone ID: PAT_TA_94596
ctcgaccaaagccgtgacactcctcccccacctcgtcccaaaccctagccacccccgccgatcccaatggccgccgcccaccaccggcccctccacgccctcctcggcggcggcgcagtcgccgacctgctcctctggaggcggaggaacgcctccggcggcggccgtcgcgggcgccacgctccgtctggtcctcttccgagcgcgccgggtacanctcgcgtcgncctctcnaacgcctctcctcctcgtctcacctcttctttctgggcaaattccgctcgctgtcaanaactctttnaacactgcctaatcnanagcctnaatgggtcnttgaaaaattntaggccggtcnttntnggganaanaagtnttgctnttgcncanaaattgcaccaagaaaacggaatttttntaaagttaaagggncaagggggtncatttntggaagcctnattntttaggccaataatgggngnaaacccccngttgttccgg

SEQ ID NO: 94597 - DNA, 520 bp, Triticum aestivum
  unsure (1)..(520): unsure at all n locations
  Clone ID: PAT_TA_94597
cctcctcctcctcaacagatcattcttctgtctagtaatatttgttggctctctgtctccatggagaaggggtacggtggcggcgctgaagaagggaaggcgaagcagagcaagccgccggcgaaggcgcggcggcgtcatgaagcgcatcgcgaactcctctgcttttgcggtgctcccgcggaagttagaaagagttacaaggtgcacggtgctccggcgtcaatgaacaactatgttataacggccgctatttcggttactgnncatgtgtggcttcctttctctccctacttttttgtgcantggtgttttnccaaaatagtagataanccnggttcnactactactactactactggttgtatggttcttacgttttggaantangttgttcctgtcacacgtcaacatgtatccccgcacattggtaatgtatatttggcacctttcctaacaaaaaaaannnaaaaaaaaacccagggggggccggtaccaattcccctanangagtctatta

SEQ ID NO: 94598 - DNA, 547 bp, Triticum aestivum
  unsure (1)..(547): unsure at all n locations
  Clone ID: PAT_TA_94598
gaaatccgccaatccacatgtggtgtgtgaacaaggaaagttgtgtaccatagtcagtagctaggtatggatagggaggcatagaatacatatgatgagctacaacaatggttgtagagcctagcatagctaggttaagagataattngacatgccatgacgtttgttaaagattccataaagaccttatggcttttcctgtaaattgggcctttgttagctcccaaaatacctttaancccaatggccaataccccaattggccctatacattattacctggcgatttangaaaaagaataccataacttaatgatngtgcgcatatcggtcaacccaaaacaccgttactggttttagccncccccnaaaantcaaaattctgcgtatttngnccattttaantnaaaaagggttntccttcggnaaactagntaaattttaccaaaagcccctttcaaanaatcctnagnatgggacccttaggtcaaccaantcnaaaattggtaatggaaaannaataattgtgccnccaaaaagaaccatc

SEQ ID NO: 94599 - DNA, 546 bp, Triticum aestivum
  unsure (1)..(546): unsure at all n locations
  Clone ID: PAT_TA_94599
ccgatccccaccgaagaatctccgacagatcgaagccaaggctttctcgtcctcctccccaagatgcagatctttgtgaagaccctcaccggcaagaccatcacccttgaggtcgaagtcatcgggacaccatcgacaacgtcaaggcgaaagatccaaggacaaggagggcatccccccgggaccaagcagcgcctcatctttgctgggaaagcantccaaggatggtcctacctttgctggactacaacatccaagaagganccaccctccaactgggtgtcccgcctttcgcngtgggatgcagntcttcngtgnaaaacctggacnggnaagacanccaccttgagtgggancctccnggcacaatcnacacttcaaggcaaattccaagacaaggagnatccccccgnccaagaacctcacctttnccnggaanactttaggatgggcgatctggnanctanaaatcanaaggncacctcactgggtcccctccngnggaacaatttcngaaacctgagggaaaacacanttgggggggtc

SEQ ID NO: 94600 - DNA, 526 bp, Triticum aestivum
  unsure (1)..(526): unsure at all n locations
  Clone ID: PAT_TA_94600
cttctacctccggatccgccacctccactacgttttccacctcgtaaacatttctcccgtctgccggccggaacgggaggacctcgccgtggtttcgccgcagaacaagttgattcgatcgacgacaagtcgctgtctttgccaacttggttacagagaatttccaccgcgtgcggcttgatcatgtngaacaaagagcggcaccgaaccgaaccaaccaaccanttgaaatttcctccgcnnancggggccgatttnacgggaatgggcatccnacatggagggttngtcncnaccgcancgcaagggcgctcgctcttngccngngcctttcccngattnaaaactaacaaatggtggnnggacccggggacaacgcttnggtccntngggccccnggggggcanttccnnggggtgaacccnccatttttnngggactggtgcccaattttnaangnaaaantttccantttaatanggaactnaaaactangtttccggaanttaaccgggncaatggattc

SEQ ID NO: 94601 - DNA, 639 bp, Triticum aestivum
  unsure (1)..(639): unsure at all n locations
  Clone ID: PAT_TA_94601
tttttttaaatgtggtgtctcgtttgtcttttgttttcataatataatagatagatactctaagcttgtcttcatctttgtatgtttacctgttccattggttgatcttgctctgtcactcttgctctgccacactaaatcaacttgtataatctaccatttcctagtaaggtgagctgctacctcccctccatttttaactactcttccttccgcacatcctcttcccctccgcagccatctccctctcctccctccggcggtgaacggcggcggcaacgtgcatggtccgtatcccggcacatacactcccctgggacccnaccatgaatcccctggccccggcttntgggcgggcaagcnagggctcccgggcaaantccacgcgtctccggacngtggcttgtaccggagcaagcancgtacggggtnannacttcacagttatccgtaactanccangtcactcctccctnngngaccgctccccctgcccaagcncgggcaacccggtgccctcccaatcnacgggaactgacgccggactgcctgggtcnaggcatatggcggcgggacaacccgganaaatcctcaagggntcatgcanacggatccagcaaantnttcccnacgcaacgc

SEQ ID NO: 94602 - DNA, 643 bp, Triticum aestivum
  unsure (1)..(643): unsure at all n locations
  Clone ID: PAT_TA_94602
cttgctacaattgtggcaatgtgagtcactttgtggaggattgttgctacttcttgagcttgcgttggttttgtcccgatgcagcacaacagagataagtatttccctcagttaagaaccaagttatcaatccagtaggagaaacgcgcaagtccccaatagatgcacctgcacaaataatcaaacacttgcaaccaacgcgataaaggggttgtccatcccttcacagtcacttgcaaaggtgagatctaatagagatacataaaactaaacaaaagataaaatattttggggtttttgggttaatagatatgaaaataaaagatgggaaaatagtagatncggaaactaatatgatggaaaataacccaagggccatagnttcnactaaggttctcnccttgaaaggcaaataatacggggggtgacaattacgtccacaatnatagaaaacacaaattttgatgataccaagnaatgattatcaatatagnacacattcgttaaagtaaacgatccgtctnatccacacatacccaantcnacganccgccgnaccanatataattaagatatagataccttagtagtactttnagatacncaggggccgtacatcccaagggtctttcccccaggcttt

SEQ ID NO: 94603 - DNA, 578 bp, Triticum aestivum
  unsure (1)..(578): unsure at all n locations
  Clone ID: PAT_TA_94603
cttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagccgccggccttccagaagaccaagctcatgacccgtctnacctacacccttgacgagatggaaggccgctcgaggtcggcgccgacggcaccctnaattcnaggagaaggacggatcnactacgcggcgtcaccgtgcactcccccgggaggcnacgcgtgcccttcctctncaacgtcaagcantcntcccaacgggaaaccccgaganttcaagggccttcctcgtgcaaactacagggtcgtcttctccaaccaaaaggcctngtggtcnncgggctananacncgtggngctaccgcnggaggagaganagagagnntggcaaganaactnaaaagctctctcagggaaanacctantcacaagannagcgaacgcgagnatcgctctca

SEQ ID NO: 94604 - DNA, 587 bp, Triticum aestivum
  unsure (1)..(587): unsure at all n locations
  Clone ID: PAT_TA_94604
tgagattaaagggggaaaataaacccaaaccactcgccgaacagtacaccaacccccaccccccatccccgccgcccctgaccggcgccatggccgccgccggagagcggcgcctcctcgtcggcctcctcctcctggcccttatggtctcggcgcactgcctggacggcgccgggccaccacggcccgcgcgtgaagcggcgccgcaaagaacgcgagattcactcccccgtcaaagacggtggtgggtggtgggtcatggagaaccgcactttcgaccacgtcctcggctgggtccngcgcctcccgccccgacatcnacgggtcaaccggcacggatccaaccgcctcaagcgtccgaccctcctccccggaattttcgtcaaccganaaggccggtactcactcgggcccggcaaggttnnaggaatccgcagatttttggtccgccgaaatcgcgtcgccccanttgggttccnaaaaccccggatggctcgatgngaaaatatanggttcnccatcgtcctttancgcctcccaaaatcccttttacgnggtncttgncactnaacacaangtntttatng

SEQ ID NO: 94605 - DNA, 413 bp, Triticum aestivum
  unsure (1)..(413): unsure at all n locations
  Clone ID: PAT_TA_94605
gcgatatttaaaaaggttaaaataccacgaaacatgttgtaaaaaatgtctaaatttgcaaaatgccaagaaaatttatggtaataatcttgaattgcaaaaagtttataaaataaaaaataaaaggaaaaaaataaaaagacaaaaacaaagaaaacctatcaaaaatgcagaaaaaaatctcctggaaaaacagcatgaatgcctctagaacttccctaaaattggacagcagttcctaaaaatttaggagtaactatccaccaaccccttgcattccgcacgggtagcatggtaatacactttccaanggtangagatccnacaatattttttggngcaaggtttgccccccggtaaattaaaagaactagacacatccccnaaactagaanncaactatcacatttcca

SEQ ID NO: 94606 - DNA, 592 bp, Triticum aestivum
  unsure (1)..(592): unsure at all n locations
  Clone ID: PAT_TA_94606
tcgagtcgtctgacaccattgacaatgtgaaggccaagatccaggacaaggagggcattcccccggaccagcagcgtctcatcttcgctggcaagcagcttgaggatggccgcacccttgcggattacaacatccagaaggagtccaccctccaccttgtcctccgccttccgtggaggcatgcaaatctttgtcaagaccctcactgggcaagactatcaccttggaggtggagtcatctgacaccatccgacaacgtgaagccaagttccaagacaaggagggatcccccccggaccaacacgcctcatctttggcngggtaacacttttaggatngcgcacctttggcagntacacttcnagaagancaaccttcacttnggggtccctctcccaaggtggcaattactcctgacnatggactgcttccgttacctggttaaatctccgtgtcttccggtgcctccaatggtncnngccgttccgnccttcctgacntcttggtccaaacctacgtgatcatgtatcgttgatgttaaacttcgctggtcacaacttgtacttanatagtagcctaattcgtcaaaaaa

SEQ ID NO: 94607 - DNA, 643 bp, Triticum aestivum
  unsure (1)..(643): unsure at all n locations
  Clone ID: PAT_TA_94607
ggcggtcgccatgggaggcggcggagagggtttagctagcgagcgagaggtttgcagtttgatccagaaacactatacaacttggaaggaatcaagcggacnaaagagtactccaaaaagttagatggctccagaaacgaatatatantggtaaccatcctanttgctgccaagggagcgctgaagttccccaaaatcaagaagcccgcagnttctgaaagcagtantagaaaaactcaactctatacctaacccgagaattccggggcgttcatgttttatggcnccctccaagatgagaatgaattcctttcccnaagaaaaacttccnagcggttatcctaatctgaggccccataatgattactagncggctccttttgggtgttccttgggatgctatgatacacatctagccagactatacatgttaaaggtatgggtactcaagggattttccggaattacggtgcatttaaacgaaccatttaaanccnagctgcnaaacatcnantgaancaccctgtatttgacttgttgtnaancataatnacctcggggggccggaccaatccctaatggtcttaccnncnaaggcctctttaacgtctacggaaacctggtacaantanccttcnaaacc

SEQ ID NO: 94608 - DNA, 450 bp, Triticum aestivum
  unsure (1)..(450): unsure at all n locations
  Clone ID: PAT_TA_94608
ctcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctccggcgtgccgcgtgggtgtcgacgagccccgaaatgtggcgctgcgccggatatgaaatccaccgtcgacggcacctgccggtgggaccctggcaagaantactgganngntcaatgccggatangatatgttccgcntaaattaaataaaactccgggacnaatgacagctcancgtgccnagcgtgtgtttgtgaccaacaatattntacaataagtcctgccttc

SEQ ID NO: 94609 - DNA, 539 bp, Triticum aestivum
  unsure (1)..(539): unsure at all n locations
  Clone ID: PAT_TA_94609
tgaacgtctactcgtcgcgaacaggagctaggcttnncngagatggtgggattgttgagaaagtggcgctgttcttctatagtaagggtgtctttgtcggcggtatgatgtacgtgattggnaacccgaagggcatcagcaacgagcatgtgctcctggggattgacatgcaaggtaaagtgcggaggactatccctatgccgtacngtcnaagatttggtacnattggatcgtcncaggggtgcttactctatgctgtatcttccgtcgatgataacaataaaatcctatattctgagatagaactctnagtgcctcaaggattgtgacantaaanaattggttctgaagcatactgccancatcgatnancttatgacatgactggggagaagtacaaggtgnttgggattcatccanattanacacaatttcctggttaaatggagtgatacttggtaaggtacatatnaacatcaaaaanttggtgntcataanctgagaaatacaancattcacntantctcggtntaaatcat

SEQ ID NO: 94610 - DNA, 677 bp, Triticum aestivum
  unsure (1)..(677): unsure at all n locations
  Clone ID: PAT_TA_94610
gttagatgtcttgtttagcttgcagaaacaatggatttattcgaacttagttcgtcgacaagagaaattctgcaatgcttgtgagtatgcccaagtgttagaatacatgatttgatgtctgcatatgtagtaatggttcaagtacgggatggattggcccccatgtcggagacttctatcatgaactatcatatgttgatggaaaatcagagagccttgaaaaccttagaagcgtgtcgacacgtcaagccataagaccatagaatgggtaggacgatggaaccctttataggcaaccgttgccaatcgtaggatatacggtgagattcaaccccgggtcatttttttcctactgggagaaccataaattgttgaccgccaagaggtccgatagttcctaatattgacgacagacattcacatatgaagaccgatcctcgggaagaactcacaagtattgagagacacaagatttgagaaaaaggcatgcccgaccgggagacacagcaaagantatccggagatatagaagacgacacgtaaccgaaagatggatcatganttgtagaacatacatgcttcagtgtggacaccanactccnctcatggttgcngagactcatccaactttctgaaccctcatnccaggggccgaccattncnaagggncntacccc

SEQ ID NO: 94611 - DNA, 648 bp, Triticum aestivum
  unsure (1)..(648): unsure at all n locations
  Clone ID: PAT_TA_94611
gtctccggcggaggcggtattcgtgtctccggcgccggcacgggcattggagcttaatgctcccgggtgtacgccggccgacacctcgccagcaagcggcccctccgtcaattgcacgccctccattggcggcgcctcgacattagtcaagctcgacggcatcacggtaactaagcctcttggccgatgacttcatctccttgcctttgactaggcatccctgacgtcctacatgttttccgcagggcaccgccaacgttccatgcactctcttgcacttccgtggggcggcganttgattcgatgtcgccaaagggaagaaccttcaaccgggaacccatttccacggtaaccgaaccaccaccgtgtataggttgaactgggtcaagngctgctaagctgcgacattgttactctgatccactaccgggccgacgaagatgattgatgacctcaatgcctgcataactggccctgcttgggtgaagacaagtccttggggggcggggaacaaccacagacaagaagcatcgnccgggtaagcatgnagaacacgaanctacggnatncgnatccatgnaaagntctatnattncaaggtcgncanatgaacacatgaaattncanttaaannatttcanangtagg

SEQ ID NO: 94612 - DNA, 668 bp, Triticum aestivum
  unsure (1)..(668): unsure at all n locations
  Clone ID: PAT_TA_94612
ttgttgtgagcttgcaagtacattcaatgtactgacctggcgtgtcatgccagttttcagaaagtctaactggatcgaagtgctgcggtgtctagatcgtgtccacatcggtgtccatgtgctatggcgttccacttcgtcgtcgttccgctgccgcgtagttgtcgtgatcgaggcccctttatgttcactaaataatgtacatattgttcagccgcaccgtgtgtgccgcctgggcctcgcaacttaatgtaatatcgaactatttcccgctagtatcaataaaagcggtgctttccgtaccatgatgttgtgtgttgccaagaagacccatctccggggctgggnaatgcaaggtaaacaatcgctctgaaccggggtgccataccgaagtgtttgttgagttggnatanatcaagataaggatttcactccgtgtacnggagangtactctgggcctctccggaaagcacacactataancctgcaacaagtgacaaagantaatnccggatgatnatacggacataaagaaatgcggtaacanatgacaagnagatgatacgacatnaatccggcagtacatacgtacaaggaacactagttgtagcgttncgtaaatttcaaaaantgnncatatacaacagttcnatgtatgcgaatttnc

SEQ ID NO: 94613 - DNA, 372 bp, Triticum aestivum
  unsure (1)..(372): unsure at all n locations
  Clone ID: PAT_TA_94613
ttttttttttttttttttacaaccaaggaatgatttattcaccttctagcaccaagtaaactcttgtctcttgcataattacagttacaggatgaacaggagatcaatttgcttggtttttttttaaccatgcaatgttgttcattcttcaattatatgatcagaagcactttgtctttggncataccggnaanccanatgtgggccaccanttattacaacaactagcttatntcaaacacagtatccatttcctcgtcgcactgncactctcannaagangctcttatttgctctcgggttgttcacacatctttcaacancaatanacncactgaatctgaaattgtgangtctaacaagcctgcaaca

SEQ ID NO: 94614 - DNA, 653 bp, Triticum aestivum
  unsure (1)..(653): unsure at all n locations
  Clone ID: PAT_TA_94614
acactatgccaggacttctcttgacagtgctgctgatctctcttctcgccaaagaaacatatgttgccacatcactggatgatgaaaacttcttcaagagttgttcaccaagtcggtgcagcaaacatggaccagaggtccggttcccattcaggcttgcaacccaacctccgccttgtggtgcaccaggtatgcaactatcatgctctgggacaggacacaatcctgtatcaccaattcttggctcctgcaaagtgactacaatatttacaaggatctatcataaacatcatccacctggtagactcatcacttggactgcccgcttcaagagaccatctcaagcaancctatcaacggggtgtacaaacctccaaaantgggtgttgccacttagtagttgttcaaagaatnctataccataatctatatggntagtggnccatcacttgtctcattaacaaggcacaattccnggattggggacccnagcctanagtcgtcnacttggactgatggttgttcaangncanacaatncattactancagatgataccagantttntatacaagaggcacanatgaacttngtaaggaacaaacacacctgagaaaattttgaccanaaacacangttcaattaaaagggnn

SEQ ID NO: 94615 - DNA, 582 bp, Triticum aestivum
  unsure (1)..(582): unsure at all n locations
  Clone ID: PAT_TA_94615
ctcgagtttttttttttttttttgnngctgttattgtcttaccatagtaggtggttaancattaagaagaacatcaccacaccacacacacaagagaatttacacatggagccagcatgattctttatttatcttagcacatgaaactaacaacaaaccgaggaagtacagtaatcgcctagttcaccgatggacatgaaattgtgcccatcgatcgaaaaacccgcgtcatcagttaaaaatatcgatggcgggtttttaccatgaatattgactgcaacgacggcacgaccggagcacggacacgacaggaagaccatggcgccaatangatggcaggaggcancatgggcatctgcacttcgctagcatctttccttngctgggcagacgccattgctagaagcttggcacactccatgggatcaactggcaccctacactgttgtcggagaaggntaacagaatttggcngcgcctcccggagccgtgtgtcncgtctccgcgccnacgcgggctttgncaagcggccttgatctggcccnctcgntccctgcggagntacggaggnttgtgacttcg

SEQ ID NO: 94616 - DNA, 437 bp, Triticum aestivum
  unsure (1)..(437): unsure at all n locations
  Clone ID: PAT_TA_94616
gccttcttgaggccgagggatttcttgacagcttctttcttgtcgcgcgggcgctggatgcggagggtcatgtccaggggccgcgcgccttggagccagggcgccgtcttggggcggaggtggtggaggcgctccatgagccgcatcccccgtacctagcggagggcaaggcagcgaaagggacggcgcaagagancccctgcggcgctgacgagattcnggtgatgccgagcaancatcttcgtagaggcctccatggggcggtaatgcaaggantcaactnccaagaagaangcngctaccntccgtttgggggcgatnagcgttggatgacancancctnggtcaaccatgattgcgtgtntcctcccgccccaaccaagggtgaacnaagaccttnctgtccttcccgccaagccgttgcgcttttgcggtag

SEQ ID NO: 94617 - DNA, 648 bp, Triticum aestivum
  unsure (1)..(648): unsure at all n locations
  Clone ID: PAT_TA_94617
attcattctcatctacattgtgttgtaggttcttctcatgaacctggctttgacaaaggatgagaagattgcacgacacaacgatcctcggcaaagcaaacagataagttcacctctagtccattagtattctgtaaagctacaactttgcataagaaaacctcgcctccctctttggaaacttaggtgctcccatccataactccgaacgctgcttcagtccaaggtgggccgcaagaggctctggggaaaaaggattgggcggggggctactcctcctgcctatcccccggtaagacaaagacggtgcccggcaggtatcctgccaaggaaaancatttatcctattaaaagaggactttgcctcctgcatggncatacacatgcacgantcctaacgaatcaccttttcatccatatgaattgcaanacaanattncagatacaaagaggttgagagatacnaattggataaaatgggcgatgccacaggtaagntnaaaaaatangcccaatacccttgcctgtcaactctcaggaanagtnanaggccggncccanagtggatcacgcnccaagatagaggacccncccacaggaganatcgnccaagggggtgnatcccagncaatgnggnaatcccgaaan

SEQ ID NO: 94618 - DNA, 187 bp, Triticum aestivum
  unsure (1)..(187): unsure at all n locations
  Clone ID: PAT_TA_94618
ttttttttttttttttttttttttttttttnttttttttaataaaaaggcataccaaattttcgcnaacttcncganaatgttacgtaatagttcactgtacanattatacaacaanagctctttggngctgtgagtttaactgtcccagangtgttccctctgactgtaaaaanaaaaaaaaaaaa

SEQ ID NO: 94619 - DNA, 640 bp, Triticum aestivum
  unsure (1)..(640): unsure at all n locations
  Clone ID: PAT_TA_94619
ggtgcgcatagcatgggagtcgtatgcgctcctccgcccgctgatcaaggagtcgtggatttgggtatgcccgcagctgaaaatcctctcggacgtggcaggcttgtcattggaaatccaaaagctcgagcatgatgtgttaccccagctcaagcttcaggaggctaagctggaaatgggcgccctgggaancgtcctactcatgaagaactcaactgttgcctcttacattngaggaangcttttaaggaaacttnggcgtatgttttgccaaggatcatccnggctcaaaccaaatcaaaaagcttgaccaaaatgctaaaggtatgctgtcccggttgcttcaangacgtnaatcanattgtccgnttttaaaacnttcccgntnctgggcaactgggcaacnaggttttgaaccccttcaattncnaaaatccgaagagctccgaagncctccnaagatanattanaactactcaagtttntaagatattctaagggcgtggaaacattanaacaccttaagttgatggtataaggatttaggggggccgtaccaatcnccaatagtcataccccnatgcctctttaactctacggaaacctggtaccantaccctnaaaaccctttcatggaann

SEQ ID NO: 94620 - DNA, 664 bp, Triticum aestivum
  unsure (1)..(664): unsure at all n locations
  Clone ID: PAT_TA_94620
ctaaaattcaacccacgccttgttatcccaaaaaatccagatatcgtgctcccaaaactcgcgccttcacaacccgctccttgctatcctgaaattacaacgcgtgcaaaaactccctccagctgtgaaatcccgacatgcgaaatccccttctaaccttgagctaaaagggccgctagttcaaatcggtgggcgtactttttaacacaccctacatttatacaagcgcgtccctaanccatggtcccccatcccacgcctccttttccggattcaaaacccaaggcgccataactctcctgntcaaaacccacctcctcccgtcnacaactcnatcgctgcccaaccggggctcttccccngatgacgttctccaacggtaaagcttgaantncctcancnactcccccggagagntcaacnacgtttcnccatcccgcggttaannacccntctcaactcaaaggctgtccganatcgctcgtcnacnggggtgtcaacccaaaaggcgcctaactggccacggaacanaatctcatganctaaacaancgaggcatcgggcacaaagnattgtaccataangacttcnctataactccggaangggngtcancgacaangngtctaanaggaatcanggtcnccattagtcccgggncaaa

SEQ ID NO: 94621 - DNA, 538 bp, Triticum aestivum
  unsure (1)..(538): unsure at all n locations
  Clone ID: PAT_TA_94621
ttttttttttacacataacattttctcaggtanttgctcaacagaagcgtcaccacaaactctatgaatctcaggaccacggattacagccattaaaacttggaagatacctcccaagactgacgtgaacaatatcaaaagagaataaatagttattgcatattcagaaaaaggtaatacatcgacatcactatgctgatagttaagaggcatgccctctcaagagttggaaagtctgtgttcttctccaataagttcaggtatagtatcatatagtccctgattcatgtaacgaattttcatgaattgaccctgacatttttttctcctcttttttccttccaaacaccactgatttcccacatgttcaatgtaaangaanagcaagtggnttgccctctcgangtcctcgtttcaccattcngtgcaatccntgtgcangctngtnccttgccttggnggaatcgtagtgccctccacacangtacaaggcatacngantaacgtgnctcacatgtcatgttttcttgaccagatc

SEQ ID NO: 94622 - DNA, 638 bp, Triticum aestivum
  unsure (1)..(638): unsure at all n locations
  Clone ID: PAT_TA_94622
tttttttttttttttttttcttttcagtcgtatggccgagaggctccagcaataaaaccttgtgcagaatttagtgttggtatatactccctctgtcccaaaataagtgagtagtatataaataagtaaaatagtttacttgaaattaccctgagttttatggacctgctaaggtactggcttgaatgtttgacagagaaatatattttatgtagaacgaaatagattccgagaccgagatgcggcaacagattctgtattttatccgtgtagaaaatattttctttttagctatcaaggggatccaataagccaaataccttaaaataagtattccctccatcccgaaaaacttgggtttacagtaaccttaatggttccaatttattaatattttggaaaaggagacaccccggctctgcatccgaaagngcatcggcacaaggtttgtaatacaactttatggtaaagaacaatacaatcttcaaatacataccgtgccgcgtacnctacatacactcaggaagaggaaattaaggatataccaatactaaccctatcaacaaaaaaaancaggggccgaccaatcnctaanggtcatanccccacngcgtgttaactcganggaaccnggtaca

SEQ ID NO: 94623 - DNA, 264 bp, Triticum aestivum
  Clone ID: PAT_TA_94623
gcccaacaaaaacccctcccccctcccgcgcgcacttcctgcccagcgccagctgaacccgctgctccacattgatggcaagtcagggctatgcgacctctcactgcttccgccgttgaagcggcgcgccgaccaagggcaccacccactgcacgcccggcatttcaagactacacagtggagagtaactttagagaaagtactacaattagatgacataagcaggctataaggatttaagatatagtatttgtgcttagtgag

SEQ ID NO: 94624 - DNA, 616 bp, Triticum aestivum
  unsure (1)..(616): unsure at all n locations
  Clone ID: PAT_TA_94624
ccgagcagcattcccagcacataggtacagttgtaggcgacatagagcctctgcgagtacctcccggtgacgagcaggacgagcacgtagagcgggaggaggttgatgatgaagacgtagcctccccaggcggagaccatgtagaagtagccgaacgcggcggcgagcgaccaggcgagggacccggtgttgacggcgcggacgaagaggtagaaggtgagcagcagcgcgaagatggcgacccctccttgtccttagganccgcgacgggagcgggagatgttacccggggcagacggcgatnagcgcggcggcgacgaagccggcccggancccagttttccccggccgaagcgttagcgacagcttgtgtttgggccaaaaaaagggcngttaggagcaaactccccgatgttgacgcnaggaaacncccgangagcgtngacaacccggggtgacatcaccggggaaactgcccgacacccgccacggnacaantntggccacaatcaaaatngagtacntgtcgtagtaaactgtcgtantaataggtcaatctgntatgntctcgacncgnaaagcccgnaaggacattacaccaccggaccgggacctg

SEQ ID NO: 94625 - DNA, 291 bp, Triticum aestivum
  Clone ID: PAT_TA_94625
gagcattttcaacaacaaagacatgtcgagcggatccacggccaggaatgcggggtcccctggttgtccaacgagcattgtgctttgcttgatgggtgtggtgctagctgtagagtagcatagtgttctctgagacatgcttgtagaattaatcttttttggggtcttttttttgctcctgtacaggtgtatttttgggtgtgtttatgtaattttttgttttaaggactttgaacatatattttctgttaaatattatggggctttaaaattccatggcaaaaggggggg

SEQ ID NO: 94626 - DNA, 633 bp, Triticum aestivum
  unsure (1)..(633): unsure at all n locations
  Clone ID: PAT_TA_94626
ggaaagtcaagcccgatgattctgtgggaagggacggatttcgaattcctttttccttcctttttacgccacctcctcccaatccttgaagatatgaagcaatattttattaagactaagtgaaggttggtatggcccaatcccatcatttaaatgagagtggatcgagggaatggaatctagactatagattgaactaagaaaaaaaatgcaatctattcattcattcatcttatcttccattttagaaagtagcaagcagcgaataaaacggctgcagcaagaanttccgcactctaactccgaaacggtttcgcgcattggaaagtgtcatcccttgctttgttcctaaccgccttcctttaagttcaagtatccgaaatcttccctanaataaattggttatttagtatagaatangagaaagaaggggntcattgccccaatatcccgcagtactttnaaaaggcgagtgtttcaaggtcctacccatcaacatttgcatttggcgcatatatanaccctcctgggnacggacatacaaatcacanggctcttccccctttgtgganccntcatgagttgattggaggcacaatcnganttctcccagggggcgnacaatcccaaatg

SEQ ID NO: 94627 - DNA, 597 bp, Triticum aestivum
  unsure (1)..(597): unsure at all n locations
  Clone ID: PAT_TA_94627
aacctcaaacagttttagagatcccagtgcaagaccactctagagggtggccttctaaggagtcagccagagttgaacgaatcaatttaaaactgcatgtatacacagtatacacgggtacacgttacaaaacccactgtggtcggcatatgacaagcaggggagatgaaacaccagtccgaccgatcttacagcgttcctccgtaacgggcgtgttcccctagctcagcccttcatcatgctaagttgctagccattgtaattcaggttcaacttcctcctgaagtgtttgcgatcttccgtcttccgttttgtgggaaagaaaaccaaaggccagtgacatctacggcattccgcgtcctcacgggagtggcggaaatgtacccgttcaagtaaatccttgtattgcgcctccgcctgctgaatttggggccttaacgttgctccttgagtaaaantccttctcaacaactccaactccaacatcctcatggactgctgatcccaaactcaaatgctcgaatcatcanacccttcggncatgtgttggaaatcgataacgactcaaatcgtangctgctctgcaggtcancggca

SEQ ID NO: 94628 - DNA, 616 bp, Triticum aestivum
  unsure (1)..(616): unsure at all n locations
  Clone ID: PAT_TA_94628
gcctgcaggtgcaggctggacctagtatgcacgatgatcccaaacacctcgcccatgtccagcgtctccgggcctgccccaccgggaatcgcccagtcaaagtgatacagcaggttggccaacacgagctcgagcatggtggtcgcgaacagggctccagggcactgcctacggccagctccaaacgggatgtactccatgtgcggccttggccgagctgtactccacgctcatgccctccgaactctcccggctgaatccgccggcgtccgtccccaatgcgccgtgtcctccccnactgcgaagcgtttatcatgacggcggtgccttgggtatgtccgtaacccatgaccccgnatnctcctggtcgccccgtggttaancgggccgaggggtcacctcancttccctntatacatcccgaaatatgcaagcgacaagtcnggtcctattttgactgcgggatcccgacacttcggatcaattccctgcatgctcggtncggacactcncatggcatcaactgnacntgtgtcgtcactaatttaaatanggctatattcgctaaggaanagggtctctncactagncatcaaagccctttcangaaaattgt

SEQ ID NO: 94629 - DNA, 276 bp, Triticum aestivum
  unsure (1)..(276): unsure at all n locations
  Clone ID: PAT_TA_94629
tcgaacagttaccgcaaagggtctatgaagagttaagatcaacgggggcagtggctacaggggttaccgaaacttgcggcaatggtgaagaacgcgaagaacacaagatgaaccctaccacagatttgttctagcaaggcagggaagactcaccggagttgaggaagagcgaaggtccgccgccgctatctgggtccgggtcaagggtgatgcagcggccgggtcggtgaaaattaaggggcgccaacggcngcggcggcggcaaaactcnggcat

SEQ ID NO: 94630 - DNA, 617 bp, Triticum aestivum
  unsure (1)..(617): unsure at all n locations
  Clone ID: PAT_TA_94630
ccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgaacggggaagggcgtcctcgatcagcaaggagtgctgctccggcgtgcaggggctgaacggcctggcccgcagcagcccggaccgcaagatagcgtgcaggtgcctcaagagcctcgccaccaagcatcaagtccatcaacatgggcaagtctccggcgtgcccggcaagtgcggcgtcagcgtgcccttccccatcagcatgtcaacaactgcaacaatgtcaactagttcaatatataatcctccctaactgcatcatggaccgctgcntggagcttaattctacttgatggagnctcatacatgtnaactactaaaaataaatgaattgcctgtgtgtgtaatcaatatgttcaagtcgtacttganaanacgtgntganaaaattatcnaatnttcacctctttctatnaatgcaacctg

SEQ ID NO: 94631 - DNA, 239 bp, Triticum aestivum
  unsure (1)..(239): unsure at all n locations
  Clone ID: PAT_TA_94631
gaanagcaaggngacnagcgccaancctttgcatcacgcaggccangccacacgcacanagcgcgcctgatncgtacgggcgcccnangtggggatccggtagccggtcatgacgagcgnctccgacctcttcaccgcccgcngcgcccgcgcgcnctncatctccnacccgggggaccccatgtccggattcgctctccgacnccnccncaggacngnacggncttctcggcccgccg

SEQ ID NO: 94632 - DNA, 533 bp, Triticum aestivum
  unsure (1)..(533): unsure at all n locations
  Clone ID: PAT_TA_94632
tcacagcccacatcgcccgccgcgccgccgccgccgccgccagcgccaacccccaaaccctaaaactcccacccgaaaatggcggccgacgatggattctcggcggcgcgcctcttctcgcagggcgtgtcctacacctacgacgacgtgatcttcctgccgggcttcatcgacttccccgccgacgccgtcgacctctccacccgcctctcccgccgcgtgccgctctccatcccctgcgtcgcctcccccatgggacaccgtctccgaggccgccatggccgccgcgatggcctcctcggcgggtcccgttntccactccaacacggagccccgcgccaaagctcatctccgcgccgcaaagtncgcggctcccttgtctctcgttccancttttccccggcttcgcccnaagctaaanattntngggcaaaatancctcctaaccanaagggatccntcaagtcttnggtcccggggccccattcncccccnaggcccgcccgttccaataannnccccccggttggccc

SEQ ID NO: 94633 - DNA, 668 bp, Triticum aestivum
  unsure (1)..(668): unsure at all n locations
  Clone ID: PAT_TA_94633
cttccccttcccctccagcgccggggggcggatctacccgccgccgcctgaatccatcggggacctgcgccgacgtcgccgtttctcttcttcctcgcaagcaggtcaccagattttgaagtaaggagagaggtcgacattgggggaaagaggaaaggcggccgctaagccaccccctaggaagcggatggacaagctcgataccgtcttctcctgcccattctgcaaccaatgggaacancgtccaatgccggattgattctgaaaaatctgaatgggtgaagntaactgtcaaatctgccaagaaagcttcaacaccactgcaaatgcnctgactgaagctattgatgtatacagcgaatgggttcatgagtgcgaacgcgtcaacactgtttaagatgacnatngtgcaataacaagtgttactatatacnctataactcaaatgtgttgctgcatttactgcaacgtnaagcatatctgtnntacattgtacaatgtactgggccgattgaaacttataggaattgtccctgctaatnacnacgatgatactgtactgaattgaacctnaaaacgggtgaataactaacnggactcaaaantnncttaaatccnttgagantcttanattataaattaatnggangggnttnaaaaaaaaaaaa

SEQ ID NO: 94634 - DNA, 671 bp, Triticum aestivum
  unsure (1)..(671): unsure at all n locations
  Clone ID: PAT_TA_94634
cggctgtgataccggaggctctagggaagtcggaggagagagcactcatcttggggtgggcttactacttatatgctttcagcagttatcctctccgcacttggctacccagcgtttaccgtaggcacgataactggtacaccagaggtgcgtccttcccggtcctctcgtactagggaaaggtcctctcaatgctctaacgcccacaccggatatggaccgaactgtctcacgacgttctgaacccagctcacgtaccgcattaatgggcgaacagcccaacccttggaaccacctacagtccaggtgggcgaagagccgacatcgaggtgccaaaccttcccgtcgatgtggactcttgggggaaagatnagcctgttatccctagagtaacttttatccgtttgagcgacggccttcantccggnacgtcngattactaaggccganttctctctgctcgacggtgatcttgcatcaaactcccttctgccttgcacccaaggggggcccgtaccaatcncctanatgagtctattaccgcctantggcgtcgttanaactctgacggaaaanctgggttaccaactaacccttnanaaacccctttcanctgctatacaaaggccnacgatgccttcaantnccactatgnatggacccctttcgcn

SEQ ID NO: 94635 - DNA, 644 bp, Triticum aestivum
  unsure (1)..(644): unsure at all n locations
  Clone ID: PAT_TA_94635
ttatcgtcttgcattatggttaattccatatgtctaacaatattcattaaactcctttgagattgtcattcttatcctattgattcgacatgtgcgtgaatgcacacattcattagttatttccctgctaattattttccttctggctcagactccactccggacatgagctgggtctcggtagatcaaacctcgattgattgtctgtctatgtctatccaacttgtcttttgatcaagagcctctacttctgatctcccaatccgggaaatcataatccttttanttaaagctttgaaaattgtccaanataagtactatagtctgatgcatttgcattattcttcttctgggtggaacatccgatactcatatcaagatccttgtggncccgcgagaccttggattgggattatatctgacagancctcataatcaatcaccttgtgancttcctccggatacataatgctttgggaaatgtacctctgcccaacaacatgctcggcttcnactccaggggggccggnccaatcgccaaagngagtccnataagcggccaanggcgtcgttanaacgtctgacnggaaacctgcgtacaactatcnctgcagaaancccttngcactgngaatagaaaggcg

SEQ ID NO: 94636 - DNA, 306 bp, Triticum aestivum
  Clone ID: PAT_TA_94636
ctagcatacacctcccccttgtcagccgctcccagttggccacccgtctccggcacacggagaagacgcgacgaagcaccgtcggaatcaattccagaaacagacccctttccaactccccaatcgacggcggcgggcgtccagcatccgtagccgccgcacccgaccggagccccagcccaagagggcgggcggaggaacacagagatcaaagaaatagaggaggcaccgaggcaggcaggacatcgagctgggtgccaccccgtgctccgccgccgttcaactcgcggcgctcccctgcagcag

SEQ ID NO: 94637 - DNA, 388 bp, Triticum aestivum
  Clone ID: PAT_TA_94637
ttcatttcaaaaaattggaatgtattaagaaaattgtggtatttcacgtttacaattttttgtgacaactattacacatataatgcctctgtgtaaaaggatttgatttttttgatttttgtttcaatttctttgtttatttttaaagtgcctaaagaagcacacaattgacagccttctcatccgtggaaaatttgagccttggatcgatgacatggcgcagatccatccatccacatctatctctccccccacatccatccatccacatggcgcaagttttctgactcggatgacatattgtatccaagtccctaagcctcattaagccagctcttgggcagacccatgtgggataatgtatatcatatgctaagacactagttga

SEQ ID NO: 94638 - DNA, 449 bp, Triticum aestivum
  unsure (1)..(449): unsure at all n locations
  Clone ID: PAT_TA_94638
gcgaggccgacaccgtcaccacccggaggtcagccgcgcgctctacgaccgggccgccagcgccgacaagaccatcaagctctaccccgggatgtggcacggcctcaccgccggcgagcccgacgacaatgtggagctgggtctttgccgacatccgtcgcctgggctcaacaagcgcagccatcatccgcaaacctgaacacggcggccgggtaagaaantccccgtccggagcctgcaaggtaccaacggcggccggttcccggcggcagcggcatggacagccggtgtcgatactccggcggcgaagtggttcctcctgcgggatgttnatgttaacatggactgttttgtgcaaggaaaagagaacagcaaatgaanatgttatactgtgctgcaccaatctcaattaaactgnaaagttttctccactccngaaaaaaaaaaaa

SEQ ID NO: 94639 - DNA, 594 bp, Triticum aestivum
  unsure (1)..(594): unsure at all n locations
  Clone ID: PAT_TA_94639
ccctacctcctcatccattcttccgtggatttttgaatttctttggcgctcagatccatcactttcccccaacaccatatcatatcttgccgcatttgtttcgatgtgtgagaacttcctgggatgccacccacattgggggttattcaagcatatctttacttgccgatctcggtcgatgaagaaagcgaatcccactgacgagaggactcgtgtgatccaaatgtgtgggggcctaggaatccaaatgaggggtaggagttctttccctcccatgacctttcctgaatttgttagggggtggcagtcgacctgggntttactgggaaggatgtcccaactccgggtcaatcgacgggtcttccccctttctctctaaagagactccgcgctcctcgattgttgactgtagaagaagaggagaagggtgagtggtcacctggtcatgcggcnttgcactggccaaggcggagtnataggaaggattgctggagngttctantcnacgatccaaccttgcaactcgcgacaccatgtggngtccaagggcagaaaacgccggccatggaggngcaanagaacgnaccatggttg

SEQ ID NO: 94640 - DNA, 628 bp, Triticum aestivum
  unsure (1)..(628): unsure at all n locations
  Clone ID: PAT_TA_94640
acggttcaacagaattcactgcccttttatggagcttttgatcgcgcttgcacaagctagtggtaaaaacatgatactgtccaccatttaactgcttcgggttgctctgataacctgactgctgctgattcccctgatgaatctactgattgtgaccaccttggttgttttggttgccctgattattctgaaatcctgagtttgaaccgccaccgctgtaacccggcccgtgaaaccctgggaccgaaactgccagatggaccctaatcataccggaagagatcaagagttttgaatccctcatgatgaaacaaccttccaatggtgtgtggctggaactcctttgtcccgtgctttggggcaaggctgggttaacctggacgacgctgcgcatgccctgcatattggtgttaancacaaaattaaatgtccgcttaagctaacaatgtcccctgggtcaactggtaatgctgcatttgtaccggatctcttccctttcccgtttcttcgcnaaaccngncctgggattaccanattncaaatttccnnagtgcatgatttccaacctgcatggggctgacgtcaacttactangactaacggaatacccaagnacatgagttanatt

SEQ ID NO: 94641 - DNA, 212 bp, Triticum aestivum
  unsure (1)..(212): unsure at all n locations
  Clone ID: PAT_TA_94641
ctgttcgttcctggaggctcggcttccgaggcaaggaagcacaggctgcttgcgatggccggtggganggaatntctnctcgntataagaantgtgntngcanagcnaacgcaaggattgctggctcatcatctccagcaaggtgtacnacgtgacgcccttcatggnnagagcacccggncggcgacnangtcctgcatggcgtgcatcgg

SEQ ID NO: 94642 - DNA, 325 bp, Triticum aestivum
  unsure (1)..(325): unsure at all n locations
  Clone ID: PAT_TA_94642
nncanctattangtcagtcaagacgagaagcaagtgccataggcaaccatgcctcatcgcgcacgcgcgtgtgtgtgtggtggtgggaagttcgcagcttggatgtggggctacagcagcngcagcgatggcggcgtccgtggncacctcnccggnctgcacccggctcatccccagcagccccctctccgcctcngcttanacggccgcgccgtccntcattcgcctggnggggtcctccacatcgcctcncgccgggccctgcgctctcggncgcggcngagccggccgtncactcnnccggngcccgggggccggcgatatg

SEQ ID NO: 94643 - DNA, 642 bp, Triticum aestivum
  unsure (1)..(642): unsure at all n locations
  Clone ID: PAT_TA_94643
ncagcctcccgccgcaacgacgcctcagtcagcgcctactccgtcncaagcgcaagcnccggncgccggggcgtgctggctgcggcggctactcgggtgtggcggcgcgtcgccgcccccggcgcctcaggaggaggacgcgaccagggacatanagatggggctcgccggcggtggcgaagagcaacgcgtcgtcgcggcaagacgaagccgccgcanccgtcctcgtcngtgacgcctggngctggacggtgggacttttcctcctccaaacttttggtatgtgncctcctcccttgcnttggcgtcatcgcaantttcccaagcgtctccccggttaatcctaatccgnccnnggagtaaaaaactgtacagatttttaaagatgtggngtgatgtacatgtgggtagaatgnnnatttcccnggaatgaaccacnangagaanaaacaantttcccccatacatttnaaaaaaagggggggcccggnaccnattnccccaaaatgatcgtataacncggncaacggccttctttaaaantcctgacgggaaacctgggntaccaattancncttgnaaaatccctttccaantgggtaaaacaaaggcccacgtttccttcaaaattncacctaanna

SEQ ID NO: 94644 - DNA, 409 bp, Triticum aestivum
  unsure (1)..(409): unsure at all n locations
  Clone ID: PAT_TA_94644
ctaatgaagacatgaattccgccgaaggggacccggtacccgtactcgattgagccggcttcggggccccatcctttgtcgtcgatgtaatgcttgccacgacgacttttggtcatccggttgatcacgtaccccttaagtccttcagagcaacccttcaagaactcgacaccatcgtgcgatagccccacggtgggctccaactgtcgtggaattgtcacggcatatgtccttgtgaaaggacttagtccgtggagccatcgcaacgagttagcttgaaggggttaaaccggacaagggacacgagagttatactagttcggccccttcgatgaangtaaaagcctacgtctaattgtgatgggattgattggggtttcgatgatcanggagcgaaatacgcttgcct

SEQ ID NO: 94645 - DNA, 422 bp, Triticum aestivum
  unsure (1)..(422): unsure at all n locations
  Clone ID: PAT_TA_94645
tccagttgcaagccgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacattggcttcatcaagtaccgttaagaatgggaaacctcaaaaggaagcaaggactanggaaattatcaaacgaatgtgggtgcttcatcgagctgattcttttatcctataactatgttaatgaactactattatgttttgaancctggggtgacaaaaccgtngaaaccatgtttaancgactgctgtttntaccatgtngaaaccgatattccnttaactggngtgccaaaaaaanaaa

SEQ ID NO: 94646 - DNA, 642 bp, Triticum aestivum
  unsure (1)..(642): unsure at all n locations
  Clone ID: PAT_TA_94646
agaccctcaccggcaagaccatcacgcttgaggtggagtcttctgacaccatcgacaacgtcaaggccaagatccaggacaaggagggcattcccccggaccagcagcgccttatcttcgcaggcaagcagctggaggatggccgcaccctcgcggactacaacatccagaaggagtccaccctccaccttgtcctgcgtctgcgtggtggcatgcagatcttcgtgaagaccctcaccggcaagaccatcacacttgaggtggagtcgtctgacaccattgacaatgtcaaggccaagatccaggacaaggagggcattcccccggaccaagcagcgcctgatcttcgccggcaagcagctggaggatggncgcacccttgcggactacaacattcagaaggagtcaacctcaacttgtgctccgcctccgtggtgggtcaataattgncctggcgttggnctgctggttaatcttggtcnttcgttgtgtccgtttcatttaactgttcaatgttccancatcctaagttggttaatgaatatcaatcacggtacttgttggttacaaattccggganagtacactagntntgataatgacttcggtaatctggctantgctgttgnaagnctanatcaa

SEQ ID NO: 94647 - DNA, 453 bp, Triticum aestivum
  unsure (1)..(453): unsure at all n locations
  Clone ID: PAT_TA_94647
gagagagagagagagatggcaggcagcagcatgagcaaggacgagaggtggagcctggccggcgcgacggcgctcgtcaccggcggcagcaaagggatcggtcacgcgatcgtggaggagctggcggggcacggggcgcgggtgcacacgtncgccggagcgcggcggactgggaggantgncgccgccggtgggaggcacaggggctcccggtcaccatgtccgtctgcgacntctccctgcncgcccacaggctgcagtccntggagacgggcaagcaggtcttctacggcaaagctccncatncngtgtgancaacacgngaaanatncttgncancgagatcgttgnagttgagacatcatnaggagtatcacaactgntggcgacaaccntantcctaactnctactcaatcaannggtgnaccctccttttgnnagcaacatacctg

SEQ ID NO: 94648 - DNA, 643 bp, Triticum aestivum
  unsure (1)..(643): unsure at all n locations
  Clone ID: PAT_TA_94648
ctccggaccagcagcgcctcatctttgctggcaagcagctggaggatggtcgcaccctcgctgactacaacatccagaaggagtccaccctccaccttgtcctgcgtctgcgtggtggcatgcagatcttcgtgaagaccctcaccggcaagaccgtcacacttgaggtggagtcgtctgacaccattgacaatgtcaaggccaagatccaggacaaggagggcattcccccggaccaagcagcgccttatctttgctgggcaagcagctggaggatggccgtacccttgctgactacaacatccagaaggagtccacccttcaccttgtcctccgccttcggggaagcatgcaaatcttcgtcaaagacctcaccggcaagacatcaccttgagtggatcttctgacacatcnacaactcaaggcaagatcaagacaagganggattcccccggacaacaacgccttatctcncaagcaaacactggaggatggcgcacctcgcgactacacatcagaaggatcaacctcaactgtcctgcgtcgcctggtggatcaatttcctgaancctaacggaagacataactgagnggatctcnancatnacatncaggcaantcagcaaggggatcccggcaaaac

SEQ ID NO: 94649 - DNA, 548 bp, Triticum aestivum
  unsure (1)..(548): unsure at all n locations
  Clone ID: PAT_TA_94649
gtctagagtttttttttttttttttagtacattttaataaattatttaaatgtactaaaataaataaataaacaacttaaataattaacaaattgccttttattaattataaaatattaaactattttatttgaggtttaaactttttgtggtagtggtgtaattagtaaaactaatttaggtactactaaaatattttacataactagaataaattgatgaatgtaataaaacagaaaagaaataaataaaggaaaaaacaaagctaaagaaggnaaacccccccactgggccaatcggccagcggncagncccaccanttgcccttaaacccactccctcccgaaacctacngncaacttnccccccctcacgttcgctcccctctcccccccacgatccgctcgggatccggaagaacctcccccgtcccntccacccanngccccganccactggacctcncntcncccaacactcacggatncctccctccgncgtcanctcntgcgtcnctctcaagggggccngtaccantcgnctnagtg

SEQ ID NO: 94650 - DNA, 634 bp, Triticum aestivum
  unsure (1)..(634): unsure at all n locations
  Clone ID: PAT_TA_94650
tctttttcttttttttcttattcctttgttctttttttggaacggttttgtttggatttttttcctatttgctaaaagtgcgaactatttttcaaagttgtgtactttgtttcaaaattgatgattttgtttttcaaaagttgatgaacttttgtttaaaatttgatttttttaaaaaaattgataagattttaacaaaattgttgacgttttttctcaaattccatatacactttttttatttacgaattttcttaaaaattatgaacatttttttccaaattcgatgattttttccaaaattcgngattttttaagtttatgatcttttttcaaaattgatgattttttgaattcatcatttttaattttttgcnttanttccgtattttgtcaaaaagcaacggtgacaaaagcaacgggcaacggcgacaatcancatgcgatcnagcaacaaggggaacggcaagcgtcgatgctgcaccgtaatggctggccacatgttggcgctgactggggcattgngacaaangagngactccttccatngnaaggaagaaagcgattangggaactccccctggcgacaagggaanacttttcccngngggccnctcccncacaaaaaaaaann

SEQ ID NO: 94651 - DNA, 632 bp, Triticum aestivum
  unsure (1)..(632): unsure at all n locations
  Clone ID: PAT_TA_94651
tttttttttttttttttttgcacaaaatacttattacttctgaatatgttacaataaccagttgcttaaatctccatcgagaattacaccataattcattcatgtttcagaagtaattcattcatctgctgcctacacctatactggaccatgaccaccgaaggcaaacgcagagccgtaatcagaaattcagaacacaaggcgctccaacactgcaaagccagtactgtcatgtcaggaggacgncggaggggagaaggccagtgcggcgtgcgaacaatggccgccccggcgtacacgtccaacgggacgagcgtctccttgtacangtacgcctgcgtctccgtaatactgttagggctgaaatcagcagctcactcctccccgccgtcctcgtcgcccgcaagtccgggaaaagcctcgccgtcccggcgttcagcagacttcccccgcggacgaacacggtncnggaccacgccgngcnacgggacagccaccgttcttagcgacaccngacaggggggccngtaccaatcgccnaaggatctatacccccacggctcgttaaactccgacggaaaccgggttccaantannctgagaacccttcacgggtaacaaagcnncattcn

SEQ ID NO: 94652 - DNA, 480 bp, Triticum aestivum
  unsure (1)..(480): unsure at all n locations
  Clone ID: PAT_TA_94652
gcttcgacgagtcgggcaccgtgccgaccctcgacctcggcgcacggaaggagaccacggtgcgcctcagggtcggcgccgtcggccgcgccctgcccaagctgccggcggccggcgcggtggagttcgccaagcagaaggaggccggcgtgttcgacgtggaggtgcggctgggacacggtgatgcagtacaaggggcgcaaggccaagtgccccctggggattcgtctgcccgctccggctgcactccgtccacccggacgtcgcccgccaccgcctttccaagaagaccaaatgcacatcctcaaaggcaagatttcccggtgctagcctccccgcccgcctttccacacttgatttggttggttcatttccaattgtnaaatcgtccttgcccngtgttctccacaattacaataatgggagaacacatcattccttcnaatgncacccaaagnaaaattcccntcccctaactgg

SEQ ID NO: 94653 - DNA, 637 bp, Triticum aestivum
  unsure (1)..(637): unsure at all n locations
  Clone ID: PAT_TA_94653
ctcgcgagggtcttggatgccttgttgatgaagatgggttgtacggcctgctggcttaaccacgccgctggccgcaggcaggcaagtctggggacccccgttcccagaacgtcgacaacatatgtggtgatagggcatgtgtgcatgttcagataaatagagtagtgtggataacctacttaactatataggacaccacaagtgttttaactatcatgctgcaatttgcatcttcatatactaaaaatattataaacaaaaataaataaataatgttaaaatcccacacanttacatgaaattgtgtttcctataatatgcaagaataagcatatagtaagtgaaaattggttaaatatgtttccaaaaaaggattaattaatggattgttattaccctttaaagaataaacaaaagaaatgatactagaaatattaaaaaatatttttttagggaaaatatttatgcttgggatacctttaagaagaaagaaatgaattaaactnnacaaaccaaataagaatttataaggnagaagaagatgacatgatataccttagagaaaaantaaaaggtctttaaaacttcccaacttccaaattgccttctaatgaagtantttccantgtacacttcn

SEQ ID NO: 94654 - DNA, 612 bp, Triticum aestivum
  unsure (1)..(612): unsure at all n locations
  Clone ID: PAT_TA_94654
tccactcagagtagttttgtgacataggcgagtacagggtcgtagctaagcccctgagtgggaggattgctatccactcggagtagttttgtaactttggcgagtacggtgtcgcagctaagcccccgagtgggaggattgctgtccactcggagtagttttgaaagttaggcgtgtaaggggtcgcagctaagcccccgagtgcgaagatgctccccactccggagaatcttgtaattaggcgagtacggggtcgcaagctaagaaccgatcgtatgattgtctccactccggatagtgttataacttangtaatacgggtcnctggtaaccccaaangggatatgcncccaatccgataattttgtacctaactattcaagnccaactaaccccaagtagaggttgccccaaccgganacttttgttactnaggganccggtggnagtaaccccgatggatatgccttanncgggtattcnnaatttggcctnaagtccantaacccaatggaagatgncncaaccgatanttgtactaggatanggtaannaaccccaaagagatgnccaccaatatttgactnggatnantctaagatcccattgagt

SEQ ID NO: 94655 - DNA, 493 bp, Triticum aestivum
  unsure (1)..(493): unsure at all n locations
  Clone ID: PAT_TA_94655
catatgtgcacactattttgtacagtttcatatcacaaaaccaaatgacacaaaaattgattcattcatcttctcaattatatcaattgattccactggatcccacaattcataaatcatgtcgttcaaatcatgtttcaatgtatttcacacacattccacaataataaccgatgctctctgtcacaaacataccaacacctggaaatggatggagcatggggaaggccggcatcagttccggtactccctactgggagtcgtcggtttgancaacgccagttcgcagtggccgtcctggnaaggtggcttcaanggtggacttgctggngcagtcccccccaacgccacaanggttaccggngttccgccgcgttatccgcncatcctcgncggctccgnatattgccagcaacatcttgctagtccccgtggaagngacancacaaaaccggttcgcgtggcnaattaaactggcttggnaccttcattt

SEQ ID NO: 94656 - DNA, 640 bp, Triticum aestivum
  unsure (1)..(640): unsure at all n locations
  Clone ID: PAT_TA_94656
gcgctacgtatcgtcatgtcatgcttagtgttacctctgtttactatgtatttactgtttcttccccctcttctctccggtagaccccgaggccgctgatgccccggtgatcgactacgtcgtcgacaacgacccctccttgccagagcaaccaggcaagcccccctttgatcatcccgatatcgcccattccattctctcatgcttgcattagatttactactgttattgtttgctcctatctgatgcatagcctgcttttgtatctactgttgtaccttaactggctatccctaatccgcttaagtaaagttgggtaagtgattccatccaatggaccccacttgtccttgttgccccaacttcatcattggaaacccgattnaacgggattgnagaccaagccccggnaacgcacacactttncccttaaattgttccacacggctgggtacnacnaatgccaaggtgtgactctanaanattctggagttnaccngtaagtactatccgcctggcanccagggatcacttaacactcganagaancgtctgaaccaaattgaacncggggatccctagtaactnagtaatnatgatttacagggtcccngtttcctngtaaaaattcaggaaaatt

SEQ ID NO: 94657 - DNA, 389 bp, Triticum aestivum
  unsure (1)..(389): unsure at all n locations
  Clone ID: PAT_TA_94657
gtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgccggatatgaaatccaccgtcgacggaacttgcggtgggccctgcaagaatacgatttggtcaangccaacatatattttccncctaaaatgaatanactccaaaccagatagaaagttaaccngccaaactgtttttttttggcaanaaattttacaatatgcggtnttccccccngtgtttttccccccccaaaaattgggttcctgttttnnaaaaaacc

SEQ ID NO: 94658 - DNA, 429 bp, Triticum aestivum
  unsure (1)..(429): unsure at all n locations
  Clone ID: PAT_TA_94658
tacttcttgaatattatcttggggtgcctcatccatccccaagcttagccttttgctaatccttattccctcatccatcgtaatatcacccgaaacttgaaaacttcaatcacacaaaactcaacaaaaccttcgtgagatccgttagtataagagagcaaaccactactataagtactattgcaaaccaattcatattttatttttgcattatatctactgtattccaacttttctatggcaaaaaccttcaaagaaaaccatagaatcatcaaaacaagcacacaacgcanagaaaacagaatcctatcanaaatagaacattcaatagcaatcctgactacttcgaataatcctgtcaccccnaaattctggaaaaattaggacgactntaatattgtttaacnaacctncgccaaaaaaaaaaaa

SEQ ID NO: 94659 - DNA, 452 bp, Triticum aestivum
  unsure (1)..(452): unsure at all n locations
  Clone ID: PAT_TA_94659
gcagcctccatgatcacctcgccgattgtggcgccgacgagcgtgccgtccctctcccgccggggctcctccttcgccgtcgtctgcagcggtggcaagaagatcaaggtcgataagcccctcggactcggaggcggcttgacagtccgacatcgacgccaacggcaggaaggtcggcaagaagggcgtttaccattttgttgacaattacggtgccaacgtccgacggtacagccaatctacacccaagaggaatggctgatccggtgaccgctaccccggcggacaccgcttcctatctgggcgtcacctcgccngctcctccgcggggctctcctcctctanacacacgtctcnccggtaaaaaanttacntntacanaggcngtctctgctttcatnangtccccgtaanngggtactacncctgtnaagtttcatcaacagccaatt

SEQ ID NO: 94660 - DNA, 486 bp, Triticum aestivum
  unsure (1)..(486): unsure at all n locations
  Clone ID: PAT_TA_94660
ggaaatcctcccctctctccctcctcgatcgaccgatcgatctcgaccgcggcggcgatggatttctccggcggggcggggggcgcgacgctgtcggagatgtaccagagcgcgcggcggctgctgctgtcggcccgcnacggcgtggcccgcgtggagcggctcgcctcggcgcccgcctcctcctcctactccgcctcngcgccgctcgtcngcgcgccggacccngcgggcnccgaatgccntgcgcanggaggtggcgcaaatccagggcctctgcgcgcaaatggaccgcctctgggcgctccatcnccngcaaagggccaacgcgactctggaaagagaaaagtggncaactatctgaagaagtcaatcaatttaaggaaacctcgaaaagaatcattggcgnaaacaaaagcggntttgganncaaggaaaggcggagnatttnnaaaactaatgttaatcncnaagtccttaaaattc

SEQ ID NO: 94661 - DNA, 650 bp, Triticum aestivum
  unsure (1)..(650): unsure at all n locations
  Clone ID: PAT_TA_94661
ccggggtcgcggttgccgaccgcccggtcgacggtctgctggacagggtgctggacaggtgttcgctgggaccgggcgccgtcggctgtttgaagggcaacgtgttggagttcttgcgggacngacgcgccgccgacgtnggacgccgacgttggactcggagctggtgcgagcggccggcgcgtacatcnaacgccgcgttnaacgagccgaccgcgcccgcggtgcgtcccggccgggcgatggacaacaacgacgccgctccccgctgctgccgctccctgccgccgccggcgaacaactactacaacagttanagtgacatggaaatnggnattatgccaaganaaatgctgatcccncatangattattaaanatnaactcnaaatctccatccanaatgatgcancttcanattnanggcacaaagngctngctcaanaagggggcaaaagcggggncggntcccctnaaggtttcttaaaaaatccggaaaaccggctgccaaaaactcccggatccgggcaatcgaactttcaattcgcccncccaanttgggcaacgaatttaannnaatctcaatctgaaccacgatatcagnattcccatccaattagggaaaaattnaacnttttntcggttngaann

SEQ ID NO: 94662 - DNA, 530 bp, Triticum aestivum
  unsure (1)..(530): unsure at all n locations
  Clone ID: PAT_TA_94662
taccccattaccgtcttctcaagaccctgcttcgctgccgccaactncnattggnaaatcgtttctccnttnaanatgacnatcatcatcnagnagcctcattttgatgcggcggcggaaaggaaggtccccgggaaccggngggatctcntgctcaaaggggntttnactttccgggntcnaaaccctttcggnnaacctttnaggggactangaccggnttcgngagcggaaaaaaangttggagggantntaaagggttgaaccaaatnaaccaanacttcgatttttcaacnggttncggaacncataagggcggttggacaanacganaatgacatcnggaattcatcngantgctcaacgatttnaccnacaanatnaccccnacttganatgcgcanattttanactcctcnaaaccgccnnagcatcccnaaggatacccaacnaaggacggnccaactaaanggctcaacaagttttgggaangntcgntgaaccaaattcgggaaattccaagnggattc

SEQ ID NO: 94663 - DNA, 278 bp, Triticum aestivum
  unsure (1)..(278): unsure at all n locations
  Clone ID: PAT_TA_94663
agaattcctcccaccctcgccgtctcgccgccgtcaccaccgcagctagataagagaaaaaaagagagagaagaactcgtcgggagggctcgagatctgtgttcggagaggggaattcttgaggtcggaatcngaacaagcgggcgcgctcgggatntgggttaccatacaattttcccaaggaacctttattgaatgtgctaaatggagtcanaagggtggcaaaaatctancaataagcattccctgatgtacgaantccctcngganatacattg

SEQ ID NO: 94664 - DNA, 155 bp, Triticum aestivum
  unsure (1)..(155): unsure at all n locations
  Clone ID: PAT_TA_94664
ttactactaccttacttgctcgttacaaattatcttgctatcaaactactctattacttacaatttcagtacttgcagacattaccttgctgaaaaacaacttgtcantttccttctngccccncgttggnttcgagaacnaatacttancaaaa

SEQ ID NO: 94665 - DNA, 304 bp, Triticum aestivum
  unsure (1)..(304): unsure at all n locations
  Clone ID: PAT_TA_94665
tttttttataaagatggtggtctgttatggaaggactccgaaccagaacgggcccatggtgcagcggcctgttaaccttccaccgttggaagcggacagtgagcgctgctctgtgaaaccagcctaacgcggtgcctgtcacttcaggaacagagaggccgaagctttcgcaacaaccccccaacccactaccaactttggaccgggcaagccancattttcaacaccaacccaancccanatccgcaacaaacattcaacancaactttaaccccccacatggggaaccctccgggggggggg

SEQ ID NO: 94666 - DNA, 592 bp, Triticum aestivum
  unsure (1)..(592): unsure at all n locations
  Clone ID: PAT_TA_94666
ctccgccccattcccccaaagcctcgactcgctcgctcgatcccgtctcctgcccacgcccggcctcccccgaggagatcaggccaccgtgcggtgcagacagggctcgccggccgtcctcgcgcgcgcgggaccgtctagcgtctctcggctccgtaggcgtcatggcgcagcgggacaagaaggtggagggagccgacggaggtgcacctgcacgccgcggagattacntctgcgccaacagtgcggttccccgggcaacccggcaccaaaaactctgccaaaatgttcctggcncctcctcctcctcgccntcctcctccgccgctcaacgcncccttcctcctcgcccgcggcgcttcccgtctttnacaaccgaggcngcgccgcgcttnccgccgcccgtctaatggcttnacngctccgccgggccggggcccaagntcnatctcngtnacgctcanaatgcggaancttggctganggtccctccgtcggaattctcggccacgtatggacgganatnantacaaaaattggggangaccatccccgaaacctttgngcncaaatgcggttntacaataatcga

SEQ ID NO: 94667 - DNA, 657 bp, Triticum aestivum
  unsure (1)..(657): unsure at all n locations
  Clone ID: PAT_TA_94667
aaaaaaacaaaaaaagtgttttcaaatttgaaaataatggcactaactgaaagtatataattttcctaaaactaaaagcaaaaacaattaaaaaataaagcaaaaaacaaaagaaaataaacaatgcagaaaacaaaagaagaaacaacaataagtatttttttgtaagtagaaacaaaataaaataaataaagcaagaaagaaaacaaaaaaacaaaaaaagtgttttcaaatttgaaaactaatggcactaacagaaagtttataattttcctaaaactaaaagcacgaaacaattaanaaataaagcanaaaacanaagaaaataaataatgcagaaaacaanagaaaaaaactgangaaaaaaaataaatatagcaacaataagtgaagaaaacacaaanacanancaaatgcctcctactgggccccacggctgaatacgactagaaacctactatgggccaagatnnagccgcagtagccangaaggccatcaggcaagnactagcaagtagccgaaagcncgtggacangactccacanggtgcggaattggcttataacangngcccctccgacacnaggggactaacttgncccagcngcanacnagncctngcnttgtncacccnactannggaggtnctctccctt

SEQ ID NO: 94668 - DNA, 568 bp, Triticum aestivum
  unsure (1)..(568): unsure at all n locations
  Clone ID: PAT_TA_94668
ttttttttgaatcatgtctggttgctctcttcagatccatggtgtttacttttttgttttcatttctaatcaaataattcatctgcacagcacacaccgaccgagaacaagtacaatttcatcccatccgggcagcttaattagcttgccatggaaacgtgagggaaatctacaggcacatatgcttcngtgccgcctggatgccgccctgcccggcttccgttacgcagcgccaaggtgcatctggatgcctcctccgggtcaaacangagcaccggccgggagggacagagacattccaaaatacagctgctgtttccttcaaaattcaaatcttgtgggtttnnaaacaatactttccgcgggccgggccggtaactcnccnaaggaaccttccctggnangcctcctgcccacggggggatccgcctccgccgtnnactcctgcaaccgcccgggcggctgcctngcgccaagggtcnaagngatctnncctgccnggatcctccctgaaaaagggtttcccccgttnagaanacttctgtcccccccaacggntngggnaaac

SEQ ID NO: 94669 - DNA, 234 bp, Triticum aestivum
  unsure (1)..(234): unsure at all n locations
  Clone ID: PAT_TA_94669
cacctcctcagagtcgcgtggngggaagacgagancctcccaaaggccaangcccatancccctaacctagggtttcgccgccatgggatccgccgcctccgccgcctccgacgcagcgccgccaccgccttctccagcgcaancacacggggccgcgccgccgatatngggttgggctcgccggcatcctcccncannagccggatggggatgattcagaacgaggaganggt

SEQ ID NO: 94670 - DNA, 546 bp, Triticum aestivum
  unsure (1)..(546): unsure at all n locations
  Clone ID: PAT_TA_94670
caccaaccggggactaaaaggtccagacgaaccgggacaaatggtccacgtggcccctgggcgcacgaaccgggactaatgcccccattagtcccggttctagactgaaccgggactaatgggctaacccggggtggaccaaagccctcttttctactagtgcagcgtggctcgcgaccggccgaaggttcggccggttccccggcctgaaacgtttccctttgtgattgcctagcatgtcgtttgactgttagttacaaggattacgtgatatcaatagagaacatcacacgtgaaattttcctacacccatggcgacaatatttgatcattttgctaacttaatggcgatatggtgttcaagttaataaccctgcggtgggaactcctggaggtgttaaacatataanaagattaatatcatcatatncatgggaataaattanagnacanttcaagnctgaaatgnncccaancaaggtccaatgggaattccacgacatcanactaatttggagtggatacgaanaatgaataaagacaaca

SEQ ID NO: 94671 - DNA, 470 bp, Triticum aestivum
  unsure (1)..(470): unsure at all n locations
  Clone ID: PAT_TA_94671
cgaagatcgtgctccgtgtgctccctctcttcttcagctccacgatcgcgtacgtatccaacgtgatcgtcttcacgttcaccgtgcagcagggtggcatgaccaacacaagtctgggcaaagattcacgtctcccccgcgacgctcttcatcatccccatcacattccaagctgataatgctgaccgtctacgaccagttcatccgtgtcttcctgcgaaaagcgcacgggctacgttnggcggnatcactcatctgcaacgcatcccataagcttcnccgncatgataccccccgccgtnantcgcacgtnttggnnaaaaaaaaagggaaggaacttttatggaaatttcccgttncnggtnccgcccaatnntcctggcntggggtggnaaacttacnncnttaaccgggtccccggagtttttaaaaaanaagngccacgggcaanatccatttccaagggtttt

SEQ ID NO: 94672 - DNA, 464 bp, Triticum aestivum
  unsure (1)..(464): unsure at all n locations
  Clone ID: PAT_TA_94672
cggctatctcctctacggcccgcccgggaccggcaagtccagcctggtggccgccatggccaactacctccggttcaacctctacgaccttgacttctccggggtctacgacaactcgtgcctgcagaggctgctcatggacatgcccaacaagtccatcctccgtcatcgaaggacattgactgcagcttcgacaccatgtccagggaaaaagacggcaagctacgccaaggcgaccgacaccgacaccgacacagacgaagacggcgacgactacgacgacntcngagcaagaagtacttccgggcctttagcgcaacaagattaatcttcnggctgctcaacttcatcnacggctgttggcnaacgaccggcgaagacgctcatctcttaacaacnaataanaaggacgctnnaccgggcgcttctaaggccgggccncatggaatcaatnnaaatggaac

SEQ ID NO: 94673 - DNA, 667 bp, Triticum aestivum
  unsure (1)..(667): unsure at all n locations
  Clone ID: PAT_TA_94673
gttttaacacatgtacagtgatggtctctagtccaagtgcagctcctgagcttttgccaaacctgtcatctgttgtacaattatcgtttgggattgggacaagccacaagcccacatcaagttacgaacttgaagctctctttgtttgttacgccgactactctgctacacatcaagttaagaacatgaacatctgtttgttacacatgcacaatctggtgaaacatgggtgagttccggtctccggtggcctcgatccggcgattaaggaggcccctcaaacatcttttgagcccctgggttcaangctgcacgacctaaacagctgagatttgggagccngtgcaaaacacgcctggtctcccccgggagccctccctcctcctgaacctcctggggaaantcttcctgggcnacggctaggttggattctaanaataanctgncctccatgggtataancacaaaactaggacacggcgggaaaatacgaccaacatggtgcnaataattggtgccgggtcnatggcaantccanctcacgtctcggaatgggtgntcgccncgtanaaatagacaaactngnctcaaactcctcaccggatttacgagncacaaggcagcctttnattganccccttcccnggaacggtntaaactttcagaa

SEQ ID NO: 94674 - DNA, 622 bp, Triticum aestivum
  unsure (1)..(622): unsure at all n locations
  Clone ID: PAT_TA_94674
gctctgacccgagtagcatggggcacgtggaatcccgtgtgaatcagcaaggaccaccttgcaaggctaaatactcctgggtgaccgatagcgaagtagtaccgtgagggaaaggtgaaaagaaccccagtgggtaagtgaaattagaacgtngaaaccgtgctggactcccanaantttggagggaaaagtnnnatttcctgaccgccttcctgtttgaaagaatgaacccggcganccaatagcnagtggtttngttaaaggaaccggaccaaccggagccgttangaaagcganccttaataaggcattgncactgcttatgacccnacttgggtgattatccatgacaagatgactttggttgaactaancaaagtcccaaccacgattttnaanacaacgatattttgtaggggnaatcatccaaccaaactactgtcccccaangctttaggganaatnacggcatcanggaaanatgttcgtcgctccaacgtacaatcaggaancnatcaanttgccaaatanagggcagncgcataacatggganacttactcanganaccgttacatagcctatccccataaagggggggnaancagttcnaacnccttnan

SEQ ID NO: 94675 - DNA, 263 bp, Triticum aestivum
  unsure (1)..(263): unsure at all n locations
  Clone ID: PAT_TA_94675
ctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatnctatccgatctaactaactaccataccatgttacccgcaacctgattcaagggctttatgttnngcaacctgacctggcatcagca

SEQ ID NO: 94676 - DNA, 603 bp, Triticum aestivum
  unsure (1)..(603): unsure at all n locations
  Clone ID: PAT_TA_94676
ccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcggccaccctcctcgtcgccgccaccgccacccacaaggcgagtccggcgggatgggagatggcggcggangatggcggctgcggctncacccaattcaattcggcaccanctgcggctgtcctggctgcagcttgctagatcatttgatcatcgattaatgcatgcaccgcgcgcatgcatcatatctatgatcgattcaatccatccatctaagtacaatgttacgctactgattnanggcttgtatgtatgttaagcacttccaacatnagcaaacaagtgcatcccatgcatgttaaccgacctaaanggggggcccgtaccaatcncctatatgatcctataccccgctaatgggcgtcgtttaaactctgactggaaacctgggtnccaacttacncttanaaanccccttccaantggtaaacaaangcccccnttcctcaaattccactangganggg

SEQ ID NO: 94677 - DNA, 671 bp, Triticum aestivum
  unsure (1)..(671): unsure at all n locations
  Clone ID: PAT_TA_94677
aaaaataatttatttatttaaggttttagtatttattaaaaattaatttatagatttatagtttaatagtattgtgaaagaaataattaaattttaaaaagaattaatttagtaccttttgtatcagggttgattaaaatttttaatttttttttaaattctcaaaatttatagagttaatttattattaattattgggttataaatatttataaaataatattaagtttggaaattaatcccntatatatattaagtatttnaagatttaaatttaatttaaaaattttaaaagtatttggattttgggtggattaaattttaaatttaattattttaagggatagctggaatttttaanatataatttattnaattttaataatttaatnggaatagaatttaattaaanttgggaaaatttatattaattaattttnaattaataanaaatattataaccaaataaattttattaanggatattaattaataggaataangttaattagnataattacattaaaatangatcggaaaattattcaccgntacaaaaccatgataagtaattaaaagggtcgccangttataaaccggngnnttgcggcaggacaaaatncccttatgggcttnaaatttggaaaacctttntaaataattttttagaa

SEQ ID NO: 94678 - DNA, 528 bp, Triticum aestivum
  unsure (1)..(528): unsure at all n locations
  Clone ID: PAT_TA_94678
ttagagcttcataggttttcgcttttctattaataagtactatgtcttgctttgctaacttgtaatgaaagaacaaatgaataatgcatgttatgctgcttatgcagcagggacattggacacgttcacgcgaaggaggcttgcttgttgcgtgtctgcggatgggccgagagcttggacagcaggaagaggccggcggaggaggcgagcaccgccccggcgaagcaggcatgtcgangccggtgacgagcggacgctcttgaacttctccnaggaccctgcctggagcaacaggatgacggcgtngccgacctccacttgggctgcntgacggaccggttcctcgccccttccttnaccncccntaaatgggtccctggacncctggancctttaaangcctncancccaanccgaacttacaaggcgngccgnttaggaattccaagcttccataacactngatatncgggtgatnacntctgcanatgaacgaangnaggaaacatgananatcaaacccccggg

SEQ ID NO: 94679 - DNA, 613 bp, Triticum aestivum
  unsure (1)..(613): unsure at all n locations
  Clone ID: PAT_TA_94679
gtcactatcaatatcttcagcttccaattcagcccgcaagtcttcatcatggacaaccacacttgtccttcgagtgtaaaagatattagagccagcaggaggactagactcactgaaatcaccacgagccctccttgaaagatggcgtccactttagaccatcggtccgcgccaacggcctcatcaacatggggaccaaagttagtgggttgtcatccgtccatagcgtcatttttgatgaaccaattcaagcaattacatcaacccaattcattatcccattgaattcttcccaaggataagngaataccccctttccttttgnganccttgccccgcntannttttcaaaccaantggnattgccggttgtatgaaaatatcacttgttaancccttanacccaaacgttcccctttggggaaggtntnagaaatganccattcgccaaaaccagacaagacaacatnacaagacctttgccaaaatggggggcataacaagcacatatgcatcacaaagtaagganctttcccgcttattcattctggnaaaattcccccgtaccaaaccacancatttcttcnggttgattnaacggacatttcaaaat

SEQ ID NO: 94680 - DNA, 643 bp, Triticum aestivum
  unsure (1)..(643): unsure at all n locations
  Clone ID: PAT_TA_94680
cctaaaccctcgtcccaccgccgncgaanccgacatggtcgtcnacnacctcctcagccgcgngatctctggtgggtctcccttcnaccctcagcggggcctcctcctcgtaacgcaggagctcgggcngcntnaggctatctcggaggcggccggggaccngtggctgagctnacaggcgcgcngnaggacgtcaagcaagntgccnanggagaaatcctggcatccnacctgntctcntggggttggatnacgcngngacttatnntaagaanattagcgacgtggaccanatgtggnaanagctaatngnacttgaagtttgnaattgantaanacatccgctaatnctgnnctggtgaangctttgnaattatcatccatcaanggaaatatcatgtgttacttatcgggtttgntcaactgccatnctcaccgttnaggtanncgtggnccaaaatccatatcatgaaggntaagttctccctgacagtncacaaaggaancccgcngaggncnctcactgcgaattcaaatttncaaaggctaannaagaatntgatgcagaatncnttgnataaacaaaccaggtggnaactaaaaaaataaatgncgnaatgggcantgnaaaggcanttaaaat

SEQ ID NO: 94681 - DNA, 656 bp, Triticum aestivum
  unsure (1)..(656): unsure at all n locations
  Clone ID: PAT_TA_94681
ctgcgtgcgcgtgtgggtttgggtgtttgcgagcttcgatttgttctcccgctctagctagcttgctcgcctgcttgcttgtttctgagtgcaactgctggtttgggatttcactgcgggagtttgttcgtttgttcatcttcattccacgattggagccctaacgctttgggagttttcttcttccccccagttcttcttgtccaaagttcaagatcgatcccggcaaggcaaaagacacacacacacatatggaatagtgaggggaaattgctgctaagtcccaacaccaaggctaccaaaaggaaaaattccctggttgcccggtgagcaactgaaagggtgaatcctgagcggcgatggatcaattcaatccggcggcggtgtcncgggctgttccggattaaggaaaggaccaacaagacagattaaccgctgccnccaacacaacgcacanngcccggcgccaaccgtgttnaaacggggcaaacaagcggcncggggngcacgtgaananaaaggcaatcaaacctaccgagtgtnncntcccaaacctatgnacaacgntctntcaggntcanagggtcacggaaaactnattacggngnaaactcntgactanaagccacagnnagggggtncttccgncctntaan

SEQ ID NO: 94682 - DNA, 548 bp, Triticum aestivum
  unsure (1)..(548): unsure at all n locations
  Clone ID: PAT_TA_94682
caacatccaccacacgagacaaggaagagtagcatccatggcgtgcatcaataccttgcagagctgctccatgttcaaaggggccaaggctgaggccagaaggggcaaagccaccggcgcagggagcttcgggtgccgggcgtccacgttcatggacgggagcgggtccggtccgggtcgacgaaaacccgacgcatcatctccggcgagtggccgaaattttccctccctcaagtacgaacacttccggcctaacttcnattcccaagcaacaagcaagcagcagcagcactttcccangctgccgtttaacaacgggggcgtccttgcnccaggcattntaaccccttctgatngcanaacnggcaagccttgtgaggtttnaagaatttantcctgtcaagccccgtttncaaaanctcccaaatcttcgggcctcctnaaaacantccccanggtcacatggcaaagngaanatgcagttgatgaattcacaatcancttatcataaacatgacgatncgactcnatgccaaganaaatcaann

SEQ ID NO: 94683 - DNA, 553 bp, Triticum aestivum
  unsure (1)..(553): unsure at all n locations
  Clone ID: PAT_TA_94683
gagtgtgttctataagaaacttgcttgattttgcatgtagttttatactctcatgttgcatccttgtttttaggtgtttgcttgatgtttgaatgcattttgcatcaatgccatgtttaacttgttttgctcataacttctaggccgtagctccaaattaaatgaactttatatgtaacttgactaagaactccgtgtagatcatcttggtgcatcttaacttgctgtttaacaacttggaacataaggttattcagatccgggacaattttgaaacttgcataatgangacttaccggatggtaaaagttgttcccggccattgaactgcttgatgtgttgccctccaancacatacctgccagatactcaaagtacctggcaagcacatactaantgggcacnagcctgtcaagtgtggctgacaantggtacaanacccnacgacctaaggacccttgatgatctgtaattggcgtggtgagncanaanaaacggtttggagccagtanacggagataggaatctttatctcgccctcgnccccggngag

SEQ ID NO: 94684 - DNA, 202 bp, Triticum aestivum
  Clone ID: PAT_TA_94684
ccacgatcatggggtggggagaggtcacttaacccgtcccctcggttctgcatgtccgccacgcgtccttcatgcgcctggggtggcaagcggtggaggcgggaaaccgggccgtcgctggttggggcagcgggtcggtctcgatcccctgggcctctgggtgtctggattggttgagcgggccggccgacctccgtccccg

SEQ ID NO: 94685 - DNA, 179 bp, Triticum aestivum
  Clone ID: PAT_TA_94685
ggaacacccacctcaagaagaggctggccaagatggggatcgaccccgtcacccacaaggccgccagcggagctcctgtgggcaccgcagatgacgtcagatcagccaaggccgcggcgagcctcagccacatggcccagtgggagagcgcccggctcgaggccgaggggcgctggtcg

SEQ ID NO: 94686 - DNA, 628 bp, Triticum aestivum
  unsure (1)..(628): unsure at all n locations
  Clone ID: PAT_TA_94686
accgcgtcggcgtcggctgcatcgccgcctcctgcctcgactgcgaccactgccgccgctccgaggagaactactgcgacaaggtcgcgctcacctacaacggcatcttctgggacggcagcgtcacctacggcggctactccagcatgctccgtcgcgcacaagcgcttcctccgtgcgcatcccggacgccctcccgctggacgccgccgcgccgctgctgtncgccgggatcaccgtgttacagcccaatgaagcaacaacggatgcttcaagctggcaagagtccgggtggnccggnttggcnggttcggcaattccnttnaattncggaagggttcnggttaaagnacctttattaagaattccccggcaagnaccggaaggcagggaaaactcaagggcgaagatttntcctcaagaacnnncaaaaacaaattcaggcaaggtccngacttgacacttntnaanaggtttcggggaananccctggggcaaccngnactgcnaangggaacggaaactgtgctgtggggcccgnaaaccctggnntgcntttccccaatttgnaaaggcgtangggaaaaaanggntttngacccanaatnnctttgggaaagaaccgtaa

SEQ ID NO: 94687 - DNA, 392 bp, Triticum aestivum
  unsure (1)..(392): unsure at all n locations
  Clone ID: PAT_TA_94687
ggtatattccttggccgttaatttacagtatatgggtaactaattcatttacatatttgcatcttgctggccgggcgcacaagagatctttaaaaacgcctcttgccgtgtacaagagctcccacgtccgcgtcacccaatctaagcgtcaaacctgatcttacggagcagcacaatggtcgagaaacntctctccaacgccgtgcctgaccgaaccgggcggccgcggtcccgggctccggaaggcagcgcgttngcccgggccgtacnccttaccaanactgggccnttcccaagtccgcgcccngacgccgcccggcctcgccgacgcctggcgatctcacccgncgggncggtngcactcccggtcctacgcgcgcgtctccggattt

SEQ ID NO: 94688 - DNA, 452 bp, Triticum aestivum
  unsure (1)..(452): unsure at all n locations
  Clone ID: PAT_TA_94688
gtcanacgcaaagannacaagcgcaacaagtagggttaggagaggaggagtcggcggnggnggcggcaagcgagagcgggtcgtcggnaggaaccgccctcgtcgtcggagatnacgggcaaggcgaancccnanaagcacacggncanggagatcgcggcgaagatcnacgcggngacgaccaaccgcggcgggggcaaggccnggcagaangaccggctcgggcangagaanggcngncacnccaagatggcgtgnccgctctgcaatgtgacggccccggtcgtcaagtcnatnccagatccaccacnangtncgccacccaangctccccttctacaccgacaagatnatcaccctnnacgctccaccgncgcngccngcgccntcnncgccgtcggtncacntccangcccaaccggaancccggatcntcnatcaaganggcgatt

SEQ ID NO: 94689 - DNA, 582 bp, Triticum aestivum
  unsure (1)..(582): unsure at all n locations
  Clone ID: PAT_TA_94689
tccaaaaaataaaaatatacttgaaaaaaggaaaaaaagttaagaaaaaatggaaaataaataatgaaaaaaacaaaagaaaaaatagtaaagaataaaaccctatgatgaaccttctagaaggttccaagttagaaccagggctggaaccttcgagacggttctggaaccaaaaccagcatacacatcaagtggctaggcccaacggatcgctagctgccttaatgataagcgtcatataggaaacccccctacggggtgctgtttttagcaagacagaagaacgggacgtcctataacacgctttaaccgccaattactggcgatttacaacaaccctggggaccccctggatttgaccgtacactaatcaatgcacgcaaatgtgtacatnaaagacaaggacccacgggaagtncacagcacaactctaaaacataaatancatacaanatcataatacaagcaagntccaagggggggcccgtaccaatcngcctaaantgatcgtataccgcgcncacgggcgtcgtttaaagtctgacgggaaaacctgcgtaccaactaatccctnagnaatcc

SEQ ID NO: 94690 - DNA, 492 bp, Triticum aestivum
  unsure (1)..(492): unsure at all n locations
  Clone ID: PAT_TA_94690
gctaagcatcagcattcagcagcaccagccttctacctcctctgctttgcattccgccttccagttccaattccaaccgcaatcaatggctgccatgaagatcgccctccttgccgtggccgcgatggccgtcttgctaggcaccgcgtcagcggtaacctacaacgtcggcgatcagggcggttggaccctcaagcaccgactacagcagctgggtgtccggcaagaattcaacgtgggtgatgaattcgtcttcaaagtactccgaccccaacgcacgacgtggtccangtcaacaaaggccggtacgatcctggcagcatcgacggngccatcaacacttggctcccggcaacgactatcacctcaacgcaacngaaccngtattaaccgtggcgtccctaacaatgcacccaacgcggcgcaacaataagncntgatcaactcgctccgggtctcccgccgtcgtnaccaatgccaactgaagcctgg

SEQ ID NO: 94691 - DNA, 589 bp, Triticum aestivum
  unsure (1)..(589): unsure at all n locations
  Clone ID: PAT_TA_94691
gttatgttgaaagtcttcaggtgaatgtcctcatgacaccacctgtgaagaataggaaccccagatcaaactcttcatatcgacctaattcttcatatggaccaagtcctcatatggaccaaattcctcacgtggatcaaattcctcaaatggatcaaagttctcatatgatcatcatcgtgctaacccttctgtttcgcagggtagagctaagggctatgaatatgcacattattcttcaaaaccattatgttcataancctccgaaagaattctcctgcttattcatatgcttaccctaaccctccttatgaagaaacgaaatggtttggcttctaanccacatcccnntgtgggggtccccaaagtggatgatccttgcaccccttcaaatgtgggtnggtgaagaaaaaagatanctcttctgcangncaagnctccaaaactgcttaactctgaagatttcnggggactgacaantcctgaaaagaccaagngatcatgatgaataaantcaccgtctctacgcanacgttacgctgagaatcactgagaacttaacaatctcatgtgacatatgagantgagt

SEQ ID NO: 94692 - DNA, 235 bp, Triticum aestivum
  Clone ID: PAT_TA_94692
cgcggttgcctcctccctatcggatcgggagcaaggatcggatcgagagtaggggttagattgctttttgtttttagatccaaggatgtgtgtatgtaattttttttcccaagtcagctccttacagtccggttccatgtgtcagaaagtgattaaatgggctaaatcacctgatcagtgcaatttgcaaaaagtttactaagaaacgcggtgatttttgcacaaaaaaaaaaaa

SEQ ID NO: 94693 - DNA, 300 bp, Triticum aestivum
  unsure (1)..(300): unsure at all n locations
  Clone ID: PAT_TA_94693
atcggtggtantgctacangcgagtgacactanttcttgcaccgatnagntccancttctgcanaggatgctgganaagctgtgggacgacgtggtggccgggcctcgcccggagacgggcctcgacaagctccngccgggccgccgncacccaanccctcgccatcaacacagctgcaggggaggcgattaancantcgccgtcgatgccgacngancccgatnangccggtgacgccgtcgtcgtccacnccnccgcacgggnggcantgcgtgngtcngcncggttttccaccccgg

SEQ ID NO: 94694 - DNA, 333 bp, Triticum aestivum
  unsure (1)..(333): unsure at all n locations
  Clone ID: PAT_TA_94694
ctctctcctgccataatatcatcgtggcctctccctccctccatcctctctgattgcccccgcgctcgccatggaggccgccgcgtccacgctgctcctctccgccgacgcgcccctcgccgccggncgccgcctcnttctcgtcccttctcggnccgcgcgggnanggaggggcgccgcgcccagcaggtgnccncgggcgtcngtcnncgcgtangccgcggcgtcgagcgnggngcaccggtctntggaaanggactcnccgggaataacaancntggntacactgttngtnacttcatgatgaanaagggangatctncatgtcgttca

SEQ ID NO: 94695 - DNA, 229 bp, Triticum aestivum
  unsure (1)..(229): unsure at all n locations
  Clone ID: PAT_TA_94695
ntatttcgnagctatgacnacttgcnttttcntccatttaaaccgagttcanccataggatattccancatcacatcccaatccatgtcacaaagggattgctgcatcaccgacnaccgaccgtgnaatnactgaaatcanaacanatgttgtttcttcctcacgtattgnaagatctaattantcccgganaganccnacantcggatntcgcnatcaannaacacca

SEQ ID NO: 94696 - DNA, 605 bp, Triticum aestivum
  unsure (1)..(605): unsure at all n locations
  Clone ID: PAT_TA_94696
atcggtggtagtgctacaagcgagtgacactagttcttgcaccgatcagatccaacttctgcacaggatgctggacaagctgtgggacgacgtggtggccgggcctcgcccggagacgggcctcgacaagctccgccgggccgccgccacccaacccctcgccatcaacacagctgcaggggaggcgattaagcagtcgccgtcgatgccgacgaccccgaccacgccgggtgacgccgtcgtcgtcaacgccgccgcgccgcggaacttnttgcngagcgnttttcaaccccggggagnaacctggcnaccaaaaacntcngggcaaactcttntaacgcccggangcnaactcccaacgtttnacaacnggttttaaaggaacaanacnaggacaaggncaacaaccgctaataaaaccctccggcaaaananctaaggnaggggncaaaaatttttcnaanccccangttgccggcttttggtancaaaccngcttactacttgctgtcgaaggtcaatgtnggtgnctcaaantctaanacgtcacaaangctgtaacttattcttgnncgtangccnctgatgcaacantgatgttnttt

SEQ ID NO: 94697 - DNA, 608 bp, Triticum aestivum
  unsure (1)..(608): unsure at all n locations
  Clone ID: PAT_TA_94697
tcagcttgaattcagcacgaccagagtcatcaagggagcaacattagcggattttgtggtagaatggacggaggcaccaggcctcaaggccgacgaggatcggtccctctccccgagaagcgaggcgccagaaggctgggtcatgtacttcgatggggcgttctccaaggcatggcgctggggctggggcagtgcttatatcgcccactcaaggacaagtctactacgtttgtacaactcctgtttccaagcaaggtgaaaagnctcccaacaacataacgcantttgaangttttaataacnggttttaangccgcagctgcccctgggggtggaaacgcctcancatcaaaggggattcgtactccttggtcaatttctcccaacaaggtgtnacagccnaaagatnacacatggaacctactttccggaggcccgcangatggagaacattctggnnntggagttncaacaatgtgccccatggacaacaaggaaggtgacgaatcnccaaacgggtcaagcgtacncaagactgggtctcaagaaaggctnaagcctaaccgcgtatgtaaaaagtaccncgagagtccacactgctaggcccg

SEQ ID NO: 94698 - DNA, 622 bp, Triticum aestivum
  unsure (1)..(622): unsure at all n locations
  Clone ID: PAT_TA_94698
gccgcctcctctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggctttcaagtacgcctgggtgcttggacaagctgaaggccgagcgtgagaggggtatcaccattggatattgccctgtggaattccgagaccaccaaagtactactgcaccgtcattggatgcccctggncacccgttgacttcatcaaagaacatgattacnggtactcccaaagctgactgtgctgtgctcancaattgaccccacaacgggtggttttnaagctggtactccaaaggatgggcaaacccgtntagnacgcctccttgcttcaaccttgggagtgancaaatgatctgctgctgcaacaagatggacccacancccaagtatcaaaagccgttataagaaatgtcaaggaatccctcgtactgaaaaagtcgntacaacctganaggttccntcgtccatcncnggtttngg

SEQ ID NO: 94699 - DNA, 476 bp, Triticum aestivum
  unsure (1)..(476): unsure at all n locations
  Clone ID: PAT_TA_94699
ccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccaagtgcaagtgcggcaccaagctgcggctgctccctgctgcagctgctagatnaattgatcatcgatnnatgcatgcaccgcgcgcatgcatcatatctaagatngattcatccatccatctaataccatgttacgctactgatncaaggcctttgtatgtatgttaagcacctggcaacattagcaagcaagtgatccccatcatgttaaccacccctaaataactcccgttggtttaaccaannn

SEQ ID NO: 94700 - DNA, 217 bp, Triticum aestivum
  unsure (1)..(217): unsure at all n locations
  Clone ID: PAT_TA_94700
aaggaaggcgtcgntgcntcaggaagggcggccaaggggaatggtgtttaccagtttgccgacaagtatgnancaaacgtnnatnggtatagcccgatanatacaccanaacaatggtctccaantggtgacntttacnntgntggaaanncagggctgtttcnctgggcagtcantctttccggaattctgttgngnggtgctcttcttgtcnaca

SEQ ID NO: 94701 - DNA, 509 bp, Triticum aestivum
  unsure (1)..(509): unsure at all n locations
  Clone ID: PAT_TA_94701
aagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgangccgccggcgncaccctcctcgtctccgccaccgccacccacaaggnnagntccggcggcatggagatggcngccgagaacggcggctgcggctgcacccantgcangtgcggnaccagctgcggctgctcctgctgcacatgctagatattgatcatcnatcatncatgcaccgcgcgtgcancatctatcnnatcgatctactaccacaataccatgtancgctacctgatnanggccttatcaatcacctgactgcataacaatcaagttcatgccatgcttgttgtaaaanggcccctaaanaaaatcccctggtttactaanaaggggggccgtttcaatttgcctatantagtcggatt

SEQ ID NO: 94702 - DNA, 628 bp, Triticum aestivum
  unsure (1)..(628): unsure at all n locations
  Clone ID: PAT_TA_94702
ctttcatcgaccgcaaacatcaagacatatgcgagaaacataacaccaatttatcaatcaactgctcaaggctgcggaagcagtaacacactcacatacgaaggtactaaacatatacattgtcccaagcaaaatagcacgaacttcaggtctctagatattatgcaggcgctgttgtggcaggccacacacgacagataccaaggtaaaagntnaagggggggaaagngaacttgacgtgctttagtccgaacaagactggaaaccatgtcctcatcaaatcttccttctccttcaacttctcctccttctttgaccaacaacaagtgctgcggcacaaccaaatgcacaactggantccccacaacaatgggaccccaactggaagnacaacggcaantctcccttccaanatgcancacttcngtgatgccttgcctttgattcaacaaagaaggatcaactttctcaacaagctcaanacaacngatcaaggtttctgactcagcggactggggaaaatcccccaaatagnaaaagnagctgcatactcacgtgaactagaacactccaatccagaaaaccaggcgcgcgagggttctctggggncgtncattcccaatagttt

SEQ ID NO: 94703 - DNA, 624 bp, Triticum aestivum
  unsure (1)..(624): unsure at all n locations
  Clone ID: PAT_TA_94703
ctcgtgccgaatttaccagataggtattgaccgctcgaggatcaaacccactaataacatcttctaaaagatgtcgtcctaggtgcaaaggccaagctttgcaggccaaccaccctggaggttgtcttcggattaccaaacaaacacgataccaaagagcaatctttgggcattatccccttatacagtgactattatatactaccaaggacgaaccgtgttggtccgattcaacgcggtgccacaccatgccaaacccatgtgacatgggtcacagtttatgggcaaaggcccgaactccaaccccgaagagtgggaaatttataccgccgctgagatagcgagttgtgccttccnaccaactttgattccaacatccaaccccccnggacacccacagaggantccgactactttnacgcatgatacccngnacgacaagattctatcaaggacccttngttnaacaaccctatgaatgcaacgctccaaacattttcttaaaagcccaatttgcgcaaaacaggacggngacatgganaaatcggcccacaagngggacaaaaantcccccaaggaagatcagtaacnttggttgaaagctccncgttgcanatagttcca

SEQ ID NO: 94704 - DNA, 188 bp, Triticum aestivum
  unsure (1)..(188): unsure at all n locations
  Clone ID: PAT_TA_94704
ggcttctcctccccttccggttcnggttctggttcngttcgggtccgagagtanctaagcctantctanggtttccgtagttcngagagganagaaaggnatagatcaatggcggagacagantaccgctgcttcgnnggcggcctcgcntgngccaccnacnaccanaacctccattaggccttcat

SEQ ID NO: 94705 - DNA, 234 bp, Triticum aestivum
  unsure (1)..(234): unsure at all n locations
  Clone ID: PAT_TA_94705
ctctccctctcacacacaaacacgtgcacaaacacacacagacacgcacaaacacccatttatctggatcctcatctctcctcatgtccgcatgtgtatctcacacactcactctctaattatgtatatgtgtctccacgttacacaacacaaagccccatgtacatgtctctctctatcctccacacacattgnacacananaatctattntcattgcctcantnctctaacn

SEQ ID NO: 94706 - DNA, 588 bp, Triticum aestivum
  unsure (1)..(588): unsure at all n locations
  Clone ID: PAT_TA_94706
ataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccaagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcnaggacaaggagatggcatggcatggatggacctaatgaaggacactaataatatttatgcatggtgtgtgctttgtgttctccttttttaattgccgccgagaataaacgagatntatcctaccntnnccttatcntatcgactaatcaatggcccttgtggcttgtacgtntggtgtgcaaagcgcgcgtactccgtgtccgtnacgcgcttttcctaatggtctaaactccgtccgtgcctccgttttatcacatatatgtgacaacataattgagttccncatgtaaaaaaaaaaaa

SEQ ID NO: 94707 - DNA, 588 bp, Triticum aestivum
  unsure (1)..(588): unsure at all n locations
  Clone ID: PAT_TA_94707
gccatcgactcaatcggtcggctccgatggtgtcttccgtccccgctgttcgccgctgcaagcgatccggtcggtcgctgcttcagtggtgggtgaaacacgtggtggctcgatgttcggccacccattaagtcgcggcaattgagcaagacgaaactctccacggcctgttcgatctgtcgactgggctccgcgggagaccccatccgagtgcgatagtagcgaccctgcggctgaatcttgatggtccatagactcgtggtccactgggttccgtcntgaagacacgaagatggtggcggcgatttcgtttcgcgtccatgnnggatacatcantgacctttcttctcaagcaaaaggaaaatttttcgccgcaanagggtgcatccaaatgcctaccgttggngaaccacaagtccnggttggaanagtgccttgggtaattgggcngacaatcnacggggaacttaacagtctccacantgtgtccggacggtcctgtgtcaatcgacaaanctttccgcctcactaaggatacgcactcgatcaaatccaaagntcaattatacaaagtcaatcaccttcagc

SEQ ID NO: 94708 - DNA, 612 bp, Triticum aestivum
  unsure (1)..(612): unsure at all n locations
  Clone ID: PAT_TA_94708
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattcgaagaccctgtcttacctgccaccgctcaacacggaggcctcctcaagcaggtcgactacctggatcccgctccaagtggtgccttgcctccagttcaacaaggttggntcatcttcccgttgagcacaacgcatctcctggggtactaacgatggccgggtattggacaatgtggnaactgcctaatgttccgggtgcactggacgcacacaagtgatcaacgaggtggaggangtcaaaaaaggatacctgacccgtatgtccgcataatcngttccacaaatgctcaaggtgcatgcgtcaacttaangcctttaaaccaacgggctcnaagatccggnaaggctaaacantcatcacaaangcatattaaatgcaatnantttgcaaancganatgctttgnt

SEQ ID NO: 94709 - DNA, 403 bp, Triticum aestivum
  unsure (1)..(403): unsure at all n locations
  Clone ID: PAT_TA_94709
ctccacccatctcagcanaaannaagctagcacagctccacacaccatggtagccatggncaccaccgcctcnagnntcctcaanacntccttctccggagtccgcntcccngcggcggnccgnaccccgtcctgcgtcgccaccccgctcgccggngccatctgcaactccatctcctcctccaccccaccctacaacctcaactncttcaagttcanncncatcaatgagtcatcgtntctcgcgagatgactcgccgcnacatgaccgtnatgatgactaangcggaaaacggacntcntcatcatcnnnactggatnccncnggggcngtcctgcgngtaaaattttccaaagnncncttccaacaagaatcaccaacatcagcatttcgtttnncccc

SEQ ID NO: 94710 - DNA, 325 bp, Triticum aestivum
  unsure (1)..(325): unsure at all n locations
  Clone ID: PAT_TA_94710
cgagttttttttttttttttttcaaagcggcaacggattgaatttttgcaaatcaaatcggatcaggaccagacggctagctgtgcaacgtagtgatcgggcagctgaactcgtcacaaattgttcggccggcaagcaagcaagcaggcaggcaggacaggagtaataacctagttgtggtatatgtcgacggagtgttctccgagtatgaaatctcacggactcatcttcacaaatggacaagatgtaaaaatccacaaaaagctaagggtggtagtaattgggattgggtgatgaaggaaaactaaagaaancaaggagaaag

SEQ ID NO: 94711 - DNA, 681 bp, Triticum aestivum
  unsure (1)..(681): unsure at all n locations
  Clone ID: PAT_TA_94711
gaagcaggggcttctctggtgcctgttgcgcggctcgatcgggtggacacagcagcaggggctgcgccgtccccctcaacccgtggtcctgtaaagacacggcgtgtggccaaagcggttaccgctcgcgatatccgcctccgcaatcgcataatataatgcgttccatcttctaagaacatccgaggcttcgaccacgctgggaggcggacccagctaaaagagttcatacgcgttgaggggatcgacgtagttggcttgcaagaaaccattaaggctgaattttctcatcgagatctgctatccatcaatccgctcgaacgctttgcgtggcactgggttcctgcggtggggcactccgggggtctgctgcttggatctacanatctgctgcaagtggtgcgttggaagccggtaaatcctcanatccgcaattggaggttacaaggttatggncaaccgacatccaccncataattctaagggaacgcagganaagttccgcttggtgtgcctactntcacnaaaaccgngggattnaacttatccttcggatggtaaaaaacggntattacggcaaggnncaagttataancatanaaaaggccttagaatgcccttgggncctaattggnanaganttancgttgaangaaccntttttcgngngaaagnatccnn

SEQ ID NO: 94712 - DNA, 611 bp, Triticum aestivum
  unsure (1)..(611): unsure at all n locations
  Clone ID: PAT_TA_94712
aaaatattgaggatttagctcggggaaagttcccaaactctgtggtattaatgaaccaaattttttacttccatcattgccgaccaatgtgatcctttaagatcgctagctctcggcttcacccagtttgccaaaaatcttaagtaaaattgatgcatatttatggctttataacgatgatttttttgatagaaagactgtaagggaaccccctacagtataattgatgcaacgaaaccaaattgcaagtaccgtgccttcaacctgggtgggtggaaangcaancaaccccttcccaacaactangctatgccttaagtctgcctttataacgatgattacggaaggcagcccttgtatattaaatacaaatgatgatgatatgtttaatttgaccccgttgcgaccgtttacaattgaaagtggnccatcgtcggttcnaccctttgtaggtacaacgcatggtgctccgcaataaaagacaacctaactgatgtcccgggcctaangggtttgttacggnaacaggcataaaatcgggcttaaaatttcattaccaagagcttaacggggaantactanaccccggtagtaacgaatcngcaacnnaa

SEQ ID NO: 94713 - DNA, 546 bp, Triticum aestivum
  unsure (1)..(546): unsure at all n locations
  Clone ID: PAT_TA_94713
tcagcctccgccatgcggcactgtttctcagcttctgtggcctcctgtcgcgccaggtcgcgcgtcgtggtggccaccccaagcgccttctgggcctcctccgcagagccccaggccgcgcggacaaatgcatcagcctttagccaaccagagatcatccccaggcgtccctgtgcaaaatgatgatccgggcctgaagtcaccctggaaggangtccagcgccgccttgcctcntccaaggttcccggagggagaacgaacaccatgatccggcaaccgctngcaaaggaaggaagacccctccggnagaaaggcagaagaatctcaanctcaaggaagacggggantctgggaaggtggttgcctcanaatcatggaaagccgggtctgaggatcaagctgcaaaagaacngactccnaagatngctcaagtctctgganaggatcactcaanggtgcgggtcaaggaatctctnactgggaanctgacgtcctcctncggcgcggaactcanaaacctcnattctcacgtgtgctanacaaat

SEQ ID NO: 94714 - DNA, 511 bp, Triticum aestivum
  unsure (1)..(511): unsure at all n locations
  Clone ID: PAT_TA_94714
cagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtccgacatcgacgccaacggcaggaaggtccngcaagaagggcgtgtaccanttgttggacaagtacggcgccaacgtcgacggtacagccaatctacacgcccggaggaatggtctgaatctngtgaccgctacgcccggcggaacgaccgggcttcttatctgggccntcacctcgcccggctccttcngggggggtctcctcctctanaanacaacgtctcccccggttaanaanactacttttacanaaggccngtctctgctngcatgaactctcctgtnactaagttactactcctgtgaagtatttcacaacgatcaaattatnatccaac

SEQ ID NO: 94715 - DNA, 272 bp, Triticum aestivum
  Clone ID: PAT_TA_94715
ttggcaccggcgtaggccaccctgccgctcgacctcgcctcgcaccggaggcgaccaccaccatccttcccgctccctcccctcccccaacccgatatagatgcctaacccgcaggaacggccatggggccggcaggcgacgcgaggcgcggtggcggcgcgaggaagacgggcagatccgggcgcggtgtcgaccgatctggcggctggtgcggccgcttgttccggtgccagcggcgtcctgctcatcagagaagggggagagaagggtg

SEQ ID NO: 94716 - DNA, 694 bp, Triticum aestivum
  unsure (1)..(694): unsure at all n locations
  Clone ID: PAT_TA_94716
ttttttttgaaagatccagcaaattgctggcttcaattagattaagcagaaagtagcggaagaacaacatggggaggatccgaagatcaatgagaaaagaaaaacgacaaccctattggccatcgaacaacactacccttacacggcggaacgccatccactcacagcaagacaacgcaactccaactcctgcggagaactacagagagcaaagcaatgttggcgtcacggaagatcactgaacggaccacttgtcgctcgtcatcgtacaccaccggtgccccgcaccgcagcttcgacttcacaagaaacaagcagccgaggtagtctcacggacacgccggagaagagccgactaccatgaccaatgccaccctccgacaatgctcaacgncgttatcgttgcacagaagccanactgctccantgccgtgcngncacgaccgagcaacacgactcccactatcactggtccctctggacgtaaggactcctggaacatgcccaagagtgcaccangccgcatcatctccgatctanggataagggtccccgacatcttctatggangacaagacnctcacgaccctcaaaagaacgggcccagntccctncctgccagnaanncggaaaaacttacgggtgactcgcacaacgncaacacatgaaccggcgggggngccagccaatctcn

SEQ ID NO: 94717 - DNA, 490 bp, Triticum aestivum
  unsure (1)..(490): unsure at all n locations
  Clone ID: PAT_TA_94717
cgcgatctcaccgagaaaatcctcgaccgatcggaanacangcgcccctcangctccttcaagatgcanatcttcgtgaagaccctcaccggcaagaccatcacccttgaggtcgagtcgtctgacacgatcgacaatgtgaaggccaagatccaggacaaggagggaatccccccggaccagcagcgcctcanctttgnnggcaagcagctcgangatggctgcannctggctgactacancatccagaaggngtccaccctccaactggtgctccgcntccgtggaggcatgcanatctttgtcaannaacctcactgggaataccatnacncnggaaagtggnctcctcggacaacaatcgntnatgttaaagccacgatcagnataaggagggcatcccccggtctantagcnctcatctttccggtaacgcatctggangatggncgcacctgctgtataanactcagcangatctacctccatt

SEQ ID NO: 94718 - DNA, 461 bp, Triticum aestivum
  unsure (1)..(461): unsure at all n locations
  Clone ID: PAT_TA_94718
ctcggacgtattctcgtaactgaagctggccggtgggaacatgctctcgttcgaccctgtcatcggcatgaccatctctgtgcagtactgccatccccagccgttgaggccatgagggtcatcatcaccttccacctgngaagcacttctgngtcgcctgtgtaattgtagtacaggctccgctgcggcgaaaggttgtccgatgacgtctgctccccgtgnggaaaagaacaatgatcttgcacatctcctttcaacanggtaagcaaggaatttcanncaatgaaattggttgggggtttgatantccaacaatggtgttttaggttaatgctgttcgctagccatttnccccaangaatcaacaaactgaacgggcctttcagccctgaaagtttttgctgactccaaaaagctgtgttgttgtttcccnncaatcaacaatcccaaacgcttnaata

SEQ ID NO: 94719 - DNA, 621 bp, Triticum aestivum
  unsure (1)..(621): unsure at all n locations
  Clone ID: PAT_TA_94719
cccctttctcacattgcagctctcctgagtgaaaaggtaatctccaatagaatcttgtgtataaacacttatagtaggaacagagcactctgctcttccactggactgacttggatagagcacacctgcatcatctatatcatatactttaggtgaaccaatctctgaaataggtatctgtatgagttaagccgcccatgcaattatcatttttcangatctatgantgaaaaattgctaagtgttggacaaacagctttcgcagatcggcgctataattttggatctatagcagatcanataatgaagaaaatttaaacctaagttgcggcancagagcattcatgtgctcancatgggtctccanggaaggggggggcgttcaagtatctaaaatgagtgctaagactgatgcnccatgatgagcacttaattcccatcaanactacantgacaggggacaaggagaacggcataaatccgaaatccnaagaaaacctaatgtcatcatgtganacanagganggtacnaggctnaatncgagccccganacttgnggtcaatcanacgccagtnaacatggcaaatagggnacgacnaaggngagnttagaaagcant

SEQ ID NO: 94720 - DNA, 375 bp, Triticum aestivum
  unsure (1)..(375): unsure at all n locations
  Clone ID: PAT_TA_94720
ctagacacaacatcaagttgacgtccagttgcagcaagcaacggcggcgatgatggtggagaggtgggcagggttcgggtcggcgatggcgaccgtcatcttcctctggtccgttgtgcagaactacgtccctcccaccttccgcctctacctcaccgcctggggccgccaaggtcgccgcctgcttnaaaccctacctgcagtttaccatctcccgaatacngcgccgagcgctttcaacgcagcgacttcttcctcgccatctaaggctaactcaacgaacgccttggggcccgccggggaagcaaantcaaaggccnactccntnaaaggncaacnaagactttctggtcaacgttttnagacaccanggag

SEQ ID NO: 94721 - DNA, 633 bp, Triticum aestivum
  unsure (1)..(633): unsure at all n locations
  Clone ID: PAT_TA_94721
tttttttttttttttttttaccaaccatatcatcagcatgacaagaatgtattatactagctcacaagcaatatgatatctgacccgcaacaagatagtcggcaaaacctggataatcaaacaatccacaaacagatttgtacaaaaggcacaacaataccaacttttcttgttattttccagtgtacagcagataagtatacataatctaaactccacaatcatcaaaatatagctagttttaaagtctggttatcttttatcccaactcctaccaccccgtggctgttgctgcaagcggcatcccaacattggtccaacaaactgccatatcatctaccaggatcttggctccanacttttcaaattgggttgccgtttgtccgggtgggccaactgtcctaagcacactttctgcctgtccttccatntcgctgcgtccaacacacttggcgcatccccattaaccggattnaacgggggngacggaggcaancccnggacgtnaactgcactcacaacagctcggcttcgcnaacggtgctctaaggactctggggggnccgtaccaattcccnaaggagcgatancggctnatggcgtcttanagccgcngaaacctggtaccactnn

SEQ ID NO: 94722 - DNA, 662 bp, Triticum aestivum
  unsure (1)..(662): unsure at all n locations
  Clone ID: PAT_TA_94722
tttttttttaaaaaaaaagacgcaatattccagttaaactagaggttcagaaggtcatatctcaatatctttgttctcttctctcggaaaaacatgcttggacaagaaaggataaagcacaaattactagagtgtgggtagtccactacagaaaattcacttcactattgcagctttaatctaagaacttagcagcttgtactccacttggagaagccatgaaactggagcgaataatccgcaaagttccggtaaggaggtgacagtttattatagctgctgctgggccagaaggcaaagatatacagtaaggctaatttcaccaagaaggtccctgggttttgacctggaacccggcaancctcccanggtgaagctgaganacccgtgtcgctttcttnaantccgcccctgctcccgccaaggaancctccatgctccccggctggcaaacaaccgttctgtctgcaacaagncaagtnnttcaaccccgcaacgggngacacaaccgttgtctacnaaccggtggcaactacggactcgctcgaaacntnactnaaatatgcattctgccncgnanatttaagncanctcccnacttanncancctgtgaggaccaantggggggggnccgccttattcggaggaccnatncgttgcc

SEQ ID NO: 94723 - DNA, 167 bp, Triticum aestivum
  unsure (1)..(167): unsure at all n locations
  Clone ID: PAT_TA_94723
tgataacacagccccattctcattcgacactagctcgagcctccagactattaccggctcaatgtcgggggccaagccatttcnccgaaaggtgacttggngggcttctaccgctcatgggcgaatgangtnccgtacatanctggtggctctggggtgnttttctt

SEQ ID NO: 94724 - DNA, 647 bp, Triticum aestivum
  unsure (1)..(647): unsure at all n locations
  Clone ID: PAT_TA_94724
gacggaaatgtttaatacatataattataacggataactgtccccacttaagcaagtcgttttcacccttgtcctgtttccttttgcgttggcggaagttgttatggatcatgactgggctttcgctaatagtgttcaaagtacttgttcatcagcagtataaggaaccagtcaagtgcacttaagtcctctttgggctttctgcagtgtaatatttatgttagactaatctctgggcaacttacaaaatggttgtttgggctgttccttaatgacaacgatctggggcaatttaagcatgatgtatgcttggatgctaacccgattnagatcccttgtgcaaatggcaatttgggcaagccgtgaaaggacagaacgccccctgggcaagtgtgctacaacgacacancaatgttcttcncnaggtggtggcgccttgtgcctcccataatccggtccnggatcaagctgagaaacgtaagttgggaactccaatctgggaacaagaatgncaaaaacntcaaagagacaggcacataggggctagtagtnanangcaacgntgtgntcaanaacnatgatangccgnttccaggttagggtccgnattnttcaaccngggcggacaattnccaaggctttccccn

SEQ ID NO: 94725 - DNA, 410 bp, Triticum aestivum
  unsure (1)..(410): unsure at all n locations
  Clone ID: PAT_TA_94725
ctctgctgagaagggctaagatctgaactgcaagataaatgcttcggttattttcctcagaggtaaaatggtatatcctcactattaaagcactttttgattacttatggctcgttagaaggtagatccccgcgcggactttgtgcagcaagagcaccctccaaggcaagaccctctggtggagacttcttctcccgtttggaaaccttggtttctggatcttcaggggtagtcctcttccttccctggggtgagagaatgccagattcctccccttggttatcctccctcacggaggcgcccgttccctcggtcggaatgggtagcggtggaggccgctttctcctcctttaatcccccctttatcttcctaaganggctccgggcaaggtgctaactcnaaggggggg

SEQ ID NO: 94726 - DNA, 541 bp, Triticum aestivum
  unsure (1)..(541): unsure at all n locations
  Clone ID: PAT_TA_94726
cgacgtgcccgctccaactctcatccaatggcctcgccgcacgccgacccgcagcagcagcaccacgcgtcggcgccgccgctcctgctcgccgtactccgcgttccgttcccgggggcccagcgcccgcgcgcgctccccgccccggacctcgcccctctcgcgcgccgcctcgacnagctcgccgccgcggcggccgcccanccgctcctgaggccgctcttcgacctccgccaccacctctccaccttctcccanagcgggaggcanaggatggtggcgatgcggnangcggngtncccgctgnccggcggcganggctgcttcncngnggtgctggncgggtccngttgccggcatggtggtgtccaaanngcgtcaacagcttcntcagctctanaacacgtgctgtcanccggtcntgntnactggtccccaacacnccgccgngattgtntngccctcagangtgtgtgatcntactgaaatctcgggnaatatccccncnggtggctgccttcncaatctnncttctgtgtaa

SEQ ID NO: 94727 - DNA, 170 bp, Triticum aestivum
  Clone ID: PAT_TA_94727
gcgttgggaggagcaagcggagtgccgataaaatcattgttgttggtatttgagaagtcacataatttggtgttctcttgagtcatgatgaccacacaacgagattgcactcaaaacaaatccggcaagaaaatggcgaacggaaaaagaggggcaaataaaacggcaat

SEQ ID NO: 94728 - DNA, 171 bp, Triticum aestivum
  unsure (1)..(171): unsure at all n locations
  Clone ID: PAT_TA_94728
tctgttggnctcanggtgctggacacttttcaacattaatataagttgttcgacatgtttaaacaatatataanttgtcnaggtgtcagtcatgacgacaaggtcttctcagaaaagcanagacgtggaaattaggacctcccattttgtagaanaatgctgcattatgac

SEQ ID NO: 94729 - DNA, 511 bp, Triticum aestivum
  unsure (1)..(511): unsure at all n locations
  Clone ID: PAT_TA_94729
cgcacctcggcctccgctcatccttctcccccgcgtccctttccgcgccgacgcggcggctgccatgtgggagcacttcccgccccgggcctccgccgggagccgcggccccgcgccgccctaccaccaccaccaccaccaccagcagcagcagcagcatgtcgcgccgcccgactaccancagcagcacgtcgcgccgcccgactgccagcagcagcatgccgcgccgcacggcnaccccgacccgctcgcctccgcctggatnngccgcctcnacctcgccccgagcccgccgccgccgngcgccanctcgcgcccccgccgtctcacgaacacnangccgtctcntcccgcagcnccgggttcggcacttccgttggagccnctcngccggtcngcgncctgcccatgtggcggtgggggtncccnccgattatgtcgngttctccngtcccggctcancnctccgggctcnggcttctgnagttcnnccgttaggccacancgggtc

SEQ ID NO: 94730 - DNA, 525 bp, Triticum aestivum
  unsure (1)..(525): unsure at all n locations
  Clone ID: PAT_TA_94730
gcggcggcggcgggggaggcagccactcctccggctccgggaccgacgcggccaccgagcacctcttcgccaccgggccctccccgttcctcccgcccggccgcggcccggccgtcgccgacccttacactccatacgccgccatgcccgcccaccccgccgcgcaccaccatcaccaccacccgcagcagatcgcccacttccaccaccccgccgcgcgcccgctcggccactacggcgccgggccaggcggcggcttcgaccacgggttcctgagccgcgccgtggccagcggcgcgccagtcggnccgcccgggatgcacaccgcatggtcggcggcggggccgcgatggggatgatgngcctctctttcccgangagtggagtcggtcccgcggcggcggcggcggcggcgggcgccgggagtgagctgttcccgacttcggcagactgangtccaatgacgtgacggaaccaatgnngagggatcgtcgtcgcctctctcggtataaaaatcgtttcctc

SEQ ID NO: 94731 - DNA, 635 bp, Triticum aestivum
  unsure (1)..(635): unsure at all n locations
  Clone ID: PAT_TA_94731
ttcacaagttattctgtctacggtcgttactttgaagtttcagcatccatctgagatgttcccaacagatagaaaccaacattcaccaattccttgcagacatgttaaaatttgcaatggtctactatgttctcccatattttctgatgatgtgaaacagtgcaagagactttattcctaagggcaatcctatatttttactaggagtctccaaaataggcacagcaatcttgtacttgtaagttccaagaaaatattgggtattataccctgttattactatgactcctactgttggggtgtggggtaatgatttggctgttatttcccccgtggaataacatttttatttggngattcaantcacatttaagggaanaatcatcttttcanggcttatgacaattgtcctttccacaatnanattgcnanaggcacattncatttcaacacaaangtcacaacatccaacaaaanggatgcacaaacggtnaatattacggggtgcaannaaaaatgccangcncctncgaaccagatcgcgganaattatccagtctncatacatgatcatgtcaancanttatgngggnncttaancattatcgaaaggagcatantncgnaatttcaana

SEQ ID NO: 94732 - DNA, 471 bp, Triticum aestivum
  unsure (1)..(471): unsure at all n locations
  Clone ID: PAT_TA_94732
ctcgccgtcgctccgctgacctcaaccagccgccggcgaaatggcccctaagcgaggcggcaaggcgccggtcccggcgaagaagaaaacggataaggtgaccaacccgctgttcgagaagaggccgaagcaattcggtatcggcggcgccctcccgcccaagaaggacctacaccgcttcngttaagtggccaagttnttcgaatccaacgccaacgccgcatcctcaagcaacgctcaaggtgcccccnggatccaacaatttaaccgaacctcnaanaaaactttcaacaaantntttcaaaatcttccttaattaccggctnaaaacaaattccaanaagaaagttttaaagnggccaagttaacttaaggaaatttttngccaaaacatatttaatttgcttacatttcactnaccacaaattaaccactgttnaaaccagattttccntnacggttttgncccgc

SEQ ID NO: 94733 - DNA, 618 bp, Triticum aestivum
  unsure (1)..(618): unsure at all n locations
  Clone ID: PAT_TA_94733
ggcagccgagggttccgccggcggcggcggcgggcggaaaacaccgttgccccataacccaagagagcgcggagcggcgaaattcctcaccggcttgccatcgcgaggaaacttctcctcaagttccatctcttccaatctgggaggcctcagggtttatgtctgcgagcacgacacaaatcctccaagagggacaagttgatcgagacggatacgacaaatatcttaatcaagacatctgcaactaaagaagaaagattagttgaggccaaagacgcaggttctaagactcccaagggaaaattggcaagggtaaaaatgttctgccagaatttgggtgttcaaaatccgtcaaaaaaacccaacctggcattcttcccggttgcttcctctgatgaacatatcngttttcaaaacaacactgnatccttcacgtaaaagtncttcattctcccgacaaagagctcacaaccaaggggaaaaagacaangncanccttanaaaggcanatttatanatcnaatttcgcctgttgtattgataattctacggnacgtaaacttctattaanaatcacaggnttattgtgnatttgccaatcaatttgngtnacttagg

SEQ ID NO: 94734 - DNA, 619 bp, Triticum aestivum
  unsure (1)..(619): unsure at all n locations
  Clone ID: PAT_TA_94734
atatgtagccaaacctccgtggagaaaggacaattatgactggtacgacacatattccaggacttggccacaaaatttgttagaataaatctgaggtgcttcgtcgattaactgaggataaagcaatcacacaagtacgataccgagatttgttaataagaatcatcgatatagttacattttcggggcctcattatggtcgctcctccccatgacaccgctacaataccatacccagtcgccctgggacgccgacacatgtcaccggttcccctagtgttgacatagattacatcatgtgtctacccctatatatgagaagctangatacaagtgtcccatttttaacacgactcatatcctatctaaacacaatacaacccaaatccaactataactactcctccgtttttatttactctgcatattananttacggaancaaactcataaatttggccaatttatngaaacatatngacatttntataataanctatacgatgtgaaatcnccataataancnaagtgttgattgtatggaaactaaaatttgttaaaactggcaaattgtaactgcttgcaagtatagcacaataaaaanggggtctncacaatt

SEQ ID NO: 94735 - DNA, 518 bp, Triticum aestivum
  unsure (1)..(518): unsure at all n locations
  Clone ID: PAT_TA_94735
ttttttttttttttttttttttttttttttgtgtgtggttgtagtattagagaagaagaagacagagatgatgggcggagaatagatgccccaaaaatgaaacctgccacgtcaatttcgtcagctaaaatcaaaactggtgtcgtcttcttctgatcagtgtttgtagcaagccatcttgcttctcgcgggtaaaatcctgcctaattctgaattctgaggcgctttagcantcaacgttacatcttcgagacagtgtccaagtgtttaatancctgtagatgccttcataattttgacctgcatctcaagataaaacctgttccggcttcngaggaatggctttggatcacgaccgcccccctccgaagatattccagcgagattgccgttcttcctgcttgcacccccantgacctttttgcctgatcccggggcncgctgctctagtcctcgtcttcctgaanactctaggatanagacaccgatccatggcgggccctcttggggccntgcaa

SEQ ID NO: 94736 - DNA, 283 bp, Triticum aestivum
  unsure (1)..(283): unsure at all n locations
  Clone ID: PAT_TA_94736
ccgagatctccccacagcccgcggcagcagatccgcgcggccggcgagatccccgccccggatcccggccatggcggggatggaggccttcgaggcctacttccgccgcgccgacttgaaccaggacggccgcatcagcggccaggaggccgtcgccttcttccaaggcgccagcctgccgcagcaggcctcgcccagtgttggatgcacgccgatttanagcaagaccggnttcctccggccggccgganttcttcaacgcgcttgcgntccntaacgttgg

SEQ ID NO: 94737 - DNA, 657 bp, Triticum aestivum
  unsure (1)..(657): unsure at all n locations
  Clone ID: PAT_TA_94737
ggagacgccggactcgacgaggccgcggacgccggtgcgggactcgtcgaaggccttgacgagggcggcgcgggactcgtcgaaggccttgacgagggcggcgcggtcagactcggggacggctgcggcggcggaggacgccatggccgtcgggttgcgtgcgtccgtttggatcggtgacgtgtntgagggaatgggcccgggaaggttnggccgtgtnnggcgcccgtgcagttttgcgcgacgacttcttatcctttcccgcgcggtttggtaaaaacctcccccgtgttttccaacctcccgaccgagcggcggtgttccggcgaacggtcaaagtnaccgcatttatttggccttccggcgaaagccgcatcatcntggcccggacgcaacnaagcacggtccttaaacgcaaccggcaangacactctccancggcgcngaccgtgttattatccgtgtnattacggngcnaagggttcnactaatccnaagtcaacggcggnangaaattcaatgtataaccggattgcgngatcnctngttgtaaaaaaggangaaanaaggnaacggggccggtccattccctaatatctatanccccatgcctctttaactctacggaacctggtccantaccttanaaaccctttc

SEQ ID NO: 94738 - DNA, 393 bp, Triticum aestivum
  unsure (1)..(393): unsure at all n locations
  Clone ID: PAT_TA_94738
ctcgagttttttttttttttttttggtgatgcaagtcatgttggttcgacgaatccatccatgcaaacaccggccccttcgcatgtgggagttcaacccagagggaccgcgcgctattcagaatttactcggcctaacacacgaggagatgtatagatcattctttgggaccccagatagagtgtccggatactaccgaggacgtgggcctgagcagtaaccgcaccgccgaccaaattaagctatcctctatccgaacacaccatctttcatttatcatgatgttattcctgaagaaaccctctttngaccaaggagttggataacaaaggcgaaagatattcgggtgttccggcccccttcccggaagctttggaaatcctggtactccaa

SEQ ID NO: 94739 - DNA, 610 bp, Triticum aestivum
  unsure (1)..(610): unsure at all n locations
  Clone ID: PAT_TA_94739
gcgaagctggcgcctggctggtcacgcgggaggggattccgccacaggctcgcgctcggggcgcccttggccctcgccgccgcgtcgctcgtgattgcgttcttgctcctccccgtgcgcgggaattgcgggggtgcgtgggccccggtccagcgcgccttcctcggagcgcagctcggagcgcacctccgctgccgcggggaccgtcatggcggagaangcaggggcggcactgggcgcgcgcccacccgccgcacctccgcgtctctggattcggtgaattgggacatttccttggtgcgaaatcaaacgactactccgatgctgccccaatcccacaatgtcttcacatgttaatgtacctcctttccaaattttgttaccctgttttgatgtgttatgctaaatctngatcctaataaaaaaaaanggggggccggtaccaattcgcctanatgancntattancgcctcatggcgtcntttanaactcctnacgggaaaacctgcgttaccaacttatcgcctgcacaatccccttgcaactgggtaatacaanagcccacgntgccttcaannttccanctaatggaatgaacccttacggata

SEQ ID NO: 94740 - DNA, 405 bp, Triticum aestivum
  unsure (1)..(405): unsure at all n locations
  Clone ID: PAT_TA_94740
cgagtttttttttttttttttttttttttttttttttttttttttttttttttttttttttacttgaaactctagttttgcatatatgttgcanactggagctcaacttgtacatgnaaccaanttaacccacataaaaatgtcnacaaccctcctaaattacaaccaattttacatanaccgcaagccatttanatgtccnccagtcacccaanaagttcctgaacagaaaactacatggncctanagatactgatanatccacacaaagaaggtaggaataggagaagttaacttaggcagcatctcacatacacccngangaaatgcnccaatcaanncttcaactctcngcccaccatcacnaagagcttatggtcaagtgccaagcaaaaaacaatgccc

SEQ ID NO: 94741 - DNA, 190 bp, Triticum aestivum
  unsure (1)..(190): unsure at all n locations
  Clone ID: PAT_TA_94741
gcggctcggggggaggcagcagcagcagcagcccctgccgccgcccangctggcgtacctcatctcgggcggccccggcgacggnccgcggntccgccgcctcctgcgggcgctctaccacccctggaactactacctcntcgggatccggacaacncnctctantaancacccttnntatnctttcgtg

SEQ ID NO: 94742 - DNA, 192 bp, Triticum aestivum
  Clone ID: PAT_TA_94742
ggtccgtctcgatctggctcgccatgattgagaatgtagataaacatagtactgtttgacaacgaagttgcaaaaattgcagcaaaataagtaagtggcagctatgtcgtggcattttcattaagcactttacctatatgtcagtcaactgggattttaaatttgggtcattcaatttctaaaaaaaaaaaa

SEQ ID NO: 94743 - DNA, 647 bp, Triticum aestivum
  unsure (1)..(647): unsure at all n locations
  Clone ID: PAT_TA_94743
tttttttttgcaagatacaaccttatgagcatctgaatgaaaatgttgtacgtagtacagacttcagacatgtaactgatactgtgcttatgtttatttctactaggacatactacgacattgatacatgtgcttatactattatagtaagcagcatagctagtcagcgacgaagcgccgttggatatcatcttcctcctggagaggccaagatatcatgcaagaagctccgatgtgatttgcgggtatgacatggatgaccaattccggccattgcttttcaccaaggccgccatgttcacgctcaactcccgtcttccctcaactccgggcagtggnatgtcaccgtccaaggtattgcttnacttccccgcatcctgggcctttgaactaaggaaatggggtgcaagcacaaaatccccagctttaacacgagcatgctcaaccaatgctgaatcccatngcacctaataccacgtcctggataacctcgttgtccaagcccatacaaccacaagaaataattcccccgcattacctgaaggtttgacgcatgcgactnagaaggacatgcaaagnaaaacatcttanagggatccttactgccngtacnccgggtagtaccttgcaacanagttggtntctat

SEQ ID NO: 94744 - DNA, 605 bp, Triticum aestivum
  unsure (1)..(605): unsure at all n locations
  Clone ID: PAT_TA_94744
tgccacaacaggcatgctgactagataaacatttgaacctagctattatgaaggaaattttgtattgacaatagttttagatagcaggagacgcctagcatgctctgcctctactagcttatttttggcttcttccatatcttctttggcttgggtgaagagagcatctaattgctcctttcgcttctacgggaactcagctactttctcaagggctgctgcatgctttctttcagcctttactagagccacgaggacatgaacagctgatgactccacctggcttgtgtgtaatccagcatcatctgggaatttgcaccttgtgtctaatccaacatcattagggaactggcaccttgtgtgtaatccagcctcantttggaaacatggncccaagggggggcccggtaccaattcncccaaaatgagtcgtataccncgctcacggccgtcnttanaagtcctgacnggaaacctgggttaccaataaccccttgagaaacccttccaactgngtatacaaaaggcnacgtgcctccaaatnccaccgaagnaatgaccccnttcggcatacccgnggntgngttccagtccnaatncacccn

SEQ ID NO: 94745 - DNA, 564 bp, Triticum aestivum
  unsure (1)..(564): unsure at all n locations
  Clone ID: PAT_TA_94745
cggcggcggcagcgggagagagagagagganagagctccanccatggtgcacgtcaacttctaccgcaactatggtaagacattcaagaaaccaaggcgtccttatgagaangagcgtcttgatgcataactaaagctggttggtgantatggactgangtgcaagcntnanctctgganggttcaatatgcattgagcangatccgtaatgcngcaagacacttgctcacactggatnagaagaatccccnccgtatcttttaagngcgcngctcttctccatcncattaacctntatggtctccttnctnanggccaannacaancttnattacgtcnttnccctnactgctnagaacttccttgcaaggcgccttaaaactcttgtcttcaaggctgnattgnaaaatccatcaacaancccnttnttgattaaggaacccaaattaaggttngaaaggcantttacaattccctncttaatgtgaggttnaatcnaaaanaaatnattntaatnaaaattcattccgnnagccctaaagccgnttaanaaaanccttaag

SEQ ID NO: 94746 - DNA, 560 bp, Triticum aestivum
  unsure (1)..(560): unsure at all n locations
  Clone ID: PAT_TA_94746
gctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactgggcagctgccgatgtaaccaagcagatccagctggcattccaggtaaccgggcgaacaactactaccgtgcagatggccaaaacacgggcaactccttaacggacgtccttcaaccaagntcatgctgctccccggcggtggtcctccctggggtactgtttggcgggaagttatccctgtttaatgatgctgcgataatttgcctgtactccgttatccaagttggtgaaaactggaatgtttngttcaacattttacaactgcgtcgatttaccctgccgtaagntcatggttccaagctgactcctgctnggnaacaattcctaaaactgtncttcaaacaacgtcntnaccaaaaattgggttcn

SEQ ID NO: 94747 - DNA, 627 bp, Triticum aestivum
  unsure (1)..(627): unsure at all n locations
  Clone ID: PAT_TA_94747
cccccgccctcctcccccgggcggcgaaatggcgccgtgttgccctgccgaatctaccaagccggccttcatcgggatattcggcgccatcgtcggcggattcgccgtctccgctgttttcttcctcctttctttctcctctatacccgcccccgcgctccccttcccggtccgtcaccgccaccaccaccaacctctctgctctctccacccccgcccagccggagaccatgttacaaccgccctatctgggaaaccccggtcgggggtcgccgatgccttcgccgcgccgcgttccgcctcacccgcgaattgtgcgcgccggcgcccgcgatggggtcatccgtcgtcactttgggnaactacccttcaatggatttatcctcaactggggtgcgcaactcaanaggctccgggtaaaacatctccttngtcggngccatgggacacaaatttatcccggnaatctactcaacggcgtgccntctccacatgggaacaagatgtcacggaggacttggctgggggccccaacttcanaanatgggaagggaaaaggtntgccataaaaantccncccttngtanaatggncagtcaaacggcatggttggnnanaacgttgaaa

SEQ ID NO: 94748 - DNA, 295 bp, Triticum aestivum
  unsure (1)..(295): unsure at all n locations
  Clone ID: PAT_TA_94748
tttttttttccataaaattaatggtcattattacatactatacaaactttcgggatgcagtctcttggccactatgctgtctgctgtgtatacatgaagttccatctgccctgaacatctgaggttaactaatgacaccataacagacggtgctttgtcataaaacatgtaggattaacttgcaaatggtgattgcttatatttttgacaaactgatganggggaagaagcctaaactacactacagagaagtgtcgttgctttcatctccttcctcggtccaaagggggggggc

SEQ ID NO: 94749 - DNA, 479 bp, Triticum aestivum
  unsure (1)..(479): unsure at all n locations
  Clone ID: PAT_TA_94749
attttccgcccaccaccgccggagggagggagntccanccatggccgccaagtgctacccgacggtcagcgacgagtacctcgcggccgtcgccaaggccaggcgcaagctccgcggcctcatcgccgagaagaactgcgcgcccctcatgctccgcctcgcntggnactcngccgggaccttcnacgtagccaccaataccngnggtcccttcggaaccattaaagtgccccgcagagctccctcatggggccaacnccggnctcgaatnccgtcaggctgctcgancccatcatggancanttccncatcctctcctaagccgacttntaaaatctcctggagtcctcncgtcgaggtcaccgngggncctnaggtcccttcaaccgggganaaatttaanccctancctcctccaaaaggcgtcttctatgcaaccaaggtcnncaacttagaagttttcacccaaannggttttc

SEQ ID NO: 94750 - DNA, 624 bp, Triticum aestivum
  unsure (1)..(624): unsure at all n locations
  Clone ID: PAT_TA_94750
ttcagacgaaccatgggggcggcgccgtcgagacaggaggcgtccaccgcctcgtcgcccaccggcgatggccgtgtcatgccggcggcgctcagcgcttctactacttccgacatcgccaaccaggcccagtccaagagggcgccggctcctcacatgctccgggagatcgtcgccggggagaatgtcgccgacgtagccgcgctggaagatcaggtctccaccgggatcttcttggacgggaaaacaaagaagtactgggtagatgagaggaccaggcacaactgcttcatgctgttccccagaggcctgcacatcacctggagcgaaaganccaaatactggacttggnacccctgaaagaaggaagcnaggccgangccggatcgagacgttggngctgcagaactctgctggctggagtccatgctaagctggagctgtcccttctcanaccaggagtcactacnagtctctccangtgaactcnatgaccaacctacgatgtcgacccgttaactccggncaaatccccaaggtacatcaacagcacaggngaactgagganaaaccangggaattgcgcagtcaggttggaagtaacccaaagggnaaatgnaagna

SEQ ID NO: 94751 - DNA, 480 bp, Triticum aestivum
  unsure (1)..(480): unsure at all n locations
  Clone ID: PAT_TA_94751
cggcgagcgagcgagcgaagcatccatggcggagcacaangaggagtcggtgatggacaagatcacggagaagttccacgggtcctcgtcgtcgtcgtcgtcgtccgacgacgacganaggaagtcgggatngtcgtcgtccgtcaaggccaaaatctaccgcctcttcggncgngagaagcccgtcnactccgtcctcggnggaggcaagcctgccganntcttcctgtggcggaanaagaagatctccggtggggtgcncgcggncgcnatcgcnatcaggctgcngtttgntggtccctgnagtacatctcctcaacctcctctgacaanggattcatcgtcnccctgggcatcttcttcntcgggtnaaangcttctgcctccgtcaaaaagtccctcncannattccaaangtgaagatcctgangactgactgttaacgntncccgctccctgngacccnatttacnaggggtt

SEQ ID NO: 94752 - DNA, 605 bp, Triticum aestivum
  unsure (1)..(605): unsure at all n locations
  Clone ID: PAT_TA_94752
gtaagttgcatattttttaatatatacttgtgtacaatgtatattcaaatgtaccccctccatccaaaataatcgtagctttaggattttcaagagtaaggatttgtgaagtttgacaaatcctgaaagttcaattcaagagaaccgaaaaagttaatgcttctgctcccaaatattgaacgaagcaccaaataggcctctgggtcacccgaaaccatgcgagactaatgtttggtcgtaggaaattaatgtcccgactctggcccgtgtagcctaccggctcgatgtccaaaggtctaaactggggtaagtttgtaacttcaccaagacccagtctcaaccgcctccgagaagcatcatacgctgtggggtgcctcaacaccaatgcgctcggccgaatctatccgcccanatttgggacactgacatgacgtccnaccccaacccgcatattccgaaatttaaatgggggaaaattggaacttcccaaattnaaaaaaggngtccaaaaccgaaaatatcccctantcccgctcctcgttccaattaaanccgtggnaaaaaccccccanancgtaancaactctcgtcccaacanaaacatc

SEQ ID NO: 94753 - DNA, 623 bp, Triticum aestivum
  unsure (1)..(623): unsure at all n locations
  Clone ID: PAT_TA_94753
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggccttctcgggggtcgacgtctgcgacgacgcccaccccaagtgtccccaagggctgctcggcgtgccgcgtggtgtccgacgacccccgaaatgtgggcgctgcgcggatatgaaaccaccgttcgacggacctgcngtggacctgcaagaantactgatcggtcaatgccggatgatatntccgccctaaaataaaataaaantcaaggcaaatgacagctcatcctgcctagcntgtgtgttttggcaacaagcttatacatatgtctcncttctcccgtgtttcncncccaanaaattgggttntggttgtcaactacccggaaccncctgnataacacgtaagatgtcntggtgcaaaatanagtcnctgtcaccaaaaaaaagggggccggancaatcnccnaatgatctatagccnncaggcgtcnttaactcgacggaaacctg

SEQ ID NO: 94754 - DNA, 367 bp, Triticum aestivum
  unsure (1)..(367): unsure at all n locations
  Clone ID: PAT_TA_94754
cctcccctcctgatcggagtctcagccgcggcagccatggcgaagacctaccccgttgtcagcgccgagtaccaggaggccgtcgagaaggccaggcaaaagctccgcgccctcatcgccgagaagaactgctccccgctcatgctccgcctcgcgtggcactccgctggggaccttccgacgttccgtccaagacaggcggccnttccgggacgatgaagaanccggcggacaagggcacnccgccaacgcgggcttggacatcgccctncggatgntcccanccatcaagagagattnccacactccctacgtgatttctacaactttcggantttccccgtggagtncccgttgccgtttatct

SEQ ID NO: 94755 - DNA, 418 bp, Triticum aestivum
  unsure (1)..(418): unsure at all n locations
  Clone ID: PAT_TA_94755
gccgcaagaagcgccggctctcccacacccgccgccgcccgcaaccatggngancganctggcgtacgcnccgccgatgaantccggcaaggccggcttcnanggcccgcangaggcgcancaccgcatccgcatcaccctctcctccaagagcgtcaagaacctcngagaangtgtgctccgatttggtgaggggcgccaaggacaagtgctccgggtcaaaaggcccgtctaggatgcccaccaaggtggtcaacatcaccaccaagaatcncccttncggagaaagtaccaaactgggatcgnttttaatncgggntgacaacggtgatnnactccntcagtcccccngactttttaacaattnactccgataacaatcaaccggtttnagtttnagggggcancancnacattt

SEQ ID NO: 94756 - DNA, 628 bp, Triticum aestivum
  unsure (1)..(628): unsure at all n locations
  Clone ID: PAT_TA_94756
gctaactagagcttccagcaatggcgacctccccggtgctcttcctcctcctcgctgttttcgccgccggtgccagcgcggccaccttcaacatcaagaacaactgtggcttcacaatttggccggcgggcatcccggtgggtgggggcttcgcgctgggctcagggcagacgtccagcatcaacgtgcccgcgggcacccaaccgggaggatatgggccgcaccgggtgctccttcaaatgggcgggtagcgggagtgccaaacccggcgactgccggcggcaactatcctgtcctctcccgggcggccaccaacaacgctggccgattaaccatcngcggcggcagaccaaattctacaatctcgtgattnacgttnactttccatgctctctgcacaccgggaccctccattcaagacccaactcccncgccggaagctacaaacccaacactttccaanaccctgcatggnaataatatacaanttactctgtcagnaactcaaaattcacgcnatcaataaaagnttcttattaggcattaanaaagngtcgcttaaaacaattgatntaagcgcgtanaatttaccataanaggtttatganttttaatnagnataaaattn

SEQ ID NO: 94757 - DNA, 551 bp, Triticum aestivum
  unsure (1)..(551): unsure at all n locations
  Clone ID: PAT_TA_94757
caacgtgggacgaaaatactgatgacgaggatgttccctccgggagttccgaggatgttccctctgggagttccgaggactttccttccacgagttccgaggacattccctccgggagttccgaggaattccctccgganccgannggaaaggggaagcccatgtacaatttacagcacggtggatgaggtcattactgcactggagagaagctgggttggaacatcaaatctgattttgggatttgactcaccaaaanaacgattggtcaggtaanattcctttcggagggaaactcctgcatgccattaatccgcacccccaatccataatganaagcatttcctattaattggggcgaacactacacttttttgatgatgattacttgnatacangctttgttttgngatnttccnacaggngatcatnccncctcnacttttacnaaataacgccttgttgtgtttttaggagtcttgacanatacaaaaagatcaaattggncttcangacaatctttcacnctaacanccgggatnaatgtgaaa

SEQ ID NO: 94758 - DNA, 471 bp, Triticum aestivum
  unsure (1)..(471): unsure at all n locations
  Clone ID: PAT_TA_94758
cacacacacaacacacacaaacccgccgaagtgaaaccgacgagacaaggaccaaacaccaaaatgctctcatccaccgctctccggccgctgccgccggcgacggcgacgacgccagcgtaccccgccactgccaccgtcaccgccacctcgggcacgcccgggcggcgctcggtggcggtgcgcgtgctgcgggactacggctccgatcccgaagcgggagccttcactccagccggcagcatcctcgacgantcttcaagcaaggagaanctctgggnccagcgcaccaagaccagttcacagataattgcacgaccttnagggtgatgattgctgcaactgctgggagcctacttttgaatccaacaaatccaacaagactacgcaagaagatctcaagatgtgaagatcccgtcaaacccgagtacttataacacaccacatcgncaaactacggagaaatgccga

SEQ ID NO: 94759 - DNA, 618 bp, Triticum aestivum
  unsure (1)..(618): unsure at all n locations
  Clone ID: PAT_TA_94759
gtttagcgccggtgcgttcccagggagcgattttttactcctcctgaagggccaacggctggagatgcccttagacacgccttgcccgccgccgtgcaaaaagaactgatccctccagctccctcggacagtgagatcgatgttgcgcccaaaacataaaataaaaaggagcaatcctagacctatgtacagttacgtgaggtttttacgtaaatgctgatgagatgagcagagccacgctcagcgacaatatagttgatgctgctttaaataaacagtcttcctaagtctcgttgatgctatatctatgagattttacattgaaatccatgtaaaactatctttttagttaatttttctcttttatgttatgtcacttgactgaaacntgggtaaattttaancnactgagatntancatacaattgaataaataaacacggtatacttgggggggccngtaccaatncgccctanatgagtcgattancgcctcacgggcgtcgtttanaactctgacgggaaaacctgggttaccaacttaacgctnganaaaccccttcncacggggtatacaaaggccccgttcctccaaatnccaccgaagggatggacccg

SEQ ID NO: 94760 - DNA, 599 bp, Triticum aestivum
  unsure (1)..(599): unsure at all n locations
  Clone ID: PAT_TA_94760
gctctacccacatgatagtatgtaaacgaatgactagatacttttcatcagaaaaaaaaggaacgcgtagatattttacttggttttctttcatgttggccttaactaacaaacatgttctcagcaagttctccacctttgccatgggatgagaatgacgcttacacaacagaggtttttcaagttttattgtcaggtctatttacgcattctgtattttacttggagagtgaactctaaggctgtaccttccgcaaagtgctagcacctacagatgatccgaatttcctcctgtaaatgtcatggaggcatgagccacaacctcctccgtagaacattaaanacaaaacattgattcccccggtgggtacacaaacatgtccttccgattaattttccaatagatgatggggacaagttttcatccaagcccttttgctgacaatttttttggngcgcatataattaattataataactaggtgtatagagtgctacacatagaagtggacataccaactcgcaaatcgaacgtgacctaacaaaatanagtttggtgtcttctacgcgtcntcaggccctgtcagtggctccancgc

SEQ ID NO: 94761 - DNA, 638 bp, Triticum aestivum
  unsure (1)..(638): unsure at all n locations
  Clone ID: PAT_TA_94761
gagagagaactaatctcgagttttttttttttttttttttttttcaaattaagtctctagacgttgatagttcaattgttttctctcttaatgggagacaggctatcatcctacacggcttgttcaataacttgtccaattggacttgctacttctcgttcgatgccgctccccctgctcgagaattcggcactttcgttcgctcaagccggcgatcacacgagtctgaatctaaatactgctgcagtgctgcgaatacaatacactacgatactggctgcagcaagcacctacaggttctgaacctccggttggaaagcgtcggacagattcaaagaacactcgtccagttgaccaccgaaccccatgtcagccccgaggcctccgccggcggcgtaaccgtaaccgccggcaagctcgcacacggaggggtacaatctccaacgtgccggtgcggggaangggaancaaggcggcgtgaccggcaatgaatccctcggggccgcggccggcgggtccctgccctntcaaaccacagggacgctgcgccngngctggccagttncccctggaaatanacaanacaaggtncggggggcctncacnctgngccggaaccgcttccgtctgacgatanc

SEQ ID NO: 94762 - DNA, 625 bp, Triticum aestivum
  unsure (1)..(625): unsure at all n locations
  Clone ID: PAT_TA_94762
cacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaatactgatcggttcaagccggcatatgatatgttccgcctaaaattaaataaaagctcggacgaaataacagcgtcatcgtgcctatgcgtgtgtgtgtgacaacaaatattntacaattantcttctcgtcncgttttctcncnccanaaaattggngttgctggtgttcaaaaaaaaaggggggccngtaccaatcncctanangatctatacnccgctcacggcgtctttaaactctgacgggaaacctgggtaccaantaacnctgaaaaanccccttccaangggtaaacaaaggcccccgttcctcaaattnn

SEQ ID NO: 94763 - DNA, 231 bp, Triticum aestivum
  Clone ID: PAT_TA_94763
agctgaccaccatgggcctgatggggctcgtcgcggccgtgtcgtcgctcttcaccaacgtgatcagcactgtggggctgccgctgtcgcccatcatcgccgtcatcttcctcggcgaccggatggacggggtgaaggtgctggccatgctcgtcgtcggctgatctctcagctagtatcttcttgaccttggcatcatcaaggtagtgctggtagatgttaggggggggg

SEQ ID NO: 94764 - DNA, 484 bp, Triticum aestivum
  unsure (1)..(484): unsure at all n locations
  Clone ID: PAT_TA_94764
cccctttttacttttcaaaaaagattaactaatctaaagaaaaacaaaaaaggaattccattgaattgtatttttattgatcaattagaattgacttctagaacgtataattgtctaaaaagggccaatatacatacactattggaccttttgagtaagactgaagaagatcttctgagaattgacagttttcgtatggaagatagaaaacatatatgggacactctagagaagcatctcccaattgatttacttaagaataaactctcgttttaaatccattgcaattttttttcttcttctttttcgagatagaatannaagaaaacaanttagcatcttggtacaatctatattttcgcgaaatggatcataataaaatggattttaagtatctanggaagatcactngggagtaactattcctacatacctatggnactcacggntgantgantcaaaactacctaaaanagactaaatg

SEQ ID NO: 94765 - DNA, 512 bp, Triticum aestivum
  unsure (1)..(512): unsure at all n locations
  Clone ID: PAT_TA_94765
tttccatggctctaaagcgaatatcttgtttattgaccatgttgtgagatgaagccgctttcagaaggttgtggatgcgcggggtggcgcctgggccttgtcctggggcttggcggcctcacccttggttaactgtagcctgtaggcaaagtagcactgttcgaggcgtgctttgtacggttgaacctggataagtactcatactgctttcagctttggttattaagtgcccctgctggttccaagttaaggttgttaagtacttctgctgcttttacaagtctgtcgtgtttcttcagtcctgtcttcctccaactgccaagaccaaaccagcgccggcggggcgctgcttccacctgccaatggctgggctgtgcctcagtgcacgcatctccgccccaacgtctccctaaatcgttaacgccgatgtctccgngcgcnttggtgcatcnccgcggtgccgcctctcgccttgtaacanggcancaaacaacaggaatcggtagaagtnc

SEQ ID NO: 94766 - DNA, 499 bp, Triticum aestivum
  unsure (1)..(499): unsure at all n locations
  Clone ID: PAT_TA_94766
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttccgagaccctgtcttacctgccaccgctcaagcacggaggccctcctcaaagcaggtgggactacctggatccgctccaagtgggtgccttgcctttgantcaacaaggtcggntcatcttcccgtggagcacatgcgtctccccggggtactaacgacggccgctactgggacaatgtgggaactgcctatgttcgggtgcaccgacccacacaagtgatcaacgaggtggaggangtcaaagaagganacctgacgcgtactccgcatcatcggttcgacaacatcgcaagtg

SEQ ID NO: 94767 - DNA, 488 bp, Triticum aestivum
  unsure (1)..(488): unsure at all n locations
  Clone ID: PAT_TA_94767
gccgcaccctgnctgactacaacatccagaaggagtccacactccaccttgtgcncaggctccgtggtggcagtgcagatcttcggcangaccctgancggcaagaccatcaccctggnngtcgagtcctctgacaccatcnncaacntgaaggncaanntccaggacanggagggcattcccccggnaccagcagcgtctcatctttgctggcanngcagctcgaggatggtccgcacgcttgctgactacaacatccanaaggngtccacactccaccttgtgctcaggctccgtggtggcatgcanatcttcgtcaanaccctcatcggcangaccatcaccctcgaggttgagtcctcgngacancattnacaaangtcaangcangatcnaggacatgatggnatnccccggaccannagcgtctcatctttgctggcagnantcgnggatgggcngncgctcgctnanncaacatcnanacg

SEQ ID NO: 94768 - DNA, 502 bp, Triticum aestivum
  unsure (1)..(502): unsure at all n locations
  Clone ID: PAT_TA_94768
atagattctggtctggttcagtgtgtgtgtgagcttctcccttcttctgatcgcgtgtgtgtgtgtgtgtgtgtgtgtgtgagaaagagagagatcttgattggttgcacgtacgaggtacgtgcgtgcgtgtcggtcgggtggtcnatcatgtcgatggcgnagcanggacagggggcngcnacntcgcngccaccggngttccggntccacccgacggacnangagctgatcctgnactacctccgcaaccgcgccgccgccgcnccgtgcccggtnccnatcatcgccgacgtcnacatctacaagttcgacccangggacctccccncccaaggcngtgtacagcgacngcgagtggtacttcttcaagcccgngggaacgcaagtaacccaanggcatccganccaaacgcccgcggntccggctactgggnagcacnggnaccgacanaccancangaagcngccaaccngcaaggcgtcngngtcaagaangccc

SEQ ID NO: 94769 - DNA, 499 bp, Triticum aestivum
  unsure (1)..(499): unsure at all n locations
  Clone ID: PAT_TA_94769
aaaagccttacatgtatatataagaagaattatccaacagacatctttatttagacaaaaagctaaacaagacacacgacttaacacatattctgtgtcctcctcacccagccagattaatatggagctcccattctattgcttgtggcacggacattgtctccttcaagaaatctgcttattcttcatctgtcttccttgtgaagcttgcccacttcacaaccacatatacatagattctgtcaaacagctcatcaaagagttgaaaataagcaatcctccatgtcttcttgaacaggaacgtgcaaaacacactccaagagccccgctacaagtcccagcacaagaccaaaatagaagtcagtggctcaaattcccgattgctgcntccaagatgaccatggaaaaccgtaccatttcctggaacantcttcnganangaggccanaaagtcgttgnttccaatgtaataagtgctgggttgtcngcacaangggtn

SEQ ID NO: 94770 - DNA, 289 bp, Triticum aestivum
  unsure (1)..(289): unsure at all n locations
  Clone ID: PAT_TA_94770
gttagggtttagtagcggggaagaggaangcatggcggacgtcgngtaccgctgcttcgtgggcggcctcgcctgggccaccgacgaccagtccctccacaacgccttctccaagtanggcgacgtcatcgactccaagatcatcactgacaggganacgggccgttcccgcgggttcgggttcgtcatcttcgcgtcggncgacgcgatgcgccaggntatcgangnatnaccggncangacctntttgacgcaacatcancgtcancgangcacantcccgacgctc

SEQ ID NO: 94771 - DNA, 496 bp, Triticum aestivum
  unsure (1)..(496): unsure at all n locations
  Clone ID: PAT_TA_94771
gttatcttctaggccactacgttgatccgtacatggtcgctactcactccgatggatgccagggagcatatggttattgggtctatccgctgggagacggtagcacgggctatcttcaaccggttgtggctatcccgtttccctgtttttagctctttgtgagcatttttaccttttgagaccgagagactttgttaaacttttcgcttattagtaaattggtcgcatgcatcgttctgatgcagaggccgggggataacctccttttcgggaaaaatggggtgtgcgagagatgctctaagttgtccgcttggcccctgcccccggncgcgccagggcgcagccccaaaccctatttggtgccttctgcgcccgatacagtactatgcgcaatcggtcgcacacccccccgctgcgccgggccagtgtgtttgangcaaggtttgagcccaagatctcacgttaagnaacatgcccgaacactacgacaagccgn

SEQ ID NO: 94772 - DNA, 266 bp, Triticum aestivum
  unsure (1)..(266): unsure at all n locations
  Clone ID: PAT_TA_94772
ccgacggcgtcgggatccaccagaggcgtggctccgccgcaagagtgacgaccaaggaggaggatgagtactcctgcttcaactcgacggaggagaaggaggcggncatggacgaggagtggaanaacaggctgtggaagacctgcgtgtacgtcatcaccttcggcatgctcgtggngctgctgcttgggctcaanatgtcctggagcgccattaccgccgccctgagngctcatcgtcctcgacttcaaggacgcccgcccctg

SEQ ID NO: 94773 - DNA, 535 bp, Triticum aestivum
  unsure (1)..(535): unsure at all n locations
  Clone ID: PAT_TA_94773
tccacaggctctgttctccagtgattccgttttccacctataaaaatgaggagtatgcacggagacgacctcctcgactcaccgccggccacgcgcgctcaccccctccgtacgagccacccgccgtcctccgccgtcagcttcaaccccaacagtgctcttacatctcttgtagctagctggaaaagcgagcttgcatgatggaggactcttcaactaggagccatgtttttgaggggaatcggctgggctatgtaagaagtgaatccatggattccgctggccatccttcggctgctaggtcaggctcactgctaagtaggagaagtagcaggcccagttcaagggggtcatcagctctctcgcgagatgggcgactcgatcctgaactcaatgaggcattcccttcagtcagcagacagttgcttggtgatgctgatactcggctttggtcaagtcattgacagtggtgaccgaatgctancctgggagatgaggccgatgaagatatggaaatacattggntnaacatcng

SEQ ID NO: 94774 - DNA, 399 bp, Triticum aestivum
  unsure (1)..(399): unsure at all n locations
  Clone ID: PAT_TA_94774
agacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccangaggaaaagaaagcaaaagcgattcccgttagtagcggcgagcgaaatgggagcagcctaaaccgttgaaaacgggttttgggaagaacaatacaagctttgtgctgctaagcgaaacgtttgattgccgcaaccctaaaatgntaaantccaattttcccgnaagcattcactaactttaagccctganccccagttncaatggggaactttggaacccctttgatcaaccaaggncaactt

SEQ ID NO: 94775 - DNA, 181 bp, Triticum aestivum
  Clone ID: PAT_TA_94775
gccgcaagggctataacaaaaattgcgaaaatatctccttttaattggcgactatcaaatagatcagaaaatgttacgagatttagattaattgaattcagtataagttcaagacatattagagctctaaccatgtttcggcttgtgatcaatccatagataccaatcgaaaaaaaaaaaa

SEQ ID NO: 94776 - DNA, 169 bp, Triticum aestivum
  unsure (1)..(169): unsure at all n locations
  Clone ID: PAT_TA_94776
gacgcgctcctcgncganngcgtcctactcaatgancttgtcntcctcggacaccttggccgggaagagcangcgcanctgcgcntcgatcgacgaaagccgttcgatcttcccgctgccgccgcccggcgccgacgacgccatcgncgcctcgctttgaccggggggg

SEQ ID NO: 94777 - DNA, 485 bp, Triticum aestivum
  unsure (1)..(485): unsure at all n locations
  Clone ID: PAT_TA_94777
gcatcagatcagtcttgcatgccgtcaactaaatgaaagacaaccagaatataccggatctgcactgaatgttggcttggttatatttatttataaagtggcagtggtgtagaatatatcctctgccatggaaggaggtatttgatgttgtcagatggcatataggtcaataatgaggtgactgccggggtaatctcaggaagggacaatgacacaaattaactttgttgacaagctcacgatcacggggaacaagccgtcctgcagtgttccaagtactgcaagttgacgacaanttcattgttatnccatgtattncttacaaaaattcatgtggacaanggtaacatgctattacccccatnggtggnggtttgcaaattttccatccaatacntgaattttcccccggtagncctttcattagnaaggcgcactgatacaagtggtaaggaacctcttacaactcatccaaccngtgagnt

SEQ ID NO: 94778 - DNA, 520 bp, Triticum aestivum
  unsure (1)..(520): unsure at all n locations
  Clone ID: PAT_TA_94778
gtggctcagaagagctactggcatacaaccacattttccttatgttgttgattcatttgaagaaaggacagcagtttcagttgacagggttgctacctccagtaatacttcaactgcctctaaggatgctgactgctgcccaattgatcagcaatctcaaactttggagtcaaacattgatagcggcaaccacagaaaacacaatagccgagatcatggccagtctcacttcccatttagcaatctactttctaatatatggccaagggcacgatagaatgttcaaacggcaagaaaatgacccaagttccagaagatatgattcaagcatgaacaatgatttgggaagcaatcctcttctacccaaaacaccatgggtggcatttcaatgagcgaagggggacaaatgagcaaagccaacctaaaagaaaacatgggatgactngacaaaagatttgnncaaagcaagcgaaaaaacgncctccggngttaaaaaantncccggttggttgcaaccttg

SEQ ID NO: 94779 - DNA, 405 bp, Triticum aestivum
  unsure (1)..(405): unsure at all n locations
  Clone ID: PAT_TA_94779
ccgcgctccaacacacgcagacagacacacaggagccacgcgaccgaccaaccgcctggtcctctcccccgcgcgatccagcccaccgacgacgcgcggggcgagccctaacccgcgcgcggatctgggagctgccgcgggcggcgctccctcccatggtcccccgccgcgccgacggggcgcggcgccgctgagatgcggggcgacgcgccgccgcctaccgcgccatcggcctcctcctcctccgcctccccctccctcttcggcggcggnggtggngagctcttcgagtcggggccctcgccgctcgtcttcctgcccctgctcctgatccaaggcggcggcatggacctctcccgcgtcggcgagaggtctcagctccgtccgctccgcgcgctcctccag

SEQ ID NO: 94780 - DNA, 404 bp, Triticum aestivum
  unsure (1)..(404): unsure at all n locations
  Clone ID: PAT_TA_94780
cccggctgaacccttcgctcccagcccagtagacacacacacacgtagatacagcaactactactaatacagttgcgtacacgcgagagtgatccgattacgttagcatagcactagccattatttttccatttcatctcatccgggatctgtcagttacaccacggtgctagtanttgctgcggtgattccccgggaaagaaaaaagaggttgctgcggtgactcccaccatggangtgtgctgctgctccacctcgtcgtccctcctcnccggtggncgcttcgccgcgccggtggcgtccgcgcgggcgcggcantggggcgcngcgngnggcgngagggcagtcntgctggcgcanccgccgcntctcngttgcctcggtctcgaggcccgcacngcgcg

SEQ ID NO: 94781 - DNA, 497 bp, Triticum aestivum
  unsure (1)..(497): unsure at all n locations
  Clone ID: PAT_TA_94781
ctcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccaatgagacgatgggggataagcttcatccgtcgaagagggaaacaagccggttaccaactaangcccctaaattacgcncattgtnaaaagaagttggggtgcaaaagacagcangagttttccctaaaacaaccacctttttaaangtgttatacccactgattnaacgccctttcgctnnaaatnaacnggtaaacatttgcccaactgtnggatgttnaaagcaccgtagggaaactttcccctttaaaggaacaaccncaaaacggggtccacaaaacggaacaaaagtcnnttagtaacgaaacatggtgaagaaccatgccc

SEQ ID NO: 94782 - DNA, 488 bp, Triticum aestivum
  unsure (1)..(488): unsure at all n locations
  Clone ID: PAT_TA_94782
ttggattgttcacccaccaatagggaacgtgagctggggttagaccgtcgtgagacaggttagttttaccctactgatgacagtgtcgcgatagtaattcaacctagtacgagaggaaccgttgattcacacaattggtcatcgcgcttgggttgaaaagccaagtggcgcgaaactaccgtntngcccggattaatgactggaacgcctcctaattcaagaatcccaagctaagcatgcgacgcctggcgccccgcccgcccnccccgaccacgtttangggcgcnttgcgcccccaaagggcccttgccattgggtnacccgtcccggccgaattccgccgtccggcgctcnaaactcccttcccaacgggcggttggctgatccttngcanacgactttaatacncaacnggcattgtnattgcaaantngctttctcaacntcaatgaatttaacccattntcacggtccttaaaaaaaaaaaa

SEQ ID NO: 94783 - DNA, 458 bp, Triticum aestivum
  unsure (1)..(458): unsure at all n locations
  Clone ID: PAT_TA_94783
tctcactcactctccccctccgccgccggcgcagcgtcctccccgcgactccgatggccagcaagtgggtcaggcccgaggtgtacccgctgttcgcggcgacgggcgtggccatcggcatctgcgccttcagcctcctccgcaacatcaccggcaacccagaatcagggtcaacaagatggggaanggcagcangagtgcttgagaacatgangaaggcaaggcgtacgccnagnacggtctcaagagctattgcaagacaagaccccgaagattatgccagaatcaaaanttnttaacaaccccaaatgacaatttancccccngggaaccntattacaatgttgtggcaagtgaaactanttcaanattcaataagtttcccntcaaaatncanagnttcanaaatacccttatnnaanacatttattttnatggttgcaaaantnaggtgatgg

SEQ ID NO: 94784 - DNA, 472 bp, Triticum aestivum
  unsure (1)..(472): unsure at all n locations
  Clone ID: PAT_TA_94784
gtcgccgccgcgtccgcggacccggcgaacggcgcggccaacgacctcctccccaagtacggcctccccaggggcctcatcccgggactcgggtcagctcctaaaccttcgacgaaggcaacgggcaatttcganattcaactcgcggggaactgctaagtccgcttcggggaacaactcgtctactacganaaaggcctccgcggctgcctctccaaagggcggttnaacggctctcccggnatccaagccaagaantcttcctcctgggtctccgtctccggatcgtcgcgcacccgaagganggacctcnaatttcaatcngttnttctccnaagantctccgctcgctctttaacggtgcctnttcggggccaangccggggcgaaatcccgggttcccgggtaatnaaaaacttggctgnccccttnaaaaggtttactttaggaccggcttntttcaatntaaaan

SEQ ID NO: 94785 - DNA, 337 bp, Triticum aestivum
  unsure (1)..(337): unsure at all n locations
  Clone ID: PAT_TA_94785
gaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccaagcagcgtctcatctttgctgggcaagcagtccaggatggccgcaccttgcngactacaacatccagaaggantcaacctcaactggttctnaagntccttggggganngcaatatttgncaagaccntcaaanggcaaaacattaaccnccaggttnagtccc

SEQ ID NO: 94786 - DNA, 455 bp, Triticum aestivum
  unsure (1)..(455): unsure at all n locations
  Clone ID: PAT_TA_94786
gcggcttcctgcacgctcaccgtccccgcccccttcgccgccgcctcctcctcctcctccacttcagcccgtcgctacaggcgattcggggtggttgccatggcgagcgcggggcagaaggtgtacgctcccggcgtggccgtctccgagggcaacggcggcctgcccaagattaagcctcaaatccccgcacggaantgaaggctgaaatttatctgtttggagcatgcttaactcttgggaaggttcccaatggaaagnntctggcctttgtcaaaaccaaaagctgtgtttaaacggcaanaaccaatcaangggngaatcaaaatngtttncccaaatttggccctggcccaataaaaaaaaggtttccaaggaatntaattggccaataanggttcaaaaatncaaaaggnnttcaacgnanttttggaccnaaaacanccnaaaacttt

SEQ ID NO: 94787 - DNA, 504 bp, Triticum aestivum
  unsure (1)..(504): unsure at all n locations
  Clone ID: PAT_TA_94787
tctcattgtagagagatcagaccagagcctacctagctactcactcatcttcgtcaagaacttcaccatggttgtcccggtcatcgacttctccaagctcgacggcgccgagagggccgagaccatggcgcagatcgccgacggctgcgaagaactgggggcttcttccagctggtgaaccacggcatcccgctggagttctttgaccgcgtcaaagaaggtgttgctcccgaagagtaccgctccgggaagccgcttcccggtcgtcccganccggtgcaagacctggagagtggttgganggcggagccgggcggcgagccgttgcgcccgttngacacatggactgggaaagaatcttctactccaacgacgacacaatggcctcccgacccgccggcttnnaaaggaaacatgcggaattacgcgcccantcaaagactccccggacggtcatgggaggcatggncnaaactccgctnganaanggcccatnaangcgnc

SEQ ID NO: 94788 - DNA, 248 bp, Triticum aestivum
  Clone ID: PAT_TA_94788
cgccgctcgccgtctgcgccaacgcgcttctccctctggaaccgcgccaactacgagcccccctaatcgcccctcaactgaggtcgcgccccctccccgacgccaaccttcctctgtgacgcgccggcggcggcctccccccgcgcctccaccgccaccaccaggtaatctggttgggtgaaagtgcaggatttactgctgtataagtgcaaatcttgtttggggatgggcaaaggaagctggagaaa

SEQ ID NO: 94789 - DNA, 478 bp, Triticum aestivum
  unsure (1)..(478): unsure at all n locations
  Clone ID: PAT_TA_94789
cctaaggccaaatcaaggcgcatacccattttgtctgctcgtgttcgttcgggtccataatcgccaaggcgctattcttccccaccaacacactcggcttctccgcaatcgccaccgccacccaactgtcggcctccatgcatcgccccaacccccgccgccgcatcaattaatgccccaatccccgtttcctcatcaactaattcccccaccaccacccactctggtgtcgttgtggccgcttcttgccgccgatggagtaagtacaaggtcagctacacagtgggcgctagcagccctcaccataccaccaaacattcatggtttgtcatgacagattcctcntgaaagacttatccatggagccatcacangggttaactngaaagggttnaaacggcatgggancccnaggatttaacnggttcggccttaaatggaangnaaaanctatccatttgtgagggatttctaggtt

SEQ ID NO: 94790 - DNA, 445 bp, Triticum aestivum
  Clone ID: PAT_TA_94790
aaccagcccaacagacccacgactcgagcgacccaccgtgctgacccgggacgcgcgccgaggaatcggacccctgtctgtcgggggcgcccttctgtgtcaggaagcggcatgggggcgccggagtggtggtggtcgacgtggagggggctggccgtcgccgccacggcggcgtgcctgctccttcacgtggcggcgcgggtggcggacgcgctctggtggcggccgcggcggctggaggcgcacttcgcgcggcagggcgtgcgcggcccgccgtaccgcttcctcgtcggctgcgtccgggagatggtggcgctcatggcggacgccaacgccaagcccatgtcgccgcccaactccacaacgcgctgcccgggtgctcgccttctacactactggaggaagattacgggcgacgttctgatatggttcgggccgacccgcg

SEQ ID NO: 94791 - DNA, 337 bp, Triticum aestivum
  unsure (1)..(337): unsure at all n locations
  Clone ID: PAT_TA_94791
gtcacgagagcttgtcacccaggtgggggcgttaaggtggtgttggatgtttggtgtggactctggacctgggcttgtgttgtaacattgctggcttgcccggtccaagttggtaagtgggctgtggtgctgatgcgaaagcttccggcctctcaatccttggaagtggcaggcaccgcgttaggctgggttcacaagagcaacgctcactgtcctcttccaaacggtggaaaggataacaagcccgctgcaccatggggccgctcctgggtttaaaatccttcccataacagacaacatctttttnaaaaaaaagaaggcacccaagggggggggg

SEQ ID NO: 94792 - DNA, 481 bp, Triticum aestivum
  unsure (1)..(481): unsure at all n locations
  Clone ID: PAT_TA_94792
ggaagatgtttcttacattaaaaactaatataacataactctgccgataacagtttgtctgtttgagcaatatgaccggattgcctggtttccgataataccaaatgtttactttcatacatagtatgcggaaacactccaactttgtggttcggaggtggaagcggaaggtctgcgatgacaaaattttcatacaattcggtaggagataagttcggtcgtaaagtacatgggtacatcaaatcgaatgctcactccctttctatgccatctagtaagctatctaatttacaatcctgttgcgaaaattcaacgctgtcatcacttggtcatataagaagtttacnggaatttcctcccgtcgggtccccgtggtcaactctggcatatggggggtcaagacaatatatgggctcacatggncaagcctgtcaaacgcctnacggaagccgttctcaanactcaacgacccnggnacctt

SEQ ID NO: 94793 - DNA, 496 bp, Triticum aestivum
  unsure (1)..(496): unsure at all n locations
  Clone ID: PAT_TA_94793
gtcacgaggcccagaggcgatgcgagcgaccgacctgctagtctccccgcccgcacaccagccgctgatcgagctccgcgtctctagcggcagcgatggcggcgagcgagcgatcactgccctgcctcttcctccacggcgccagcgccggggcccacctcatcctcgcgctcgccgttgctgggagccggctcttcccccgccgcgggaaggacacggccgtcgccgtgggcgggttcccgtgctacgcggtggtggtctgcgccacgtgggctctggctttattccaactcctccttgccgcgtactcctgctacctggacgccggcgccgggtggccgctcgaccggtggtgggaccaagcggatgccgccacacgcgcggtggcgtggctgctgctcgcggcgtactgcattcaattccgccgccaangagcggttccccgcgccgctcagntctggtgggcgctcttctgctgctctcggtcgtcgccgtc

SEQ ID NO: 94794 - DNA, 298 bp, Triticum aestivum
  Clone ID: PAT_TA_94794
tgcggttgcgcgggctggtggatgtgtgtggtgaccgagtctgatggagaggatccttccgccgtcttgcgcgtgaggtcgaggtccgcctgcgtcagatcgagctgccgcgctaggccgcgcatctcttgcgagatctgcgcgttgaaggcggcctggagctcgatctgcttctcgtgagtcgccttctgatcgtcgatcttggcgagcagcgactccagcatcttggtgatgttggtgttcccctcgtccatggcggccagcacttgccgcgtcgccgcagaagccttggaagtag

SEQ ID NO: 94795 - DNA, 507 bp, Triticum aestivum
  unsure (1)..(507): unsure at all n locations
  Clone ID: PAT_TA_94795
acattgggatcagccatgcaacgggccaccaccagaattggtacgatggaaccactgtgagattgaagaagatagcacgaaccttgcacatggcggtcaaaggtgggccatgctgtctgcggtagatttgttgtcgtatgagtacgaagacattgtgctcctttctaacaacatcttcacggtgacaaaccagggacttgcttcatatggggacaaatcctatggtatactccctatctcctagtttatttgttttgatttttttcattttataanttcaaaattaaaatttagagtccccatcatatgctgagattaaaatgtccattaaatcgttgccttcatgttataagtaaaagaaacaaactcgaantttggcacgaattccgtgcagcaattacaccacaagggctggcgcaggantaattccnccttgggggcctccggactgacttcaacgccttacacaccgcctttgatcaatacatgtgngnccaatagtggatg

SEQ ID NO: 94796 - DNA, 494 bp, Triticum aestivum
  unsure (1)..(494): unsure at all n locations
  Clone ID: PAT_TA_94796
ttttttttcaagcaatgcaccaaatctttaacctcattaattttccaatcgaaataaatatcacataatacaattgaggcacatcaagctcggcacaaaggaatagaccaaaagaaccacttaatagatcaggattagagcaagtcatgtacatagaaagtgatgcattccgcagattgaaagccattcaacccaaaatgtgggtagcatttgaaaacacaaacttttggaagcagatgatgatgctaagcccataccatgatagggaacgtggttctggatgctgatgcacattatagcaaaagtagcactgcagagtagtagacaaaaaataactttgcttgggcaattcgaaaacttaccaagcaaccaagctgcccctggaaagaaaaacaccttaaccattttatacgttcctncgatatcacacatttgagataatttttaaaaggccccatttttaatanaaantntaanttaaccacccaatacan

SEQ ID NO: 94797 - DNA, 500 bp, Triticum aestivum
  unsure (1)..(500): unsure at all n locations
  Clone ID: PAT_TA_94797
ccaactggtggtgccggcgacaacggcggcgatgcggctgctctccggcgcctcggcctcccgcctcccctttttggcgcgggcaaggcctagatgtgtgtcgcgctattcctccgcctccgcttgccgggccgcctcctcgtcagctgcgcccgtcggtgacggcggcgcgcggaagccgtggttgttcgttgggctcgggaaccccgggaaagatgtaccaagaggactcgccacaacgttggattcnagatgattgatgctatagcaagaagcanaggtgtatcaccaagcaatatcaattcaaagcaatggnttgcaaaggcctattgganatttcctaacatgcttgccaaaccgcaaacatttatgaatgcaancgtgatccgttgggnactggttcanatttcaagatacacttaacaattgttgtatgtacnatgatctggattaacctcccaaatgcgtcnantgcaaaaggtggcatgggggcanaatgg

SEQ ID NO: 94798 - DNA, 505 bp, Triticum aestivum
  unsure (1)..(505): unsure at all n locations
  Clone ID: PAT_TA_94798
tggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttaagtagccaagaggaaaagaaagcaaaagcgatcccgttagtagcggcgagcgaaatgggagcagcctaaaccgttaaancgggttttttgggaagagcattncaagctttttctgctaagcgaagccgtttnattccccanccctaantggnttaaancccaatttacccgaaanatcaactagctttacctcctgacccnattacatnggnaacgttngatcccnttgttgatcaacnaaggccactttgcaaggnttataccctggggttgnccgatacgaattttacgtttagggaaaaagngaaaaagaccccatgggtatggaattaaacttn

SEQ ID NO: 94799 - DNA, 506 bp, Triticum aestivum
  unsure (1)..(506): unsure at all n locations
  Clone ID: PAT_TA_94799
gctccctcgatcccatctcgcacaccacaccaaaacctaaccctagcgatcccgtcgccggtgcccgaccttggctcgttcgatccaatctcatagccgccgccccaccactttcttcaccggcgttcaaccgagccgcgtccctccaggatccacgcctcctctcatccccaaggaccatggtggatgttgcacgtcaaaaaacgggagaaagggcgccgcccccagtgccggccgccgccgcccgtcgccctccactttctgctacaactccacgcggaggtggtggaggcggagctggtcgcggccttggtggaaaagggggccaanggctttccaatccgacctcgaagcctcatccaacttcaacgtccgcaagaagttgaagactagtccttctantccacaatgtgaggaccatgttaatggataattgcangatatgcacattgttggaggagtacactcttganagtgtgatgatatggcaacatcttctcattccc

SEQ ID NO: 94800 - DNA, 178 bp, Triticum aestivum
  Clone ID: PAT_TA_94800
ttcaagagctcatcaagtttcattccatcttcttaagttcgtgttctattcctccatgtttcagccggagtgcttcctaaatcgtttcagtcttattcgtttcttttctcattctaaccactccggttagaatgagttgtttcatagtctatctgattccgtgagtttgcgattctcg

SEQ ID NO: 94801 - DNA, 288 bp, Triticum aestivum
  unsure (1)..(288): unsure at all n locations
  Clone ID: PAT_TA_94801
ctctctctctctctctctctctctctctctctctctctctctctctctctctctctctctctctctctctctctctctctctctctctntctctntctctntctctntctctctctctctctctntctctggtggnngganaagaaagaanctcancaagaaantacgcnancgccgagcaaanaaggnaagcagcgtgcagaggcggccaacagnanaaacaagcggggagagaagatggntgnggcggngggtgcggngagcggnggaggnggagtggtgaagcat

SEQ ID NO: 94802 - DNA, 487 bp, Triticum aestivum
  unsure (1)..(487): unsure at all n locations
  Clone ID: PAT_TA_94802
ccgttgccccctccctccctccctcccctctccacccgtcggctcgggcggaaccaaataggcacgcacggctagggtttatccagccgcccgccgccgccgccccgcccgcccgccgcttcccgcggncgcccgaccagggcttactctcccctacccaccaccgangcgccgggccatggacgcggcggcgctcgacnacgtgatccggcgactcctggaggcgcgcggcgggcggacggtgcgccccgcgcanctctccnacgccngagatccgncgcctctgcgccgccgccaatgacgtcttcctcagncangcccaacctcctcgagttcgangcccccatcaaagtctgcggngacatcatggcaatattctgatctcttcattatttangtatggtgngttccaccggangcgaactattttctgggtgacatttatnctggaaacagagtattnaanattnccttctgtttgttaaan

SEQ ID NO: 94803 - DNA, 335 bp, Triticum aestivum
  unsure (1)..(335): unsure at all n locations
  Clone ID: PAT_TA_94803
ccgacgtcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggctcccagttcttcatctgcaccgtcccctgcaattggtcgacggcaacacgtggncttcggcgaagtcgtcgagggcatggacgtcgtcaagaantcgagaaggtgggtncccgcagcggaactgtccnagcaantcncatcgccgaatggcggcantccaaattcgttcggccgccggtc

SEQ ID NO: 94804 - DNA, 494 bp, Triticum aestivum
  unsure (1)..(494): unsure at all n locations
  Clone ID: PAT_TA_94804
tttttttttttttttttttttttttttttttttttttttttttttttttttttttttttcaactttctttaggctcaacaaacatgtgcagtgnactttatcttcgttttcttcngcaaaaatgagttaactgaacctcattgcacttaatttttttacaacaagaaggcatccaaactatccaaaatacaaactaccactgaagcacncccgcactcgcagaaacaaattgcgannanatccgaccatgagttgtcncgtcggtggattgcagacccagaanaagtgcantattgcgcccaagcaagatccaaaaagcancaaaattactgctgaacttcaaccgtttggnacccgcactgnagcttttgtttcctggcgcggcaaagcccgtcctcaccatatatggancagcaggagaangcncggcgccagcgccatgaanccacggtgaccacaaancaaaattaagcgagcttaaaaaantcaaatga

SEQ ID NO: 94805 - DNA, 245 bp, Triticum aestivum
  unsure (1)..(245): unsure at all n locations
  Clone ID: PAT_TA_94805
agcagcagcagctgcgcacagcctcctcgccccgtccccaactggcgaagctatctgcagaaccccaaagaactttcgaaccttctcgaagcaagcctcaaccccccttgattattccctcgaaaccctagatccccaaacccacgcggccacctcctcatggatnatccatggcgcttcccagccggcgccggcaacgactctgccccgtctgncggggccaaactcctttttnggccngntgt

SEQ ID NO: 94806 - DNA, 506 bp, Triticum aestivum
  unsure (1)..(506): unsure at all n locations
  Clone ID: PAT_TA_94806
ttcagtttttctttgttttcttcttttcctttttctttttattatggtatttattttcctttttttttcttcaccgattttcttttgtttttctttttcttcttcgttataccttttttcctgttttcactgcttttccttatttttcagttttcttctaaatatgtggattttctttgtttccttctcggtttcttcattttctccgccttccttttcgtttccttgtcggtttttaagtggtttccctttttctttctccgttggtgttctttccttgnttccttgttttccacgnttttttttccttggttccttcctccggtttcaatggcctccaaatacacgatgaacaattttttttccgttaaaaaaaagttccgaacactttaangaatacangatcgagattttcaaatacnangggaacaatttttaaagggaaaaactttttcnacacgcaatggtncaaatnaanatacacaaagaacattttattacatgtg

SEQ ID NO: 94807 - DNA, 342 bp, Triticum aestivum
  unsure (1)..(342): unsure at all n locations
  Clone ID: PAT_TA_94807
tcgagttttttttttttttttttttcgaccaaagaagaaactaaactgcaaacagcttagtctatgacagaaactcaggaacatgtcgccacacaatctcaggccaacacagttagagcagaagcgctgaatcatcacaatcacatggacaaaacgcagcaaaatcttatcacccaggcatagcaccactgcaaagtctcgattccgcagacgcatctggctacaatattcattcaagcaaagagtacgntttgaagcaatttccnanaatccaaanggggganagngtggtttccggacaangtttcctttcgagcgagttnaggccnnggttttttgcgg

SEQ ID NO: 94808 - DNA, 494 bp, Triticum aestivum
  unsure (1)..(494): unsure at all n locations
  Clone ID: PAT_TA_94808
ctcgactggaaggcgaggctgaagcgcgtggccaaggaaggcgatggcatcctgcgcgctcacacgaggagatccgcggagcgcaaacggggcgatggggttgcgaggaaggctgttcccgttcataagcgcgtcgctcgagcggcgacacgcttcttgcccttccgccgcggcaaggacgacgacggcgatccgagcgatgcgacggtgcggaggtcgagaggctagcgcgtgtcgccgacgattcttccggtactccagttggggggcgtccgaaagagttngacggcgtccatggaattcctgcaagagccgctgctttcaaggaaagacctgggantctccctcccgggagcggcaccngggacncctcctggctgctccaacccttgcaacaggaagattcttctcttcctctccctgcgacnacacgcggcgtngganaagaacgtnaactctgcgttgtcttccntgccnaaggggggggcccgtac

SEQ ID NO: 94809 - DNA, 483 bp, Triticum aestivum
  unsure (1)..(483): unsure at all n locations
  Clone ID: PAT_TA_94809
ccccaccgaacgaagccgtcgccgcttgcccctgcggatccgccgccgccacttccccctgcagatccgccgccgcctggccccaccgccatcgcgtcccaatggccgctcgcccccacctgccacacggctcgactgctgagggagccgtagtgccccacccgctcttcggctcggccactcgcctccaccgccgagggagcagtggtgccccaccggccgttcggctcgaccgctcgcctccaccgccgagggagcgtcttgccccaccggcgttcgcccgagcgancgtttngagatnccganccctccaaacccgaggcaagtgttacgaacggaccgttcgagggagcctnctgctctcatcggagtttatcgcaagatgcttctccccggatttaggatgtnctgctcccccggaactaagacttcngagcggaaatccctgtccnccggactcatgccggtgggctctggacnaaa

SEQ ID NO: 94810 - DNA, 342 bp, Triticum aestivum
  unsure (1)..(342): unsure at all n locations
  Clone ID: PAT_TA_94810
gaaatcacaacacaacaaacgggcataaccacgtacacgtttagaggaacctgcaacaacgaatacacgtaggcaggaaataccaagagaagagcaccaggagaaacgaaagaaaaaattataacaacaaagaaagaaaaccgcagaataaataagaaaaccaaacaacaaaacaaaagaattttttgaagtaaaacaaagagaaaacaaaaactgggggaaagaaagaaaagaagaaaaaagtaacataaaaaggaaacagaagaaaaccgggtgcaaaaagaaaagtaaacaantaaaacaaantatccggtggaaaaacccgagattaagaaaaaaaaa

SEQ ID NO: 94811 - DNA, 508 bp, Triticum aestivum
  unsure (1)..(508): unsure at all n locations
  Clone ID: PAT_TA_94811
ccgaaacctcgtgaagttgcacggttgttgcatcgacagtaagacgccacttttggtctatgagtacctggaacaagggagccttgatcaagcaatctttggcaagacagacttgaacctagattggagaacgcgcttcgagatatgcgttggcattgcaagaggtctagcatatctccatgaggagtccagcatgcggatagtccacagggacatcaaagccagcaatgtcttgctcgacgctgatctcaaccctaagatctctgacttcgggctggccaggcattacaaggacagcatgacgcatctcaacaccggagtcgctggcaccttgggtatctcgcacccgagtacccatgatgggacacctgacggagaaagccgacgttttcgcattccgggtccttggactggagatntccctgggacgcccggnactctatgacatctcgagggggggccggtaccaaatcgccctatantgagtctattaccgcgctcacgggcn

SEQ ID NO: 94812 - DNA, 472 bp, Triticum aestivum
  unsure (1)..(472): unsure at all n locations
  Clone ID: PAT_TA_94812
gcaggtatgagtgtatttagatgtattttagttctagatacatctatttctgcgacgagtaatttggaacgaagtgagtactcccttcgttcgaaaatacttgtcgggaaaatggatgtatctagatgtattttaattctaagatacattcattttcgcgacaagtaatctggacggagggagtaagtacagtagtagtattctaatccaaccgtctgggttttcttttgggtgataagatattccgaaagatgacgtgggccggaccctgggcataatcatangatcttggcaaggctggcccatcgtggcctcanctcctccctcaaagaatcatgttaatnatttaactagtttcccccggaaaaantcattctccgcatacgggnagccgggcccgataccgaacaactngcaaaagacagataacactacacnagggacttcacaaaatcttaactcactggcaagn

SEQ ID NO: 94813 - DNA, 251 bp, Triticum aestivum
  unsure (1)..(251): unsure at all n locations
  Clone ID: PAT_TA_94813
gcggccggtcccccaccgccggccggcgccaggaggagcgggcggggccccgatcggtgcgcccggncacgccccatgcctgcacgcggtggcggcggagggacctaccagccaaggctagaccttggcggcgcggcacccgagccgggctccggggcgccgaggaggccgtcgccggcacccgnctactggtcgcagagcccctcacgtgggggggctgagcttgcnggccggtggggcagagcangcgt

SEQ ID NO: 94814 - DNA, 397 bp, Triticum aestivum
  unsure (1)..(397): unsure at all n locations
  Clone ID: PAT_TA_94814
gtttttttttttttttttttggttgaccaacaaatactcatgttgaagatattccggtgatcagcacgtttcattagaaagatttcactacacaagaacatgtatacatatatacatcgacaattaataacatacccattatccaagctgtcaaaagaaaaggaaagacatttagcatctatgagggcatcagcagtgtatagaggctgggctgcatctatgctgggtcccaccttcagcctctaaggttgtccgttgaacggacaaacgaacacgtagctcatgttgatgcagacngagatgaagtgtttgcgccggccgtggccgtnggcctcgcccgacgaactcttccagtaccantggcggtcccaaaccgaccaagcnccaaggggggggg

SEQ ID NO: 94815 - DNA, 467 bp, Triticum aestivum
  unsure (1)..(467): unsure at all n locations
  Clone ID: PAT_TA_94815
tttttttttcnaanatttcatcttacattctgaatgattgcncagncantatcantccatacanacacagtantatnttcaaatgcttttgcttaatcaantgtatcaanacaagccanncantgcaactcactgantnacgtgtgaatnaacgcacnggtaacataagactanggcttantagccttcctcgggccttcatcctacaccttcatcttgcgcaaccacttgantgagctcncgagctcactgtacncngttgccggcggantgctcttgctctcgatnccataatcatacacctcatatgcatacggaaccctcnccgcccgacacaaatncctgntgaatgtcgcgtacgccggtggctcaagcttcatccgagctcctannatggacatgtnnatcncgatggnttntcatcgngancacgnggggccggtaancnactccncctntagcgagtc

SEQ ID NO: 94816 - DNA, 518 bp, Triticum aestivum
  unsure (1)..(518): unsure at all n locations
  Clone ID: PAT_TA_94816
cgaggcgatggcataacacaagcaacaacacttcaagggtcagaatcacaagccatttcggtttggaactccgtactctccttctaagcaacaatagtctttcaggtggattcccttcactcctacgacagtgccgaaatcttcttttcctcgacctagctcaaaataaattgagtggagacctacctgcatggattaagtgatcgaatggcagctttgatcatgctacgcttaagatcgaacaactctcaggtcacgttccaattggaaataaccggactcttgctcctccgcatccttggacctaactaataacagctttaatggggatattccacgaatttaagtgaactcaaagctttggactgccattaatgaactgtagntccaagaaaacatccttccacaagaagaatatattgggggactcctacgacaatatggggctgactggggatagttatcagttgcataaaaggcaagtgcttgcctacagggagatatgtatatttgatgan

SEQ ID NO: 94817 - DNA, 515 bp, Triticum aestivum
  unsure (1)..(515): unsure at all n locations
  Clone ID: PAT_TA_94817
ttttttttttttttttttttgaagaaaataataattgctgcgtattcattctgtgtacagcggtaattacaagtgtgcctcacctcaagaaaataataattgatgcaatcttagataaacaagacgcattctatgagaagcagttccatccaagagagtaactagttagcgtatctcgagaaatgcacaaatcctagccatatcggcacgaagatcctcaaatccatggctccggcttgacagtgcctccccttgagcacgcgtgtcctgggtctctatatctcctgttattatgaacccgaatcccactggtatgagagcaaagacgataatcccatcataatatagggatcctgcacctgaagttcccgaaccgaaatatcgcgcccacgaatatcgaggcatcatcgcgatctcatccgcgggcatgaacacctaatgaaatcttgaanattccaagcgtnggtttgcccgtgggcctacncttcttcaatcngnggtttgccancgtanan

SEQ ID NO: 94818 - DNA, 373 bp, Triticum aestivum
  unsure (1)..(373): unsure at all n locations
  Clone ID: PAT_TA_94818
ccacaatcagcaactgaccctgtaataccttacctagctagctaggtgtagtttgcttgagccaagatgttgggggtgttcagcggcgaggtggtggaggtgccggcggagctggtggcggccgggagccggacgccgtcgcccaagacgcgggcgtcggagctggtgaagcgcttcctcgccggcgccgacccgccgtgtccgtnggagctgggatcgctggggcaacctcgcctactcccacgccaacatccctcctcctcccaaggctttccctgcaaaagatgaatcttctgcctgttccaaggatccttggacacttggggcggctgaaccannaataaggctctccaaagggcgggaacaagtgtcc

SEQ ID NO: 94819 - DNA, 472 bp, Triticum aestivum
  unsure (1)..(472): unsure at all n locations
  Clone ID: PAT_TA_94819
gtctgctcgaaggccccgcagacgctcttctggcgaagatgttgactccggccccttatacggtgccggagaagaccaagaaggccaagggaactcgaaagagttcccgacaccaggcgtcgtcggactcaccgtccgatgactctatgatgcactcttcccccgaagacgaggaagaagaagaagatgctcccccaccgactgggggagacaggaaaaggaagccgccccaaccggggaagccagaaggcccaagaaaggaaagatctccttccggacggttcaaccgccgccgacgaagcgaagacaatggttcccaaggtcaancccaaggaattctnagtatccnntacaaattatcatagatccttcgttcatgctttcctaacaccgaaccattttcaagacncacnacatatcaagnatcatcggacgtcctntgtcctcgacatggtacattcatcccgacgca

SEQ ID NO: 94820 - DNA, 299 bp, Triticum aestivum
  Clone ID: PAT_TA_94820
gttggaggccttgaagtcgcggtagatcaccggcgggtcggcatcatggagaaaggcaaggcccttggccgcgccgacagcgatcttcatccttgtcatccacgggagagagccattggtacctgaagatggtaggatgtttcaagatcagtttcctcctccacgttgaccaagagttgtagtaacttgcaagcaccaggaagttggtaggataaatatttttttaatccaaaatatccagtatccctttttaagtaaatatccaatctccacattcatctgattttaaaaaaaaaaaa

SEQ ID NO: 94821 - DNA, 322 bp, Triticum aestivum
  unsure (1)..(322): unsure at all n locations
  Clone ID: PAT_TA_94821
agcgcgcggccgccgccggccggatctccatgctccggccacccccgcgtctgctgctcccagatccggcctcgtctgctccccccttccaggaatcaggtgtgggaactgtgccccggcgaccccgcaccgtctctcccgtcttcaccggcagctccccgtcggccacccccaacgctggtccacgccccagcgagcgcgctgtcgccgcctcccgccgagatgtctgctggtccgcaccgcgcgtcgtcccgcaancaagcccctctgttgctccattccatctggatttgggcccgcccggcgcttgggccgtccgtca

SEQ ID NO: 94822 - DNA, 478 bp, Triticum aestivum
  unsure (1)..(478): unsure at all n locations
  Clone ID: PAT_TA_94822
catacatttatctgtcttcctgtgcatgcttgtttgtcaaagtggaatgaagttgtttttgcagaattcctaaaatagttatgtgcttgtatgttttatatgtttagaatggatcataatcatgaattcatgttgtatgactaagtttgaagagcctgggattgtgaactttagtctacttttagataaacctgttgctttcaattcatagctagaggttaatatcaaaggagtactgtgtgactaactgtccttatggaatattgagctgggggtgtgtttcctgctttcctctaattccacatttatntccttaaaaccggtataataaaactaatggtcaatttggnttgctgtctaatatgatacataatttaaccctaacacagntcnataggaaaatgcacaattaagatatnncatatcacctgaatattgctggnnaatccagctgtgtgcttgggcgtagctaaaaaag

SEQ ID NO: 94823 - DNA, 495 bp, Triticum aestivum
  unsure (1)..(495): unsure at all n locations
  Clone ID: PAT_TA_94823
aaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgactcaccccggggcaacggcaccggcggcgatccatctacggcgagaantcgccgacgagaattcgtccacaacacaccaagccgggatctctccatggcaacgcggggccaacacaaacgtcccattctcaactgcacgtccctgcaatgggtccacggnaanactggtcttcggcnagtctcnaggnatggactctcnagaaca

SEQ ID NO: 94824 - DNA, 285 bp, Triticum aestivum
  unsure (1)..(285): unsure at all n locations
  Clone ID: PAT_TA_94824
aagaagtccttttancttctctcttttatttttattgttttgaaataattataaagaatttgttgaaatcaaattgatccacttttcaaatttgantaaattcaaaaatgaaaaatatgaaactccaactctctccttgggtccttgagttgcttaagatttcttggatcacaancaaaactaaacaacaaaatgcaataaaccatttatgcatatgaatgatctatgtataacatccaaattgaaaattaggatgttacaaacctaacccccttaagatgaatc

SEQ ID NO: 94825 - DNA, 342 bp, Triticum aestivum
  unsure (1)..(342): unsure at all n locations
  Clone ID: PAT_TA_94825
gaaatctcaagcttagcacagaagcaaaacaatggcggagcagaccttcatcatgatcaagcccgacggcgtccagaggggcctcatcggcgaggtcatcagccgcttcgagaagaagggcttctacctcaaaggtttgaagctccaagaacgtggagaagtcgttcgccgagcagcactacgccgattctgtcctccaagcctttctttcgctgggctccgttggagtanatcctctcccggccggttctccctatgncctgggaaaggcaagacgttctctcccantggacgnaaattatttgggccaacaaaccccttgctcctancccggacanacgt

SEQ ID NO: 94826 - DNA, 498 bp, Triticum aestivum
  unsure (1)..(498): unsure at all n locations
  Clone ID: PAT_TA_94826
ttgtattctgcttgggtctaggcctttcattgtcatgcttcgccacacatttttgccaagcttgcctaaagttttcaaaatgaaaaggaggtgcacttgcgcacagctgtcgtggtcgcaccgcaccctcacacagttgcacctgcatgccgcggtcccaccgcacccttacacagttgctcctgcatgccacaaacccaaccaagggaacgcaccctcgctgacacgtgctactgcatgtgaacaaatcaaactcagccatcctaccgctgacacataatttcgttcatacattatgtttatccaaccacatgttggggaggtnccgtacgggccctgcngtggtctgttggggaagaagaagagtgaggaagaanggttaaggagacgtatgatattcaccaaccgcctgaaangatatactgacccaaatctgaanncaagtgactgcatacacatatgttttacatnnanaagtccctaaaaacacaanatntg

SEQ ID NO: 94827 - DNA, 432 bp, Triticum aestivum
  unsure (1)..(432): unsure at all n locations
  Clone ID: PAT_TA_94827
actagctggagcatatatttcaggatcttctaatggggggctgtttagtttcctagttccatgcttttgttggacaagttagaaatgaaggtcccctaaaatggtatctgattagtgggcaagcccacatatttacaaatcaactgaaacactaagaacatttggttcaataataaacaatttttattggttcactttcctacatcacgcacaacaagttgaattagcctagaaaattaaactttgtttgtctgcataaagccttggtatttcagcttgtttgtctgcataaagccttggnttaattttcagcctacaaaacgttttgaactgcaagagacaacagaatcaactttgaatatttcctaagtacaaaccagcaatatctagaaactaacaaaattgttacatcaanacaagaaatcataanag

SEQ ID NO: 94828 - DNA, 440 bp, Triticum aestivum
  unsure (1)..(440): unsure at all n locations
  Clone ID: PAT_TA_94828
gtcgacgttcatataacaccactaagagaaacaacaacatacctatcatcaaaatatcaaacgaatacaaattcacatgattacttatgacaagacttctcccatgtcctcaagaacaaaagtaactactactcacaaatcatattcatgtccaaggttagaggggtattcagtagcatcaaggatctgtacatataatcttccaccaaataagccaactagcatcaactaaagatgtaatcaacactactagcaacccacaggtagcagtctgaggttttgaaacaaagattgaatacaagagatgaactaaggnttgagatgagatantgctgggtgaagatgttgatgaagattagtcctcccacgatgaganggttgttggtgatgatgatggcttcgatttccccctctcggagggangtgtccccggcggaata

SEQ ID NO: 94829 - DNA, 517 bp, Triticum aestivum
  unsure (1)..(517): unsure at all n locations
  Clone ID: PAT_TA_94829
acaatttgaatgtaaaataatccaactcaaaaaaatgaactgaatgtgaaatacattatgccagataagaattctaggtgccaaatacattatgtcacagaagaattctaggcgccatcataaaataggaatcctgacataaaaggcacgtcccggtgattccaaagctagggactcgagggcatctaaaatagatgctgccatgcacacttctcataagatggagtcgatctgtagtacaagcgtgtcctcatttgccaaaaagctggagtcaatctgtgcaagaaactacacaaggcaagactgaactatttcaagttgcacaatgcttccgtgatagacatgttgatccnttcaaaatgccataatccaagcttaattactttngataaaactcagaagttatgcatttcttggccaatggggaatagttatatctgaaacgtncaatatctgtaagaagcatccaattgntatcaaatttggttagggngaaagcaagctttatttaattctn

SEQ ID NO: 94830 - DNA, 513 bp, Triticum aestivum
  unsure (1)..(513): unsure at all n locations
  Clone ID: PAT_TA_94830
attatgcaaatgacgatttttggcttcgtagtgtgctgtcacgaagtttgccgcctcctcagtgatgaatgcctcagccattgatgcttcaattctacgtttattcttacatttttgtcgaagcttcttctgcatcctctcagttgggtagcaccaacgattttgcacgggcccccccaatcttgcctcggtcgggagatgcaaaatcaaatgttgcattggattaaagaagcccggtggaaagatcttctctaacttgcagatcaactccggcgccaactcttccatttcttctaagcacgccaggcgatagttcttttgcacaaagaacacggaagaaatagccgagttctgccagtactagccattcatcctcanggatgaagccacgcaacatcaccggcattacccgctcaatccatatgtgccaatcatgactcctgagacaaatatctcaatttatcaagactggtccctctgtaatcgctgcataccatcggggaacanaacgca

SEQ ID NO: 94831 - DNA, 222 bp, Triticum aestivum
  unsure (1)..(222): unsure at all n locations
  Clone ID: PAT_TA_94831
gcgacggcgacggcgacggagcacgtgacccgcaccgaccggcggcgagcccctccggcccccgatcgatcgattcgcgccgcggttcgtccaactgccccggccgcgtagggctcgcgtaggggatcgatcatggagctgccggccgccggcgggggccggcgcacgagctactcgctgctgtcccagttcccggacgacccggnggacgccggggcatcc

SEQ ID NO: 94832 - DNA, 490 bp, Triticum aestivum
  unsure (1)..(490): unsure at all n locations
  Clone ID: PAT_TA_94832
cccattcctcgccgccgccgccgctccgtacccgctcgaagccgacccgaccatggcggacgtcgacgttgacacggaggtggccgcgggcgcgcagccgaagaagaggacgttccgcaagttcagctaccgtggcgtggatctcgatgccctcctcgacatgtccactgacgaccttggtccagatgttccccgctcgcgcccgcagaaggtcaaagaggggctcaaagaggaagccatgggcgctcgtcaagaagtgcgcaaaggcgaaaaaggatgctcctgctggtgagaacctgagcaattgaggacaatctccggcaacatgatcattgtccctganatgattgggancttatcggttctaanaanggnaaacttnaaacaagttngaattaaacctgaatattggcattacttgcaaattttcaactcctaaaaaccatntaacacggtaggccgtatcggngcaaaancttcccggtnaanc

SEQ ID NO: 94833 - DNA, 407 bp, Triticum aestivum
  unsure (1)..(407): unsure at all n locations
  Clone ID: PAT_TA_94833
gttcggcaggcggccccctagtaagaagggcaagcctacgacgccggtgacctccgtccaaccgggggcaccggataatttgctggaggtgcttaacagcgcctccatcgactaggagcaccacactattatgagtgcggtgatccagaaggttcaatccgccaagagcgggctgactgaaacctgtgccagcctgctaacaggttttgaggtatgtttgaaaatatatgaaaatattaccgcatagacagtacccctgatctcctgtttggcgttcaacnaaggaaaaacccaatagaggtttttaacatcctccncaaggatcctaacataattatttcnatatgcntttgcnagcttcccctgctgactctaacgcaanaaactgcggaggtggncctttttaa

SEQ ID NO: 94834 - DNA, 488 bp, Triticum aestivum
  unsure (1)..(488): unsure at all n locations
  Clone ID: PAT_TA_94834
gccatattatgatctgtcttaataatatacggaaatgatggagatttgggagaatggtaatgattggaatcaggattttgcaaacagtaccttgatgaaccttcgaatatcatctctgtactttccattccactcagcccaccttctcctccagcttggcgtcggcgctgcgtgagctgcagtggaggtcgacgtanatnaggagctcgtgcgtctaccgcacgccatcgacacattggagtgttgatatagatntgcttgtcactcttgagctcctgggttgccattctccaggtcaaagaaagccaacagagattaaccaccacaagcatgtcaaaccttgacaaacacaaacgaaagagcatagcanaaaaagtacaagctgaagaaagaaaggaaagagatgcangtaattctacgcttgatatatcaaaagcaaggcgaggatgtttactgataacactgaatctacaattatcgccgcaagg

SEQ ID NO: 94835 - DNA, 241 bp, Triticum aestivum
  unsure (1)..(241): unsure at all n locations
  Clone ID: PAT_TA_94835
gagaactagtcatgccgtatttgtgggtgttgtaaaactctaaactctattctctttttatttaattgatgaggcaaatcttatgcctccgtttcaaaaaaaaaggccttgcagcgtgcagcaggcccaggattgtggggaacactcagccttggtcagaccatgcaccagcagggcccactaagtataattgtgaatatgggtagtattattaaaatacatccancccaanggggggggc

SEQ ID NO: 94836 - DNA, 176 bp, Triticum aestivum
  unsure (1)..(176): unsure at all n locations
  Clone ID: PAT_TA_94836
ccannacncctcggttntcttccnatctcaaggcaaaancnacgggcacactncgctnacaaccacagccacaaaccatcaacgtttcnncntgggtgaccgtctgacacagtggtctccnagcntcggtgcacgcncttaggtcacctcttgggggcgcgggggtaaaanntcac

SEQ ID NO: 94837 - DNA, 176 bp, Triticum aestivum
  unsure (1)..(176): unsure at all n locations
  Clone ID: PAT_TA_94837
gacagcctcaggtgttactgctaatgaatgctgatncantcgcggcctcangtaccgnagttgaactaatcgtanatacatacangaaacaanaggngctactacagtgcangtatactactaatcntagcagtgngancgctcaaccagccagctantgnacgtgttgtaatcac

SEQ ID NO: 94838 - DNA, 402 bp, Triticum aestivum
  unsure (1)..(402): unsure at all n locations
  Clone ID: PAT_TA_94838
cgaacccccctccgccgccgacctcgcgtcttctcctgtgcatctcggaggtgcttcttggtttccacgatgaagctgatcgctgcctacctcctcgcctatcttggtgggaactcttccccaagtgccgctnatgtcaagaacatcctggactcagttggtgctgaggctgatgaagaaaagctttgantcctttctttgctgaaattgaaaaggaaagncatcaacanaattgattnaatctggaaggaaaattttgccgcctttcctttaaggntgggggtgcaattccgttgggaacntccaaattcttcanntggggggtgggggnaaaactgcngcaatccaannaaaagggggaaaaaaggtttnaaaaaaggaaaaatctnttaaaaanaggtt

SEQ ID NO: 94839 - DNA, 397 bp, Triticum aestivum
  unsure (1)..(397): unsure at all n locations
  Clone ID: PAT_TA_94839
caatgtaacgcacccagaactgggagtgacagttcaattaccgattatttcggtgaaaaaaaatccacaaaaccagatgtacactcaactaggggttcttaccaaaggaacaattatcgaggttaatgtgagtgaactgggcatggtgacagctggcggcaaggtggtatggggtcgatgggctcagataaccaacaattgtgaaaacgatggttgcgtcaacgctgtgcttttgatttagcgcaaaaggtagagattgaagcatggcgttcatcgggtttgggaatgggatgggagtttttgggctatttcaaaaacatgtggcntttacttttgtttgacttaagctagagtntaanggggactcccagcggagagagaaaatatcattcatcat

SEQ ID NO: 94840 - DNA, 171 bp, Triticum aestivum
  Clone ID: PAT_TA_94840
acatttatcatgatataaggaaataaataataactttattattgcctctagggcatatttccttcagtactaacatgcacggccgctcgcgagccctcgatcaccttcgtcgtctcgaacccttctcggcgcatgtggccgcggccatcctcgaaggggggggcccggtac

SEQ ID NO: 94841 - DNA, 428 bp, Triticum aestivum
  unsure (1)..(428): unsure at all n locations
  Clone ID: PAT_TA_94841
gagatctccatggccaactcccggnagaacatccgaaagctggtaaaggatggtttcatcatcaggaagcctcagaagatccactccaggtctcgtgcaaggagggcacatgaggccaancagaagggccgtcactctggatatggtaagcgtaggggtaccangggtaggctaggctccccaccaagatcctgtggatgcggaggangcgcgtcctgaggcgccttctgcgcaagtaccgtnnaggccaagaagattcgacaagcacatgttcatgacatgtaccttaaggtcaagggtaacaattttcaaagaacaagaaggtcctcatggagaantatccannagttcaaaggctnaagaagnaagagaaaaanctcccctattaatttgaagngaagncgccaanagaagntncaaggaaagga

SEQ ID NO: 94842 - DNA, 486 bp, Triticum aestivum
  unsure (1)..(486): unsure at all n locations
  Clone ID: PAT_TA_94842
gtactcatatctgtgttcttccacctccatgaaatcaggaagttgatcatcaggcaggtaatctgatagattgtcataaccgtccaccgtccccggagcattagcgacgatgtcgctgctagacacattgagcggggggcacgattgatttgcttgttcgcctaactggggcaatttttccgcagctgctccgttctcttggacctttggatgtctgataatactccccgaccgctccgctccgggagatatgtctgttcaagtaatgcgctcatagtgggtctccngtgggaacttgctgggttccctcnanggcatccgagagtgtgctttgcttttcaccgggttctacttctcctcccggaggtngatgncncctttgtttttnaaccttccaagancctccactttnggccnacattttcgcgtttccnccanggccccttggtacggaattcnccnaaggttttaaaggagnccttnctn

SEQ ID NO: 94843 - DNA, 501 bp, Triticum aestivum
  unsure (1)..(501): unsure at all n locations
  Clone ID: PAT_TA_94843
gaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaaggccgccggcgccaccctcctcgtcgccgccaccgccacccacaaggcgagtccggcgggatggagatggcggcggaggatggcggctgcggctgcacccagtgcaagttgcggcaccaagctgcggctgctcctgctgcagctgctagatcatttgatcatcgatcatgcatgcaccgcgcgcatgcatcatatctatgatncgatncatccatccatctagtacatgttacgctacctgattcgaaggctttngtatgtatgttaagcaccttgccaacatnaanaaaagcaaggtgcatcccatgcatgtttaaccgaccctaaataaactcccgttngtttaacctaaaaaaaaaaaa

SEQ ID NO: 94844 - DNA, 502 bp, Triticum aestivum
  unsure (1)..(502): unsure at all n locations
  Clone ID: PAT_TA_94844
atgatcatgcctagatattctcataactatgcacttttctatcaattgctcgatagtaattgaaggaaatatgccctagaggcaataataaagttattatttatatttccttatattatgataaatgtttattattcatgctagaatttaaccgaaaacttaagtacatgtgtgaatacatagacaaacaaagtgtcactagtttgcctctacttggactagtccgtttgaacaaatgatggtatgttccctaaccatagacatgagttgtcatttggattaacgggtgtccgtgtcaaaaccggcagtttccgggtaagggggccccgaacggtgcgtcctaggattcgaaggggaacaaggagacgggggacacatgtttaacccagttccggcctctcctangaggntaaacctactcctggcttggattgatatggaatgatatgatggtacnagagtgggtatacacaagattctaaggntaacctanaanctaacn

SEQ ID NO: 94845 - DNA, 259 bp, Triticum aestivum
  Clone ID: PAT_TA_94845
gagaacccatcaagtgttatgcactatgtccttttgtgcaaggacgaggcaccaaaaactaacacctctcacaatctacctttagtgttgtcttctcttttgcaggaattccaagatgttttccctgatgagctacctcagggtctacctccactatgaggcatcgaacgccgaatcgacctcatccccggagcacttctacctaacaaggctccctaccacatcaaccccgagtaaactaaggagatccaaggggggg

SEQ ID NO: 94846 - DNA, 476 bp, Triticum aestivum
  unsure (1)..(476): unsure at all n locations
  Clone ID: PAT_TA_94846
ggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccaagaggaaaagaaagcaaaagcgattcccgttagtagcggcgagcgaaatgggagcagctaaaccgttgaaaacnggtttgtgggaagaagcaatacangcgttgtgctgctangcgaagcggtttgagtgccgcaccctagatggtaaanccaantacccgaaanacactagctttacgctcctgacccgagtaacaatggggacgttggatcccgtgttgatcaacaaagacaacttggcaaggctaatancctggggtgaccgatacgaagtatacgtttaggaaaggngaaaagaccccc

SEQ ID NO: 94847 - DNA, 490 bp, Triticum aestivum
  unsure (1)..(490): unsure at all n locations
  Clone ID: PAT_TA_94847
tttcactgcaccgattcaaaatttttggcttccacggaaatatctacatccccgccccctcccccttaccaaaagccacattccccctgttgccgccttcctttccaagttgaaaccttcactccttgcttgcagcgccacctcctcgccggcgaccctccttcgcactgctcggcctcgtttatccaggcaggaaatccaccccgacccccatcctcctccttccacatcccacatgcctcgacagccgacgcgacatcttccacccaaatcactgacccctcccccaaataagcgccgccctaagccatggtgcacgcagtatagccaaggcgctcaaggagcatttgggaagcggagaagcaattgcgacgcacgtcgatgagtcgcgatggctgccattcgtgccgaccccaaatctgggaggagaactcccgtcnaggcacgtcgacgctcgcgtgccgatgcacgaccggtgggtggtttaaac

SEQ ID NO: 94848 - DNA, 498 bp, Triticum aestivum
  unsure (1)..(498): unsure at all n locations
  Clone ID: PAT_TA_94848
caaggccaaccacccgttccgcgccttccataacgtacacagccagaacaccaacgactgtcaggagctcagggccatccgcgacaggcgcttcggccgacgccccgagcgcaatgatcgaggctacggtcgcggaggaggccgaagtggaggacgctgggacgaccacgacccctgtcaggagtggtgccggccagctggcgaaggaccgctggcaaggaccanctccgaagagggcgcctgggagggaccaactccgttgaggaccatccttaagggnaaagggaagtctccctccnntttcnaaacacntatcggggaaagaacgacaaccatcaccaaatagggggcttggnngggctttccaaagagccttngcgccatacctaatcttggggttggcgcccaagcccaaccctcatcgatcttctaacaattccctgtnaggtgaatgcgcctcacagcangagggngggggcccggtacccattntcctan

SEQ ID NO: 94849 - DNA, 488 bp, Triticum aestivum
  Clone ID: PAT_TA_94849
attgtaagggaaaattgagcgttgtacaaacttgtgatggcaaagtaataaaagtgacagactgcataataaaggttactatcataagggacaatataacgtgacgttcctttgcattaagagcttgggcatccaaaaataaaaagcgcatgacaacctctgtttcccgctgcgaagggcctatctttttatttttaagtatttacttttaggcaagagcaatagtatgcattctcatttcaacctcaattatcctctaggcaagcatcatgttgatggggaaagatctaggcacatattgcgagtcaaatatattgatcatgatttaatattggttggacaattatctccaatgataaacgactggggaggcgaaacattaacccctactttcctcctgtgttccgatgggatccattttgtcctaaagaatagctttggagtactaagaatcatgggaaacatatgatgattggatatgtgggacc

SEQ ID NO: 94850 - DNA, 500 bp, Triticum aestivum
  unsure (1)..(500): unsure at all n locations
  Clone ID: PAT_TA_94850
ctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtgggacattgggagccaaccctctgctgagggtggtggtgatgataggggttttaattgaccaagccgtgaagtggttgacattgttnnacaccttccgtcttcaaggagcaacctgcttttgacaagaagcatttatctctcaacatgaagcgctacatcaaagactctctgccaaacttgaagggatgccctaaatctttcaaaaanaagtttaanccgccnaaanacttcttaanaagtnaagncttcatccttntttngcaaaacatgcatatatgngngttgtgttnccnacaa

SEQ ID NO: 94851 - DNA, 485 bp, Triticum aestivum
  unsure (1)..(485): unsure at all n locations
  Clone ID: PAT_TA_94851
ggtcgccttgatgaccagcagttgccttctgtcttggggaagtttgatgtttcccccacatatcgattaaggtcaaagcgaatggctgtgctgaaaaccgttgagaagcatctagatttttcggctgatgcaatggatacttgtgacatggttggaactctgaaatcttcttgccggaacacggagagcatcaatgccagtcaagacatttcaagcgcacacgataggaggattaatgggcatatattggtttnggagactctaaccagtgacttttgcatacacaacaaanttagattcaacctaanttctgccagtatccaagaagcggttggcgtttcnacttggaaaagggatnnaaaactttatgcgtctaaactaactntccctagacnttgctcacagaatttaccaagagaanaattttggttatctaccgggtaanaaataacanttgccccgccatctctccttggnggggtgta

SEQ ID NO: 94852 - DNA, 482 bp, Triticum aestivum
  unsure (1)..(482): unsure at all n locations
  Clone ID: PAT_TA_94852
aaaaggtagggtttccagttgcaagccgccccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacatcggcttcatcaagtaccgttaagaatggaaacctcaaaggaagcaagggctaggaaattatcaaacgaactgtggtgcttcatcaatcctgatctttatcctataagctatgttattaactaccnntaaaggttttgaacctgggtgacaaaaccatgaaaccatgtttagtgactgctgtttgacaatgttgaaaccgatattctgttccngtcctgcaattatggtaaaaggttccctgaaccttanattttattaaaaaggggggcccgtaccaattnncctaaaa

SEQ ID NO: 94853 - DNA, 314 bp, Triticum aestivum
  unsure (1)..(314): unsure at all n locations
  Clone ID: PAT_TA_94853
gggcttcgtggtgactgcgtcctgggtgccacaggtggaggtgctgcgtcactcatccactggtgcgttcgtaacccactgcggatggaactcgacgctngaggcggtggtcgccggtgtgccaatggtgtgctggccgttggtagccgagcagtggatgaacaaggtgtacattgtcganagatatgaaggttgggttggaggttnagagggtataagcgcggngggttgtccangccgacgatgtttnacgccgcggttaagcagattcatgngacatgggacccggagaancnanccaaaggggggggggc

SEQ ID NO: 94854 - DNA, 302 bp, Triticum aestivum
  unsure (1)..(302): unsure at all n locations
  Clone ID: PAT_TA_94854
gatgnngagacggcgacggngacagnggtgctggccccgggccgagcgcncgcnagagcccgnattcaggccgccccccgccacccggcnaccgtctcgctganatgccaccgcgcgcggaccctaaccgcngtcgccgccgcnggcnantcgccgtcgtccgccgtgttccacggcgagtgnttcgtcgncggggacaacatcanacaccgaccatatcatcccggacnancanctgaccctgatgccgtccaaacccgangantancgcaagntcgnctccttcnccttcgagggcctcc

SEQ ID NO: 94855 - DNA, 466 bp, Triticum aestivum
  unsure (1)..(466): unsure at all n locations
  Clone ID: PAT_TA_94855
nggcgaccgangtggangtggacggnnacggcgtcnccatcatcancatctgaaacccgccantcaantccctctccatcnatgtactgctanccttaaangaaagctatnangaagntcttcanaggaaggatgtcaaacctattgttnttacangggaaaantatnaaantntctggtcaattcganattctgtcctttggtaatcttcacantggtcaaaattgagcaaccaaangatgtctacatatcantagacattctcactgaacttcttgaacgnccatnaacaacatcgntacntgcaattgatngtctttatcttngttaatnattatnnatttcaatggcattcatnaacttanttcaaatcccactgntcaantangtnttccatancntaacttgcgataattcaatgatttttaggaaccaactantccactntgttgcttacaaatcactg

SEQ ID NO: 94856 - DNA, 194 bp, Triticum aestivum
  unsure (1)..(194): unsure at all n locations
  Clone ID: PAT_TA_94856
tggggctccggantanggacgatctgtcccgccgtcgggagacggtggctgattctgttggccagatacccggccccccgaagctttttgatatccttctcccggacggtagaggccatccacttgcctcctgctccgaatcctgacattttcggaagaccttttgtgggcagaaaggataaacgcttgggcgt

SEQ ID NO: 94857 - DNA, 452 bp, Triticum aestivum
  unsure (1)..(452): unsure at all n locations
  Clone ID: PAT_TA_94857
aatccaagcacnacctgcannctggaatatgtcttgctgcggaggaaactgcggatgcngcaccgcctgcaagtgcngcaacggctgcggtggctgcaacatgtaccccgangttgangccgccggcnccaccctcctcgtctccnccactgccantcacaagggganctccggcngcatgnagatggcggccganaacggcggctgcngctgcanccagtgcaagtgcngcaccagctgcngctgctcctgctgcagctgctnnatattgatcatgcatgcgccgcgtgcatcatatctatgatctacgtaaccatctactaacatgtaatgccanctgatcganggtcttgtagtangtataagttagcaacttcctgcaataacaaagcnggtgcanntcatgatgttnacccttaatanatccccgttnntttgctaaaaaaaaaaaa

SEQ ID NO: 94858 - DNA, 508 bp, Triticum aestivum
  unsure (1)..(508): unsure at all n locations
  Clone ID: PAT_TA_94858
ttttttttgggataaggaggacatatggagctcgttatctctgtcttttatttatacctttataaaaccaacggcttattaaccggaaacacaagattggcgaccaggagacaggagtgcgaagaaacagacagggcctatcaaaacatgatggggtttgcacagcaaccaagaagagatgtccatgagcccgtccacggcagcctgccccggtgtcatgtcgtcgagcaaccagttctcgagcaccgagaaggtcatggccgtggcagcctcgccacggctggccaatatctctgaggacgagaacctgtcgccactgggtcatggaaactgcggcaccggcctctccatcggtccggaactcctgcatggccaccataccttgtagtccgccatctccggcgatgggaccttcgcatccaagactggaagagcttccagacggcatggtggcagtgcaagttgccntggcggtctcgggtaaccatggcggntncatgcggccggg

SEQ ID NO: 94859 - DNA, 509 bp, Triticum aestivum
  unsure (1)..(509): unsure at all n locations
  Clone ID: PAT_TA_94859
ctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgaacaagccccgaaatgtggcgctgcgcggatatgaaatccaccgtcgacggcacctgcggtgggccctgcaagaagtactgatcggctcatgccaancatgatatttccgcctaaaatgaataaaactcaagacnagatganaanctcaaccgtgccaancntttgtgtgtggcaaacaaaatttnacaantatgcctgtcttcgtcctgtgtttcncncccaaaaaaattgggttcctgttgtcaaataccggaanacctn

SEQ ID NO: 94860 - DNA, 506 bp, Triticum aestivum
  unsure (1)..(506): unsure at all n locations
  Clone ID: PAT_TA_94860
ctcgtgccgattcggcacgaggcatcgtgggcgttacaatacacacctactaataaaggtgctattgcttcttaccaccgtaatttcgtccgttttttgtccgtccaccttaccatattatatttttgattttttgtacctcgttcatttgctttgccatccttggaacgcctaaagattttttttttgcaaaaaaaccgcataaccccatattcnaaccgggattgctcggatataggcctagtgccgctagccaattcagcaaggttgcccttgcgtgttaatggtaagaaacttattaaatttgaatgtttattctctccaacacatgggccganctgggccagtccanggatgcagccnaaccaaacagattatttggtgtcgggctactcngccnttttttcaanttaaatccactgatttaaatgggccnaancagttgttnnataatcaacaaggaccccaaggggggcccggtnccaattcgcctanagngatcctng

SEQ ID NO: 94861 - DNA, 498 bp, Triticum aestivum
  unsure (1)..(498): unsure at all n locations
  Clone ID: PAT_TA_94861
cgaagccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaacaagggcaacggcaccggcggcgagtccatctacggcgagaattcgccgacgagaattcgtccacaagcacaccaagccgggattctctccaatgggcaacgcgggcccaacacaacgntccaattctcnactgcacgtccctgcaattggtccacgnaacacgtgtcctcggcaagtcgccanggatggact

SEQ ID NO: 94862 - DNA, 500 bp, Triticum aestivum
  unsure (1)..(500): unsure at all n locations
  Clone ID: PAT_TA_94862
cttccatcttcaaattgcttttgataaacttctagcttgtttgcttaagacagcactggcaaaaggtcaccgagggattttatagtcccgccccacagccagaggaccacaaccgggagctagatcccaggttcgaagaggacacggatatatttgtggtgcttgcggagggagtgttctacaagaccagctacgatggcacataagtggccatcaccgcagactatccaggccttcttcctgcttcttggggtaaataattaggaaatcaccttctcgaaaagatgctctcactccatctcacacatcgcaccgtatcgtgctcacaagggagacttcggcggttcaagtgatcggtcccgcgcccgacatccttccaagaggatagcaaatgaagaacnccgcncttcatcgaanaggtatgattcnccaacctgccctgacatcacntcaaccgtgccttcgaatttccattntcaggaggaagncaccgggctgtg

SEQ ID NO: 94863 - DNA, 477 bp, Triticum aestivum
  unsure (1)..(477): unsure at all n locations
  Clone ID: PAT_TA_94863
ggatgtgagcaagttgccgcctctgtggcccggtctacattaactcgcccgtccgagcggattaccgcgcttgcggttactcgcccgcccacacggcttgccgcgcctgcggttgactcgcccgtccgcaccggcttacaacgccgcggccggctcatctgtctgctctcacggccgactcggtcgtgagtgggttttagtgtcaccgaggcgatcatcaactctgcaacggataatttccggcctaacatatcaggtgaatctatctaagtttatttttgacacatattattttatcaaaggaacattactttggttgtgtatttttaaatacangacatcatcacttttatacaatgggcatggagcacgggctgacatatccgcccggggatatcgntacatatacccgatgaatgggcnccaaagcgcaacctnatggccggtctaataactanccggaatgncctgnatgan

SEQ ID NO: 94864 - DNA, 505 bp, Triticum aestivum
  unsure (1)..(505): unsure at all n locations
  Clone ID: PAT_TA_94864
agcaagcaagaagcacacaggaagctcctagccaacaccaatcaaagcctccatccaatcccaagcaacctcnaagatgtcttgctgcggaggaagctgcggntgcggcagcncctgcaagtgcggcaacggctgcggcggctgcaacatgtacccggangtcnangcccgccggcgccancctcctcgtctccgncantgccatcacaangngagctccngcnggatggatatggcggcgggagaacggcggctgcngctgcacccagtnnaagtgcggcaccaactgcngctgctcctggctgcaactgctaaattantgattatgcatgcgccggctgcatcatatccanatntaactaccatctactaacatgttacgcngcctnatttaangnccttgnagnaantccacctgcctcaatatcaaaccngtgccatgcatcatttaaccctaaataaacncccgtggtttgcttaaaaancaccaaaaaatanaaaactn

SEQ ID NO: 94865 - DNA, 497 bp, Triticum aestivum
  unsure (1)..(497): unsure at all n locations
  Clone ID: PAT_TA_94865
gttttgggtacaaaatgtcacaggttcaaatcctgtcatccctacctattacttctttcttctttataggcagtagcgacgagatcaattaaagtaaagtgggtataacttgaatttgtggagactatacgtacgtgagatacattaggaatagaaaaagattttctttttgaatgaatgaaagcgctcttagttcagttcggtanaacgcgggtctccaaaacccgatgtcgtaggttcaaatcctacagagcgtgattccatctatcttatgtcgaagcagagtaaaatacttaacaaaattgaattgtacncaatttcaattgactccctccctngncctggaggaggccaatcaaaaaaaatgccaatcaaagntcaactgttcccangcccggtttggaatnccatcncgaataancccccaaantaataggattaggctaagacatccaantngaaaattcatcattcnattgttccnnggganaaaaaaa

SEQ ID NO: 94866 - DNA, 504 bp, Triticum aestivum
  unsure (1)..(504): unsure at all n locations
  Clone ID: PAT_TA_94866
tttttttttttttttaaggtgaaacaagttccccactcaacatctgtagctcgggcatgatctgcaacaccggagacactacctcgaggaggccacaccctcgaagtccggcaacacttggggcgtcgaactggacccaacacagggcgagaatcccgaagcacgagggaagaagcagccatagagatccacatctttatcgccctcgaagtcaacgacaagctttggcaaaggaggcgacataggagggagttggcgcctcggccatcgcaggagatagcctgcccaagagcaacctctgcacgctccaagaaggtcccancccgcagcagccatatgtgcaatggatcaaccacatcactcaagatgctgaatcgcctcaccatttgnnaaggaaccangcctngcactcaaagcgttacaatccggntncgcnattaagacanatgaagcccnctcaagcttaggtngnaaaacaccagangangaaaaccgacccaaggg

SEQ ID NO: 94867 - DNA, 449 bp, Triticum aestivum
  unsure (1)..(449): unsure at all n locations
  Clone ID: PAT_TA_94867
ggcgaatcgacctcctcactaccgtccgagtcgtctctgtcatcgtcatggtcacctggagattgccagagggggaatccgagccccagccgcgcgaaggtgagcgtgtcctcctcaccacccatgtcgaccggggtttctctctgcctccgcatcctttttccggggttttctgaattttttcggtgcccaaatccaccacttccctccgaacaccatcacatatcttgccgatttcatctcgatgtgcgaaaactcttgggttgccaaccgcactggggtctgtttaagcatatcctcacttgtcgatntcattccgtgaanaaagcaattccgactgacgaaaagancatgcaattcaaatgtgtggggggttaaggattcagaccaangggtaaganactttccttcnatanncttccccatttaatncggganaggaancnacc

SEQ ID NO: 94868 - DNA, 236 bp, Triticum aestivum
  unsure (1)..(236): unsure at all n locations
  Clone ID: PAT_TA_94868
gatgggttatgctgacccttttttcgttttcggcccaattattttttccgtgactcgatgggccggcagcataagcccactacaattgttcgctctggacagaggtccctagatcgaacgcggctactgggacctcctatgcgccgctcgttgcgacgaatttccgagtgaacgcacaggcgcgactccagctggggccatcccattagcangaacacagtgaaaaatccaaaaat

SEQ ID NO: 94869 - DNA, 608 bp, Triticum aestivum
  unsure (1)..(608): unsure at all n locations
  Clone ID: PAT_TA_94869
gcaaatcctctccgggtttatcatccgtcacgcgcatgatcctgcgccgtctcgcttcgaacgttccngtaaccattctgatatctcncctataantacttgcaggctgcggctgcggcagcctcactcagtcaacagcgtacagctacagtttgcttcgttcnttggtttggtcatggccaggtcatggctggtcggcntgcggtctcggttcggcggcggcgncaggcatgacgggctcggnatcctggccttcgaggcngcggncgccatgtcgcgcctggtctcgctccacctctcgctgtcngacgcggnggtcacgatgctccgcgncgacntnctgcgcgccnagggcgtncncncctcacntccacggatcagtncngcctgctccgnctcncatgngccnagctcatngcngcctcganaggccgcatagacgccgcgcncctcggagcgcnctgcancagctgctggacgcgncttcctgcacacntcgncgcgtntacgctgntcaaggggngggcggnccgcacggcngacgcacgttgntctcatngngcggaaacngttagaanatggccgaagtgccgcacgtnacttcgcgc

SEQ ID NO: 94870 - DNA, 622 bp, Triticum aestivum
  unsure (1)..(622): unsure at all n locations
  Clone ID: PAT_TA_94870
cctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtccgttcaaaggagcagttgatgtggacattgggagccaaccctctgctgagggtggtgggtgatgatgaggtgtccaaatgaccaagccgttgaaggtgggttgacattgttgacaccttccnttcttcaangacaacctgctttttgacaaagaagcatttatctctcaacatgaaagcgctacatcaagaactctcctgccaacttnaaagggatgactaattttcaaagaagatttgatctgccacaaatacctcntaacaactcaaggactnaattcttgttggcnaaacatcatgatatggcggctggtgttcccacacaaggaggaactgctgatcaantttctgtctttcaatggctnaaaaaggcaantgtaacccacgntgcaaanctagnggcnnaatantttngccgccaaggntaancnccccaagnttgnnggaa

SEQ ID NO: 94871 - DNA, 709 bp, Triticum aestivum
  unsure (1)..(709): unsure at all n locations
  Clone ID: PAT_TA_94871
gctagtctcatcctcttcctcttcctcttcttcttcctgcctgcgacctgcgaggtggagtttcttcaacttgttctctccagaaacacaaactatcttctcgttttttctcgaaaagaaggaatatacccccgtcctctgcatctctttatgcacacatccatcttattaaaaatccaggtccagaacaaagtcttaagcagaagtatgaagcttaaaaataaataaattgggccacaactagcgaaaagaagaggaaggtgctaatcatttcacgatcacaatccatatgtgatctgatgggtgtgggataaatatatgcaagtgcttgggtttgggaggaagaggaggacaccaactatttgaacaaantttggtgaggaganctttatactgatcccatgtcggggtactgctaaggnctcgtaagagaactaatgggcggcatcanactgatacatttggggaaggtgatgcgaagaacagaatgnaggaatgggaagatgtcattgatgcagtaagagataaaccttcaatgataaccattagtatgcggaagaantgtggatcccaggttcacaaganttntgaaaaaacattcgcaagatagatgcgacagagnagaattaaatagtcgaatgntgaaaangcaatcattagctgcagtacccgnggnattaaaggttcanggactaanttcnggnaagcc

SEQ ID NO: 94872 - DNA, 289 bp, Triticum aestivum
  unsure (1)..(289): unsure at all n locations
  Clone ID: PAT_TA_94872
tttttttttagctccctaatatattgggaggatatgttatatagagaaatcaccatgtgagttccctcaatttagatagatcaaagatctatgcatttaatttaattgagttaaaaaaggtacaagatgacatgatgcaatgcacatgatgacatggcaagatgcaacacgcaagcgaatgacaaggcaacaacagcgaataactaagaagacacctgggcgcaacggtctccgaggcgttacaactactccaaatgcaagtagtaagagagaagaatangcgatactg

SEQ ID NO: 94873 - DNA, 644 bp, Triticum aestivum
  unsure (1)..(644): unsure at all n locations
  Clone ID: PAT_TA_94873
taggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccaagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggacaccttgcaaggctaaatactcctgggtgaccgatagcgaantataccgtnagggaaaggtgaaaagaaccccagtgggtantgaaatagaactnaaacgtgctaactccaaacantggangggaaatgnttcnaccgctgcctttaanaatacccgggancataggattgcttgttanggaanganccacggnccttncaaancatctaaagggattgcncgtttggccaaccggttttaccagccag

SEQ ID NO: 94874 - DNA, 709 bp, Triticum aestivum
  unsure (1)..(709): unsure at all n locations
  Clone ID: PAT_TA_94874
gttcagggtgccgaacttccgcgaaggtgttcggactttattgtcgtattatgggtaaaacaaagcccctggcttatttgaaggcatatcgtggtgtacggatgccacttgataaaagaagtttaataagaaataacagcagataagcgtcatatgaattcataagttgtatttgaatagtacgtcgatgcgtataagtacaggtaatgtgacaaagaggaaatatgaccgtggaacctgctgagaccagggggaagaagctgtgtgtggatccggagtatagccagatggtcatcgcggggaatgtctaaggattcccttgcgcgttcgagctgcctccgtatcgcccgtcctgggtcggcgcaaaggtgaacctgcgaaggaaatgtaagaaatgtttgtgtgccggagagcggttgaaccgctgagtgtggctgtcctggccttcgccggagtgtttaatnaactcangacnagccgggctatcttccacnaagtagttggatccntgaaggtgtccggaanctacgtcaacncaaggggggccggtaccaantcgcctanangatctataccncccacngcctcntttaactcngacnggaaacctgggtaccaattaaccctganaancccttccaatggntanacaaggcccccntcctccaaatnccacnaaggaaggaccccttngnaaaacggggttggt

SEQ ID NO: 94875 - DNA, 164 bp, Triticum aestivum
  unsure (1)..(164): unsure at all n locations
  Clone ID: PAT_TA_94875
cttctcctcnccttccggttcgggttctggttcggttcgggtccgagagtanctagcctagtcnagggtttccgtanttcggagannagagaaagggacagatccanggcggngacngngtacngctgcttcgtgggcggactcnnatgggncaccnacgacca

SEQ ID NO: 94876 - DNA, 665 bp, Triticum aestivum
  unsure (1)..(665): unsure at all n locations
  Clone ID: PAT_TA_94876
ccgtcaaaaccgaatcagaaatctcaagctcagcacagcaacaatggccgagcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagccttcttccgctgggctccgtggagtacatcgtctccggccggtcgtcgnatggctgggaagggcaagagcgtcgtcgccactgggacgcaagttcatttgggcgccaccaacccctgggctctgacccggcacatccgtggtgactttgccgtccgacatcggcaggactcatccatgggaaccaatcaatttagatgccaggaaggaatngcctggtgggtccctgaaggattcaaatggnggacaacaacacaacggtttatgaggctaagngttcaatgatggttgatgaagttcattaacatctacaaactatcttggttgttaagtttgagattgtanctgggaacttgttgtgtgactgattacnctnggcttacatcacgttacngtgncaatnganaggatggtgnttnaaaaaaaananccngggcggacatcccaaggtcatt

SEQ ID NO: 94877 - DNA, 653 bp, Triticum aestivum
  unsure (1)..(653): unsure at all n locations
  Clone ID: PAT_TA_94877
tggaattaagctttcttgtcaaaaaatcccatgccaggattgttccattgctggggcattcggtcaaggatgacgaggaattgctagtgtacaagtacatgtcaaagggagatttgacaactgcactgcacaggaagccagcggatgctgaagtggggttatcttcattggattggataacgagactgaagattgcaattgggtgtagctgaggccctgtgcttccttcacgatgaatgtagtccaccattgggttcacagagatatccaagcaagcagtgttcttcttggatgacanatttgaagtgtgccttgggaagtttgagtgaaattgccctnaaaccaagntgatggagcaggatttctccccnaggatgtttgagttaacaaaatctctccacaagacatgtcagnccactgctaaccgcacatatgatgttactgcttgggaaaggtgcncttgagctaaccaccggaattnggtgnnagtggtcaaatgacaccgaccaaaggatggtgcaacacttngatncattgaaccangcaagagntgtaaaatattgtgacctcnantgtgtgncnagacactnnanagtatggatcncatgcccaaaaagctaatcaanctcagggncccnncgaattnaagcctg

SEQ ID NO: 94878 - DNA, 593 bp, Triticum aestivum
  unsure (1)..(593): unsure at all n locations
  Clone ID: PAT_TA_94878
ctcccctcgttcccccatgttctctctctcccactcccaatccaatcgggaccggaatcgatcccgcccggcgctgcccatcgccgccgcccaaagccacctcgcggcgcccatccctgacgccgccccgccctgtcaccgcctcctcctcacctcacccccgagtcgcccccgacgcccgtccgcgcgccgccctcgatctggnactgggactccgtcccgatgccacagccgcttggagtccccctcgccggagccacgacaccgccgnancgcgacctcgtctcctcctcgcgccgcttcatcaagcctcatcgcccncgttcctctacgcgngnaanccggagaccgatgctgccgctgcgatcnactacgtctctgacnagccttcttccttttcaanagagcttccnnatgacggttccaggagccaanacacacactgatgantacttgaaccccgagggtgcctactantgacgacgctganactgaagtacttacgangtccaagnanggaggcctgcntttgntnaagtnctttgtgcancntcttatggcanactgtttactantcgtaccaantatgtgct

SEQ ID NO: 94879 - DNA, 220 bp, Triticum aestivum
  unsure (1)..(220): unsure at all n locations
  Clone ID: PAT_TA_94879
cccaccccgacctccaccttggcggcgcccgccgccggcgtcgccgttcccaaatcgacgcgaccgaggaggcctccaaaatggccggccgccgncgcagccggtctcgaatccacaccagcgacnacgannacggggcgacccgtcccanccgccgangccgcnggctgcccgnnccgganggtccctgtccctctgcnggaacggaggtgggtacctg

SEQ ID NO: 94880 - DNA, 390 bp, Triticum aestivum
  unsure (1)..(390): unsure at all n locations
  Clone ID: PAT_TA_94880
ctagcaagctatatacctacatagtacagccatggcccccaccgtgatggcctcgtcggtcacctccgtcgctcctttccangggntcaagtccaccgccggnctccccgtcanccgccgctccaacggggctagcctcggcancgtcagcaacngtggaaggatcaggtgcatgcangtgtggnccatcganggcatcaataagttcaagancctgtcttacctgcnattgctcagnanggaangcctcctctaagcatggtcnnactantggntncgctccaaagngggntnccttgcctcnagntnataancgntgggtcatcttctntggncanaaccatctccntgggnacaacnatgnccctnttggtcaanntggacntcctt

SEQ ID NO: 94881 - DNA, 613 bp, Triticum aestivum
  unsure (1)..(613): unsure at all n locations
  Clone ID: PAT_TA_94881
ttttttttttgtggacaaacgtgatggcttatttgattcttgttttaagtatataataatagatagatagatagatagattgctcctatcaatttgcacttgctttctccccttgttttcccatgcatatatatgaccgtcccggccggtggcttcaggacggagggttcccgtgcagttaagcatggcctgccctcccagtcccatgtccgtggacgaacctcgcgtcatcctccgcgtacacatgcgtctcattcaatagcgagtggaagacggcttgttgagagtggntgaagaaataagggctccccgtcgaggtacgacagctcgccgtcgatcctgtccgtgatcctctcgttgatctgctgggcggtgagcgtgaagggtgatctgatgccatgaccagcccaagtgtcagcgaaggatggacangggcatgtatgcttcaaatgctngaaactgctaangggttgtagatggacaagagaccctgtggtaagacccggtggcaaccggncctaaagactgtgtaactgnnaaaggcnccccaaggatcgcaggcccacnacantcaactcncccgctcttcnacnaccggacctngtnaaggaaa

SEQ ID NO: 94882 - DNA, 265 bp, Triticum aestivum
  unsure (1)..(265): unsure at all n locations
  Clone ID: PAT_TA_94882
ctcagctctcacgtctctatcgccgcctgccgctgcctcnccccttccccgccgacgccatggtcacctccgccgcctcgtcgccttcccccgaccaacctcccgcgaacaaggcggtccgngtggtggtcaanggtgggtccagggnntgggnttccacnactggactgttcgacanagcggnntccctctcgcctcgcnngctgngtctgcagnaatcgaagggacggcaccgaggacggcntctnctcgggggatcctgcaa

SEQ ID NO: 94883 - DNA, 331 bp, Triticum aestivum
  unsure (1)..(331): unsure at all n locations
  Clone ID: PAT_TA_94883
catattcgctgccatcacgccaatccgagttcacctgcaacatatatccgccaccagtccaatttccaccagattcatcgccgccaccagtccgagattccaccagattcatctccgccacccgtcctagttcgactccagtaattgttgcattgttttcgagttccagacacaccatactccgagtcgtgacagagtaggactcccgagattccgtgctacccgcagaagaaaaatatttccaaactcaaaaaaaactaagtctggnaaattttgggctaggcagtttttagaccatttgtagactttttcaanaancnaactcnccgat

SEQ ID NO: 94884 - DNA, 171 bp, Triticum aestivum
  unsure (1)..(171): unsure at all n locations
  Clone ID: PAT_TA_94884
ttggtcttctcggcgtgtgtccagctccggcgcccggcggcccggcgaganaggcgggggcttcaccgnccgcgggtanctggggctggcgcgcccgcccgcnctcccttcggtccgttccgccgcccggangancggagagggncggggcaagggcngntaggnccncgc

SEQ ID NO: 94885 - DNA, 681 bp, Triticum aestivum
  unsure (1)..(681): unsure at all n locations
  Clone ID: PAT_TA_94885
ccgttgcccgcttgccccccgaacagcgccgccggcggtcgagcatggcgacgagcgtgacgggatcgccggttccttctccacgggaggtactgtacgcggtcgcggccgcggccatcgcgtggtgcgccgtgcgggcgctggagtgggcgtggtggaggccccggcgcctggaccgggcgctgcggtcgcagggcctccgcggcacggcgtaccggccggtggccggcgacgtgcagctgagccagcggctcaacaaggaggcgaggtcccggaccatgccgcagggctgccacgactcatgccgccgggcgatgccgctcctccaccaaggccgccaaggacacggtaaaatgtccttcacctggcttgggaccggtgcctaaagtgacatcacaaacctgactggtgcgcnaattctgtcaaacagtccggcactcagagaactaaactcggcgatcaaangatctcaaaangtgtggtggcacaaggcaaaatgggcaaacaaagaggtataacccgcttcatcngaaactaacgatctgcggtttcccctgtacagnctgttccatggaagttacncaggatccctcaaggatttgcaatcaacctangaanttncccgcttngaaannccaagaaggttttcntaggaatncccantnaaaattnatctttttt

SEQ ID NO: 94886 - DNA, 589 bp, Triticum aestivum
  unsure (1)..(589): unsure at all n locations
  Clone ID: PAT_TA_94886
tggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagacctcgccaccagcatcaatccatcaacatgggcaaggctccggctgcccggcaattcgcgtcagtttcccttcccnatcacatttccaccaactgcgacactgtcaactattcaatatataaccttccntaactgcatgcatggacccttgtgtggacttaatgtcatgttgatggatgccaaacatactgatgactacnaaaaaataaaaaattcctcatgtgtatncaataatgtgncattctgtacttcanaaantgtgtttcanaatttaatccacatnnngccactcgtatgctgatgaattaattcntgttacccaatcaaccaaattntctgtatntctactactntcagattataatatattntttcaaaaaaa

SEQ ID NO: 94887 - DNA, 675 bp, Triticum aestivum
  unsure (1)..(675): unsure at all n locations
  Clone ID: PAT_TA_94887
aatgtctagtagataacattttgtataacttccactccttgcaactagagattctttaagcataatgctagaataatcataagcgcggataccatatggagttgtatgaaccaaacagttcacccaaaagcctaggtgttaggcaaaagttggccatatatttcaagaaaggagacctgtgtagcaaatggccaaatactaaaaatcatttattcaccttcaatcattttttcctagagatgcatcgaatttccttcaaagtatttcatgcgccattacaccgttaaaaagcacatcctanttttcaaggagatgtaccattccttgattatccaccccatacccaagtgggtggtttaattcctgaaancccaataagccatccaaacttgccttcccaaacaatccatttgggcatttgcaanatttgggcnctccttcgttgcatgggcactgcaatcaancaccaatcactacaangngaaaagatgtctgctctganatgctaaaacccctgatanttgtctgataaatcatatccgcgcacgggaantacaacatctatgacaancatatagcactcatacgcctganaccccgaaancagacncctnggtcgggataaccattgnatntactngcccanatctncaggatnccctccganntttaagn

SEQ ID NO: 94888 - DNA, 666 bp, Triticum aestivum
  unsure (1)..(666): unsure at all n locations
  Clone ID: PAT_TA_94888
gtgccttcgactccatctcgtggcccttcctctttgaggtgctgcgcaagtatggatttggggaccgattccgggagtggatggccattctgctctcctcggcaagcacgcgggtcatgatcaatggagttcccggtccgccaatctggcaccggcgcggcctacgacaaggtgactccacctcaccacaactcttcgtgctggcggtggacacccttgggagactgatgcgacacgccctacagaccggcatccttcagcagctgcatccccgacgagccatcccggcgatctctctttacgccgatgatgtgatgatgttctgccatgccactactgaggagatngccgctgtcaaaggatcctgggacgtgttccggtacggctctgggctcccgcgtgaatacccaagactcggcacgattcttcaagcccggcgatacnaatggggtgctggacaatctgcctgtcntggcttccgttactactgggacccgntctcaatcgcgccanccgcaancactgaacctcntcanncgtggcggccgngcctcngaaacttgtgataaaaacggangtacgnctaaacgngtatcaacgtcacatgtacgtgcccaanaactaaattaaattacngtnttgcgcncgtccagtgatncataagtt

SEQ ID NO: 94889 - DNA, 301 bp, Triticum aestivum
  Clone ID: PAT_TA_94889
tttttttttcaacaactgaaatacaatgcattgcaaatcagaaacttttagatccggcttgagatgttaaacacaagcatcaaggttaccagagcatattacgcacagatgttgacaatgagcatccaggttatcgatacatcaaaccaaatcacatgtatttccaagctttctgaccaagaaagaatctctaagttagcacgatgagataaattaggccacctccatttctgcacattcagaagaaccaagtgctcagcttgatcaatagcgccatcgttgtcgcatcagccgggggggg

SEQ ID NO: 94890 - DNA, 416 bp, Triticum aestivum
  unsure (1)..(416): unsure at all n locations
  Clone ID: PAT_TA_94890
acacagcctccattgaagtgcaagaaccaaatccttagcttacacgtccatcaaacacctcagttggctaccatccgttggagagatgaacacgttgtgcgccaagcccatggggttctctggtggcgtgaagtgccagcggcgggcgcgggtgagggtgtcggccgtggcggcggcgccggagagggtgacgatgtacgacgtgctggcggtggggaacgcggnggggccggaggagatnaaaggcggcgtacaggcgcgccgcgcggcggtggcacccggacgcntgcccgggcggcgccgaccgttcatganggcncgcgangcctacaagtgtctccgaccccgagcgcaagcggggtacgaatccaactgcctgtgggccggccccggcncgccggtcccgctcaaccccg

SEQ ID NO: 94891 - DNA, 417 bp, Triticum aestivum
  unsure (1)..(417): unsure at all n locations
  Clone ID: PAT_TA_94891
actgttagtttccaataaagaaacaggtcttgagaagctgacacttgagagatgcccacctctcgagttgaagcaccntctgaggctaaccaatctgatgacattgattgtaaaacactcagatggtctggttggatcacaaggaggaggtcanggtgatgtggaatggaagctccctgttgagtatataaagatcaacgacttacatggtaatactggcgaggaactgacanaatcctccccnacctcccaaactctcnaaattgggaaatatttgagtgtgaaaacataaaaaanctggtattgggggttggatgtgcaaccaacaacacaagaaaatcatatttggggggnaggtganataacancaccaanatcagcaccagaggaagaggatgacgggtgctgctcttccaa

SEQ ID NO: 94892 - DNA, 199 bp, Triticum aestivum
  Clone ID: PAT_TA_94892
agatcacacctctactcctcctcctcctcaggatcgcagcctccatgcaatggcttcccttaccaccaccgccgccgctccacatctctcccatgccttgagacgacggcgcaacgccgccgtgcctaggcgaaggccctccttccgctgccaaaaccgccttcccaccgagccgccgtcggaaacggaaggaggaagg

SEQ ID NO: 94893 - DNA, 506 bp, Triticum aestivum
  unsure (1)..(506): unsure at all n locations
  Clone ID: PAT_TA_94893
ctctggcccgccgcggccaagccaagatcctaaccgactgcctcgtaccgataaccgcgtcacgccacgcggcgctctcagtccagggaactcaccaacggccgcagccccgtcgcatggagcggaggcacccgcagatcgcgccgtcgccgccggtgtcgcggcggaaggccgcggcggcggcgagccaggagtggctggtggtgccggcggcgggggagcggcgcgcgggggagttcgggaggcaccggatcatggagatgacggggctcccggcccgcgactccgcatgctcgaccgtcctcgcctacctcaacatctcggccgcgacgcacatcgtcatcaactcgacacttaaagcattgtcaccgccgccgaaggtcgtccgcgacccaanaaccgcgcttcgcccttctcaagaatcaagcccgcttgcctcccggancggtacacnatccggaacgggaacggaactgcattcggattcggagtcaaancgccttcat

SEQ ID NO: 94894 - DNA, 234 bp, Triticum aestivum
  unsure (1)..(234): unsure at all n locations
  Clone ID: PAT_TA_94894
cccaccttcttcaatcaaatccatccctacaccaacacctacaccaacaccagcaccagcttcaacccaatccactacctccctcctccttgagagagagacaccaaccgcaactcggctcagcacgccgatgaagagcaggaggcagaacggccgcggaggagccgccgccggcgccatggcgctggacgggagccaccacaccacaagcagcggctgcgcgncganagagag

SEQ ID NO: 94895 - DNA, 561 bp, Triticum aestivum
  unsure (1)..(561): unsure at all n locations
  Clone ID: PAT_TA_94895
gtggtggtggtcaccccgctggccacctgcaacgcgtccctagccagcgtcactgggacgctgactgcaccagttcagctcctgggtattgacactggcagtggcaatggcagtggcagcggtagcggcggcctcggggggcttggcggcctaattgggcctcatcggccagttcgtgggcggctccttggcggcatccttaatattatcccattgcccttctccgtccgtctagatgcttctaactaccggcgtgtccgattaaaaaaacacgacggacctaaaataaataaatacgtgccaatcctatcaacgtaccaaacggcaactgtccccgctttataanttaaacnacccctgtggttggtataaccgcttccnaagaacacattattaacatacaacctnataatataccccgatgtgtacaagtgatcnaaattgntttggaaaaatnaacactccgngatccanagttaaaaaaaaaggggggcccgnaccaatcccctaaangatctattaacncccacgggcgtccttnaaaatccgactggggaaacc

SEQ ID NO: 94896 - DNA, 487 bp, Triticum aestivum
  unsure (1)..(487): unsure at all n locations
  Clone ID: PAT_TA_94896
aagagattcatgtcttgcaactcaagaaaacacaaacaaattgttgtgttcaatgatgaactttcttgagaacaaaacactttatccaccaaaagttcatacaaacgctgactctatcagaccatgtattctacacatgacaaagaatatgaaaataccagatatgttataattgcagttgtcagttcatgttgtcttataagtaaancattacccatcataatatggggtctatgtttgcattactgctccataaccctgttgtggcggcgccccggtgccgggtgccggtgaaagatagaccacgacgatgttgactcctcntggaatggtatcttgccgtcttcaagcatgtacatcgctctcttctcctgggtctcttcaaaggatacgtccaacattccgattccttgccttggcccgtanattctgcagctgcacatgttncatggaccggtgtaacatggngattcacaacaacatcagg

SEQ ID NO: 94897 - DNA, 669 bp, Triticum aestivum
  unsure (1)..(669): unsure at all n locations
  Clone ID: PAT_TA_94897
ggagcaatggcgggcgagaagggcctggtgctgctggacttctgggtgagcccgttcgggcagcgcgtccgcatcgcgctggcggagaagggcctgccctacgagtacgcggaggaggacctgatggccggcaagagcgaccgcctcctccgcgccaacccggtgcacaagaagatcccggtgctcctccacgacggccgccccgtcaacgatccctcatcatcctccaatactggaggacccttcccggacccccggaactgctccctccgaccctaagcgcgcgcgcaaggccgcttctgggccaanacttcnacaanaaggtctaagactgcggtccgcctctggaactcaanggcaaccnnagggcaagncccccccaaatcctggaatcttaaaacctcaacggccctcngggaaaacctcctncggggnaaaattcggttcttnaacccgctttggccttaacgcttgttcnaagnacaaaagnaggnaatnaaccgccgaaggggcccaaattcggtnggcaaccctcgnaacgaaaactccaaanctcatcccgnagggtcactcacgctgtaaaaatncgatcataccccgcgnggggntnatccaacccgcgnaataagactttgtgcaatctcttngaaatttccgncaagtccgttt

SEQ ID NO: 94898 - DNA, 627 bp, Triticum aestivum
  unsure (1)..(627): unsure at all n locations
  Clone ID: PAT_TA_94898
cccgccgctgcgagcgtccaccatcacgagcgcccccgaaccctccatgcgccgtagccctgcctccgccttccgccgtgtcgccgtcaccggcatcgcgcccgcctcctctgtgaccccgtgtagcacccagnctccccgtccaccttcgctcctccctgcccccgcccccctgcgccattgtgccgattgttgagccccgcctctgcgggtcggtgttggtgtcggggatccgttctgcacgctgcttgttcgccttgggtcggtgtcggggaaggattttccttaactcctctgcaccgccactaaccactaccacncacctgaccatctctctctctgtccatggtgaggtaatgggtccacggtggcgaccgagtggcctaagcaagcagcgcggaactgacgaggacttctgcggnatncgctggacgggactctaatgcctccancgtcnaggaatatcaagggctcaagggttgtacaactgtttaacaagatacantgcataaggatgacaactgatataaggaggantaattggactttaaggaacagagntacatgtcatgacgttaanaatggtttaagggctacaattnaatgnctacaaatgggaggatccta

SEQ ID NO: 94899 - DNA, 376 bp, Triticum aestivum
  unsure (1)..(376): unsure at all n locations
  Clone ID: PAT_TA_94899
ctgtcctactgtcgcatacacacacaagtgctagctagctaatcgatcagccggcggccatggcggaggagaagcaccaccaccacctgttccaccacaaggagggcgaggacttccagcccgccgctgacggcggcgtcgacacgtacgggtactcgaccgagacggtggtgaccgccaccggcaacgagggggagtacgagcggttaccaaggaggagaagcaccacaagcacaagganactccgcgaattggcgccgccgccgccggaccttcgccctctaacnanaacacaaggcgaaagaaggcccggganaancccacaagnaatttaggagggtttnnccccccnttaaacttttnggcccgggggttc

SEQ ID NO: 94900 - DNA, 413 bp, Triticum aestivum
  unsure (1)..(413): unsure at all n locations
  Clone ID: PAT_TA_94900
ttttttttgcctaataatacaaaatacaaaagaagaaaagggtacacagagagagaggcgggcccagcccaacacaggaagaagtaacagccgtgagaatgcacaaacaataggctgcgtacaaacatggatgacactctcaaaaggaaaagaaaattgatgacgtcagcaacttagactcgcgaaatctcaagtcgacttatactaaacaagaccttgccaatttaaccccggaaaaatccggtgtctttttttgcccaacanttatccctggggaaaaantttnttcnaantccaaantgaacgnattaaaccctannaactgaattgnagccatgcaaattggnggttttcccaaaaaatncattttcttcaagaattgccanttttgggnccaaccgttaaccccccct

SEQ ID NO: 94901 - DNA, 706 bp, Triticum aestivum
  unsure (1)..(706): unsure at all n locations
  Clone ID: PAT_TA_94901
ctcaagatagcataagtattacggtgggtgaacaaattactgtcgagcaattgatagaaaagcgaataattatgagattatctaggcatgatcatgtatataggcatcatgtccgtgacaagtagaccgactcctgcctgcaccttctactattactccacacatcgaccgctatccagcatgcatctagagtattaattcataaagaacagagtaacgcattaagaaagatgacatgatgttagagagataaacccatgcaatatgatataaaaccactttttatcctccgatggcaacaatacaatactgccttgctgccctactgtcactggggaaagncactacaagattgaacccaaagctaacacttctcccattgcaagaaaatnaatcctattaggcaaaccaaactgatattngaagaactngcaaagatacttatccacacataaatattcagaggaatcaaatttctcataggaaactgtnataaccacaatcatgggttcgacaacacaccgcaaaaagattactcaatagnttcaagaagatgggagactttatggatcaagnagaganaatcnccngatataatatgnccnaggccgtggaacancaanccncaggctggaaaattaagcctttngtgtnccctgggcccaaggccantggttcnggaaaagtnngggaaattttngggcnt

SEQ ID NO: 94902 - DNA, 522 bp, Triticum aestivum
  unsure (1)..(522): unsure at all n locations
  Clone ID: PAT_TA_94902
gtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatncccgacttcatgtgccaaggcggcgacttcacaaggggcaacggcaccgggaggcgatccatctacggcgagaattcccgacaaaanttcgtccacaanacacaaccggatctctcatggcaacccgggccaacacaacgtccattctcatctgaccttccctgcaattggtcaacgnaacacttgtcttcgcaagnctcaaggatgactctcaaaaatcaaaagnggctccnnacggactgtcaanaagtctatcccaatg

SEQ ID NO: 94903 - DNA, 650 bp, Triticum aestivum
  unsure (1)..(650): unsure at all n locations
  Clone ID: PAT_TA_94903
cgataccagcgtcaccgttcttcaggaacttgggcagcgcctccagctccttaccagatcgcctgtcgatcttggtcaccagctcagcaaacttgacagcaatgtgggaggtgtggcagtccagcactggggcgtagccattgccgatctgaccagggtggttcatgatgatgacctgggaggtgaagttggccgcctccttgggcagggtcatccttgggagttggatgcaacaaacccacgcttcagatccttcacagcaacgttcttgacgttgaagccaacgttgtcaccaaggaagcgcctccaaggagagaccatggtgcatctcaacagacttaactcattgtcaaacaagtgggaccaaaggtaacaaccataccaagcttgatgacacaatctcaacacggcaacangacattccaatgccacatcctgttaacatctgaangggaaaccagggctgtctaaggctcttgggccatgtctggcaagacccaaaggggggccggtaccaatcgcctanntgatctatanccgccaanggcgtcgttaaantctgacnggaaanctgggtaccacttatcnctgagaaacccctttcactgntaaaacaaagcccacnttcctccaaattccactnangaang

SEQ ID NO: 94904 - DNA, 599 bp, Triticum aestivum
  unsure (1)..(599): unsure at all n locations
  Clone ID: PAT_TA_94904
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcaacgccttccaccgcgtggttccccgacttcatgtnccaaggcggcgactnaacccggggcaacggcaccggcggcgatccatctacggngaaaattcnccgacgagaattcctccaacaagcacacaagccgggatctctcaatggcaacgcngggccaacacaacgtccaattctcaatctgacgtncctgcattgnccaacggaacacttgcttcgggaagtctcaaggatgctctaaaaaancnaaagnggtcccaagggacngtcaacagggcacnacaannggaaattaattgccgncngtccnttcctttntncccccttttccngcggnccantaaaaaaaacc

SEQ ID NO: 94905 - DNA, 655 bp, Triticum aestivum
  unsure (1)..(655): unsure at all n locations
  Clone ID: PAT_TA_94905
aaaaaggctttcgccccgctttatatataaagcaaccaccaagcaaacatccagcgtacaatcgaaagaacaaaaaacaaagaacaaaacgacaaagatacaagacactacggaacaactaacaagattcgaatgcaccaagcaagcttgagcatcgaagccttcagcgagctccagctcctgccatgatgagatgaggccaagggagcaacacaaacgctggaagaagaacacactccgtcaactcccatgaggtcaacactgctgatctgcccttcaacgccaaagaaggcccctgccttctcgtcccggatcggaggacgctacccgtcngctggcaaaagccgctcaccctgagcactcaatgagcaagtcaagccggttgccaaggagaagacacaagcatggngacaccctcgcanagctgcaaccagacacacacatcgctggaaggaacatgacccactgcaagccgcgagcnggaaatcactgaataacntgacaacagcacaactccaacccagcatactcacatccaagggggcttaagaaanaacaaccgtggcgtacgccatcaaaattgggtnaccggtanttgggttcaggaggttctccctaaaaagggaacccgngtcctaactggacccccggnagg

SEQ ID NO: 94906 - DNA, 299 bp, Triticum aestivum
  unsure (1)..(299): unsure at all n locations
  Clone ID: PAT_TA_94906
cgccggnagcancggcctgctcctctacggcgcggcgtcggtgaaaganagcggnctcctggagctcaccancggtacgctccgcnagaaaggacacgccatctacccgaccccgctgcgcctccgtggncgctcnntctcgtcctccttcgtgttcggcatcctgtccgcctacccngncgtgagcgncnacggngtcacgctcttcgntngcaccgancgcanacttgtcnggcgcnatggcggcgcactacctcngntctcctcaacanccangaacaacggnancnccacgaacg

SEQ ID NO: 94907 - DNA, 439 bp, Triticum aestivum
  unsure (1)..(439): unsure at all n locations
  Clone ID: PAT_TA_94907
ttgcaacctacagatnangaanctgcttcattgttcccaccatcnatatcagatgtttaataagaataagaatcnaataagctgctgnttgactgaggaagcatttgnaaagaaaggaanggtgatgcttgttaaacaaagctgcgtgtggggccgccacntacagctgtaatttctgctgtatcatcngttatttccgttattgctgtaatatcatcngtnattgctcatgttacgaatgacccaatctatctatggcaancacccctacttttagtaaatggagatgcncacctagannagacggatgaaaganaactgcccttctgacttcttcncttgtcagtccnttaaccaaagcatcnatggccccaaanacccccnataantccgnttttgaatnnaacacanggnaagttatccangaaggttgccccaa

SEQ ID NO: 94908 - DNA, 422 bp, Triticum aestivum
  unsure (1)..(422): unsure at all n locations
  Clone ID: PAT_TA_94908
cggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttccgtgctccgcaacatctgcccttctgtgccatcctatgagaggcgcttcaccacaagctgctacatgactcaagaacttgggatcaagtgtccccatgatgtcatcttctccattggtttgcctaagaggggaaagaaatgatgacgaacaagagaancctgttcccanccctggcctttcaaggttngggcaattttaccttttaaagtttggaaggaaattnccgttaaagggggttttcccaaattccttttttggggg

SEQ ID NO: 94909 - DNA, 554 bp, Triticum aestivum
  unsure (1)..(554): unsure at all n locations
  Clone ID: PAT_TA_94909
gttttttttttttttttttgctaagagtttgtatcatgtgcctttctgttctcatagtgaaatgacactggtgccaatatggtataagaattatgatgctttaaatgctgatagggccatttacgtcctctgattcgttgcccgagcanatctacagcatcctctacttcttaactgatggtgacatttctttgctattcctacaatatacataaatgatattctactattagttttccatttcctgaaacgacacctttcanttcactattttgctgtgctagattgcattccttgtcggtatgaatttcttgttgctgttgncaanatatgacnggtagcattttgttatatttttttctttaatagaaggcaactgggggactggccatttgcaaaacacatgcaaccacaagcaactgaggaggtgcctcaaagatacacaattgatcnaangctggcctgaagtttgganactacggnaattggtggagtgaaattggnanaacctgntgtgaactggaatatggcactttacnccaattgttttgttt

SEQ ID NO: 94910 - DNA, 434 bp, Triticum aestivum
  unsure (1)..(434): unsure at all n locations
  Clone ID: PAT_TA_94910
cgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaanggcatgccgcacaagttctaccacggccgcaccggccgcgtctgcaacgtcaccaagcgcgccatcngcgtcnanatnaacaagcatgtcggcaacaggatnatcaagaanagattcatgtccgtntngancacttcagccatcnagtncaacnaggagttctccaaaggaaaccaanaacgacaactnaangcggagcaaagngctcgntaagtcattat

SEQ ID NO: 94911 - DNA, 647 bp, Triticum aestivum
  unsure (1)..(647): unsure at all n locations
  Clone ID: PAT_TA_94911
ccggcggtcggcggcgttcgctggagatgtgtccgcctcccctcggctgcgtgggtggcgaggcggcggtggacctgggcgtcgggcggcaggacccccgcgacctgctgcgccagatctgaagacggcacccggtcgcttgcatcagcgtcctcctcgtctgggtccggcgggatccggccggatccggctgttggctgcgttggattgngtgtggggaaggtctgaatccggggtaaccccttgggccggcggcggcggcactcntttggtggcgcttccggngctntccccttccttgaagggacgtttangttaacttccctcctcctccttcccctgcacctggggttaaaacccaaatcccggttttgggcggcggcggtcaatacnngccgttactttctttaaaggnccgatttggtctgttgggaagcaagccgttgttgtttgcttcnggtgcncttgggtggngngatattctccaacggtaacattnacatgataacgtccctctctggcgcgtccccctctgtggccgtaatcggngnttaacccttgcctggnaaagggaaangcccccacgcataagactangaaggaangggcagggncccnttcncgggtttggtnaaaagngtttcttc

SEQ ID NO: 94912 - DNA, 426 bp, Triticum aestivum
  unsure (1)..(426): unsure at all n locations
  Clone ID: PAT_TA_94912
ctcctcctcctcctcctcctccaggagaggcgactcatcagctagggttctcggccggcctcgcggggggttggggcgcgatgtcgacgccggcggacggcgcggcgtactggctgcggtggcaggtgttcgtctgcggcgcgctcatcgccgtgcccacggcgctggcggcggcgctgctgccgcggctgcggaggtcggtggcgccgctccgcgccacggacctctggctcccctgctggccgcgcctccacccgggctgcctcctcggctaccgcgccttcgcgctcgccgccgccgccgcgctcctcgtccgcgacatcncccccaacggcccaaggtcttcttcttcctaaaccaatggacctttttataatcacatatattttgcggttgaaactgccatatanctcatggatgttggtc

SEQ ID NO: 94913 - DNA, 515 bp, Triticum aestivum
  unsure (1)..(515): unsure at all n locations
  Clone ID: PAT_TA_94913
gaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagcttctaactggagagtggcaacacgaaggatgacctgaacttcccactggatgatttctgcttgggcagatnaaagactgggtttgctgatggcaaggactgatcctgtccgtgatgtccgccatgggtgaaaaacagttttgcgctgttnaangaatccngtggtgggaaattaacaacttgcgttngttgcctacctgccatacttggtatcaaatgcttccgggtgtttgnnaatacacatncataggnncaaaataccgttggggtgaaaatttgtncaaantgngtgtttttacacngaatgccaaggggggccggtaccaaatcncccta

SEQ ID NO: 94914 - DNA, 615 bp, Triticum aestivum
  unsure (1)..(615): unsure at all n locations
  Clone ID: PAT_TA_94914
ctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttgggacaagatcaggttcgaagagcctcacggacaagagcaagtcgatgcgcagccgagtcttcatccacatcatcccccgacaaggcgaccagcacgtcacgatngtccacagcggattggcatgaccaatccgggctccgtcaaaactcnggacatcgccaggtccggggacaaggnttcatggagganccctgccggggctgacgttccatgattggaattcgtgttggttcaatccggctactcntccccaaaggtcntctcacaacaaancanacgacacaacatacntttggatctcaagccggnggtcttaacgtaccntganantctggggaaaaancgnagggtcaaatggggtcncnaaggngacaantgganccttaggggcccataaggtnattaaacanccgattnaanaccaaccctgggccaaaacactaaag

SEQ ID NO: 94915 - DNA, 684 bp, Triticum aestivum
  unsure (1)..(684): unsure at all n locations
  Clone ID: PAT_TA_94915
ttttttttttttctacttataattttttttatgaaaaatggagcacacccaacgatttcaacggggtgaaaaatggacgtgaaatttcccagttcggaagtttcacaccaaaagataaaaaattaaaacacaagggcaagtaaaacatccagcaagcggttcaagaacttaaacaccacgctgcctgaaaccacttcactggaaggccctttccgggtgagccccatcgattttgggaatgatgggggaagcatgcggcatatcttcagctttcaagaccaagcgcctctcaaggtctgggacgacctccttgtgngaccaaagcgtttccttctggcgtcaagatgcattccatcacttaagtaaanttctgccaacttcaatggcttgcatctttggaccaaagatcaacacactgtacancatttccttgggtaattccaancattgaccgcatagacacaancatttcatttgtcctttccggggancnctcgcacttctcanacngggatngtgaaaacttcnctcaanctcatcaataggagtggatgataacaaatncatggcttgganaacctcagagnttaaaanntttnaatcgttaaccccacggaaatctccctantttcgctgaagccgatnttcgcaaanntanctcaacgtgancacaggaaattccgg

SEQ ID NO: 94916 - DNA, 576 bp, Triticum aestivum
  unsure (1)..(576): unsure at all n locations
  Clone ID: PAT_TA_94916
gtctcgagtttcctttttccccttttctaattcgtcaagcggcaaaggagaggcagcgaagatgcctgattcatcctcacgccgccgggcagtagagcaccaagcgaggttgtttgaagtttcgtcctggctgcaattgaagcgccaccggagctacatggcactattcccgcgttgcatcgcagcatccgccgtcatcgccgcgcactgcatccgccgtccgtcggtgtgctgtatcggagtgcacccaaagctgcaagggagcacaatttggggcattgaantcccgccacgttgcaatggactccacgcgttgcgatanacaccgccgtggcgcaatggacttcaacgcaactacaatggaccatccggggantctgcctcngttcaatggacttcacacaactacaatggacccngccgggctgtaaggaggcctcctggtgcaatgaactccccggganagtctcntcgtgtcctgcttttgggctgggcggcatacatgctnaangacanaccnttcncctgacgcccccacatcaatgacctacgggatcacgtcgggggcnctnaatt

SEQ ID NO: 94917 - DNA, 678 bp, Triticum aestivum
  unsure (1)..(678): unsure at all n locations
  Clone ID: PAT_TA_94917
cttcatcgaccgcactcttgtccgtgctcgtgatccaccgactccatcttacccacatattgagtatcagcctgccccagccatgttgtcgtccgtgcctcaggctctcagtggcaagccaacgccgcctcccactgctgtggacatcttcaagctcacccgctcagagcttggctgcctgcgctcgcagctccccacaggtgaaggtgcgccaaggttcagcacgtatgcagtcttagctgcacatgtttggcgctgcgtctccattgcgcgcaaccttgctcctgaacaacccaccaagctgtattgtgccaccgatgggcgacaacggctgcagcccccgctgccagaaggttactttgggaatgtcatcttcactgcaacccgctcgccgaggcagcaaggtgacnancggctggcagaaggacaacggtcatcaanggagcgctagacangatgacaacgatactgcaatcagcctggactactgagatcaccggactgtaacatggtcgtggancgaaanttcggtgccaactcggctacaactggtggctgcgatcanacccgnttggtggggcgcgtgtanggtctgcggatcctaaagannggtctcnccaccacaagaggaccncaccatnatnggancaatgaatagacgtctnttaaacaatttaa

SEQ ID NO: 94918 - DNA, 284 bp, Triticum aestivum
  unsure (1)..(284): unsure at all n locations
  Clone ID: PAT_TA_94918
cgccgccgccgctcctccgactccaccctcaccgcatcctccctcgcctccgccgcttcacctctggccgcctccttctccgcctccaccccaaatcnctctacgccactgcctcnacctcacaaggccgccccaanccccgcctccnttaaactncctcccaanggcccctccgttcggcngncggcggccaaacnaataggcaacctncccnaanggccctttnctttttggtgaaaattcaactncgnggccttcngntttccggcgnccgnttgngnttc

SEQ ID NO: 94919 - DNA, 232 bp, Triticum aestivum
  Clone ID: PAT_TA_94919
gtttcatcacatattggtacatagagcatgtttcatcatcacaactcaattgccgttagaatcatacggctacaacatacgttatgttcagaaacaaactctgttccttttgggcctatccagaaatcataaggcttttccttagacccatgccggctaagtgttccttgaacacattggatggtaagcctttcgttagcggatccgcaagcatatcctttgtccttatatg

SEQ ID NO: 94920 - DNA, 686 bp, Triticum aestivum
  unsure (1)..(686): unsure at all n locations
  Clone ID: PAT_TA_94920
agcagtgggaggggaaagtgatctctgaccgcgtgcctgttgaagaatgagccggcgactcataggcagtggcttggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaagggtaaagcactgtttcggtgcgggctgcgcgagcggtaccaaatcgangcaaactctgaatactagatatgacccaaaaataacaagggtcaaggtccgccagtgagacatgggggataagctcatcgtcnagaaggaaacagccggataacaactaaggccctaaatgaccgctcantgataaaggagtggggtcaaagcagcaagaggttccanaacagcacccttaagangcgtataccacgatgacgcctncctaaataacggctacatngcaactgtgattaaatcacgtaggactccctaaggacaccaacggtcacacgacaaantgtatacaaatganacatcc

SEQ ID NO: 94921 - DNA, 653 bp, Triticum aestivum
  unsure (1)..(653): unsure at all n locations
  Clone ID: PAT_TA_94921
ggagaagcaatcgctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtagtacaggaatattgacctgttgtccatcgactacgcctttcggcctgatcttaggccctgactcaccctccgtggacgaaccttgcggaggaaaccttgggttttcggggcattggattctcaccaatgttttcgttactcaagccgacattctcgcttccgcttcgtcgaccccgctttcgcggttgcttcctctaaggcggaacgctcccctaccgatgcattttgacatccacagcttcgnagattgcttagccccgttancctcacccaagggcgctcnattagtgagctataccatcnttaagggggctgctcaggaaactcctggtgtcttgcacccactccttacacgacgtcattagggctaactgggtcggcgttcctccacataactanccatcgccangcgactnaccgtatttggcaacattaaattgccattgacgnccaaccgacaaattt

SEQ ID NO: 94922 - DNA, 680 bp, Triticum aestivum
  unsure (1)..(680): unsure at all n locations
  Clone ID: PAT_TA_94922
gtgagttttgtcaaattgcctaggctatttgggatagaacttgagagtatgttttcactaagatccaggtactgcaagctcccaaggtaatctaattcctgtggaattagcccagaaagttcgttgccccagagacttaacacggcgagcttggtcaaattacgtaaatttcttggaatggaacctgagagtgtgttggtgccaagttgcaggtcctctaagtttagaaggtaacccagttctcgtggaatttgtccataaagttggttaccgtaaaggtataaggaagtgagtttggtcaaaccacctatgctattcggtattttactggaaagattattactagacaactttaatgcaactaagtgtttcatgtgtcctatttcacaagggatatgaccaacaactgattgcttgacagtccangcgcntcanggtcctcaaggccnanaattganggacccaantccctcccaattcattcnccaaagaatgcantgatacaggcgccncgangcaatgaaangctacncaagtgatgcctcccaattcaaggtctgactntttccaagacccagnctgtnctttgtntcaggttcttcaaaaagatnctncttcccnacacatnatcagaaccgaaaggtnaannatacaanatggncataatgaaattggttgtc

SEQ ID NO: 94923 - DNA, 676 bp, Triticum aestivum
  unsure (1)..(676): unsure at all n locations
  Clone ID: PAT_TA_94923
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacaagtggaggagtcaagaaggagtacctgaccgtacgtccgcatatcggatcacaacatcgccaagtgaatgcgtcagctcatgcctnaagcaccggctcaagatccgcaaggctaaacactantcacacggcacatataatgcattgaatttgtaacncnantgcttggnttctccattgcttctatntccaaaaagtgagtcaagtcagtaaaatgtcaaaactnctantaagaacgngtantatcatgca

SEQ ID NO: 94924 - DNA, 683 bp, Triticum aestivum
  unsure (1)..(683): unsure at all n locations
  Clone ID: PAT_TA_94924
ctctcctcgccgagctcgctctcgccgccgcatcccatccccgtcgcgctcccgccaccattcctccttccctcctaccactcccctccgctaggcctagaaatcgacgaggaggccgagccgccacccgctaccgatcctcagaccgtcctgatcgaccaagctcggggtcgaggggcgcgccggatccgggcgcggcggctcatatcccccatgctgcgcggaaggacggcgacctcgccacccggtagccgccttcctggtcagcgccctgcggacgcgttcccggcggactatgtggctgcgcccgtcgagacagagaaggagcacatgcccgccgacaggtacccagatgctgtggccgcggctcgagggcctggatttggccgccgttagaaagtacccatagatggatttggaagcggcgttgtttgtcactaccttgatangttctcttcgtcnatcccttcctgaaggcaaanntgggacgntcttggaatggctgcatttctgctcaaanatgaggagactattgcactcccatggactgaggtgatgagnaaatctccttgncggaanaganaaaaggtgacggtactctgccattatganattctcgaatnatatatannactcagccgatnacgtacgccatnacaaaaagggtatttgtanctaattcg

SEQ ID NO: 94925 - DNA, 205 bp, Triticum aestivum
  Clone ID: PAT_TA_94925
ccgaaacctcgtctctttgcttggctattgcgacgaagaggatgagcagatgctggtgtacgagtacatgccaaacggtactctacgtgatcatctttcaggttaggacttgttttcgatctgtagctagccacctcaaaatttatcattcttttttggttgcttgcaaactatttttgcctgtcctgtgtcgaaaaaaaaaaaa

SEQ ID NO: 94926 - DNA, 162 bp, Triticum aestivum
  unsure (1)..(162): unsure at all n locations
  Clone ID: PAT_TA_94926
gagaactantctcnactttttttttttttttttttttttttttttttttcaaaacaacncattgttaaaggaccaannttgganagnaaaggtatggttcaccactacatcaaccagtacccangggntgaattacacatcaaaaccncgtgccgaattcgg

SEQ ID NO: 94927 - DNA, 577 bp, Triticum aestivum
  unsure (1)..(577): unsure at all n locations
  Clone ID: PAT_TA_94927
gtggcataaggcaaaccccacttccttatatcgctctgaatggcttatcccttgtgcatcgcgagctcgtcgaccagtgtgtgtacactagggggatacggttggaatttccagagatgagaaagatgatcagacgtgctttcacccccttggaagatatatgttgcatctttgtacacaagatgactgggtgttgacattagaggtggctacatgaggcttccgaagaaggctgttgatcttattgaaagcaaaacggncatatggataattcaagggatatctgctgcatgacgatacaggaccctttgtagcggctcattccaaaaaggcaaacgatggcagctcctcatacaaggagttttccgaagtgttcngtcaacttgaactgaaggaaagatcttgttgtcacacttccanaggcttgcatggctattatcatanacatagatncatgttnacttggaacaccaaanagctgcccttgggtctcncatggtcggttgtacacttcggtgtggacaacangtgaattcactacacactctcaaacaattgttgggtgattcaaaaaaaa

SEQ ID NO: 94928 - DNA, 182 bp, Triticum aestivum
  Clone ID: PAT_TA_94928
gttcttcctctagataagggagaaatcagtgtgctgttgtgcaatattagggtctttaggtgtctaactgtaaccgaggtatctcctatcttgtgatgttgcactgtaggctgcaactaattgcttgtcttcatcattgaacctatgtgtagatcaagcagtgtcgtactaaaaaaaaaaaa

SEQ ID NO: 94929 - DNA, 627 bp, Triticum aestivum
  unsure (1)..(627): unsure at all n locations
  Clone ID: PAT_TA_94929
gaggaccaccggcatctcccagccccaggtgttctggcgcagtgccctcttgaggtcggtggtgttgaaggtgtaatgttttttctccgccacaaacgcataatcgcaggggctgaagttgaccttgtcggtgtggtcgtagctcatgaaggccacccagttgtcggtgaggtccggcggaatgtctacgtggcagcagcctaccccggagcaggcaccgttcaccgcgctctgggagttgttgcagtagcagaggcagccggtgaactgggcgtaagacgtgctttcgccggagccctggtccggctggctcgcgaagtaacccgtggttttgcaanccaagacaaagagttgttcttggcgttggagatgcggtacaccccctttgttgaaccnaagtcctgtatccgacctactccggttgccggaagatctaacacggcacactacaggcagcacagcnggctcaaccgcctggattgagaaattgcnatctaacggctttcgtcccnccgtgttgaatacggtacggngtaanataatggaacaancggatccacgcgcatctcanatccaangtagganacaacgctnatnncggcttgtactctataccggacanaccaa

SEQ ID NO: 94930 - DNA, 633 bp, Triticum aestivum
  unsure (1)..(633): unsure at all n locations
  Clone ID: PAT_TA_94930
cgattccaggaaaccgtcgccgatctaagcaaatcttgttcaccagagcgccaacaagttgttgcctcttggcttcatgacagctccttgacctgctgctgctgctgctcgttatccagctttttccttgggtaattagctacctgctcgtcgtcgtcgtcgtcgccgcagaaaggccttggtgcctagtcatgtcggcgtcgccgtcgatgagcggcggtgccggggagcggacgcggacgcggacggtggtgtggttcangcgggacctgcgcgtggaggacaacccggccctagcggcggcggcgcgaacagccggggaagtggtgccggcgtacgtgtgggcgccggaggaagacgggccgtactacctgggcgggtgtcccgtggtggtcaaccagagcctcaagcactggacgcctcgctgcgccgctcggcgcaaccggctngtcaaccggcggtcaacgacacgtcgcncgctgtggagctcgtcgcagnacggngcaaccattctctnaacactcnacaacgcgtnctggccggacaacgtaacaatttgggccanggatacgnatcttaatcgacnnnacacaaggagcnanacagggcctantttaacctcgaanccgtngt

SEQ ID NO: 94931 - DNA, 412 bp, Triticum aestivum
  Clone ID: PAT_TA_94931
acaacaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaagaagtactgatcggctcatgccagcatgatatgttccgcctaaaatgaaataaaagctcagacgagatgagcagcgtcatcgtgcctatgcgtgtgtgtgtggccaacaaatatgtataccagtatgccgtgtcttcgtcgctgtgttttctctctcgagaaaaattgggtgttgcttgttgttcagatatccggaatatcctccgtgaataagtaatgattgtgcgttggtggc

SEQ ID NO: 94932 - DNA, 625 bp, Triticum aestivum
  unsure (1)..(625): unsure at all n locations
  Clone ID: PAT_TA_94932
gcgtcttcgactccatcgcctcctcctccccctcgttgtctccggccagccaggtagtcctccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattgatatcgctctgtggaagttcgagaccaccaagtactcgtgcactgtcattgatgctcctggtcaccgtgatttcatcaagaacatgatcactgggactccaagctgactgtgctgtgcttatcaatgactccacactggtgggtttgangctggtactccaaggatggcagaccgtgacaagctctccntgcttcaccctgggtgaacaaatatcgctgctcaacaagatggtgcacantccaantatccaaggccgtnagaagaaatgcaagaatcctcatactaagaggcgtaaactaaagtcctcgtcacncggtcaaggnanaatatnaagcacaact

SEQ ID NO: 94933 - DNA, 361 bp, Triticum aestivum
  Clone ID: PAT_TA_94933
ggtgtcttgagaactgtttgagttcaggactgttttgttcatgtctgcagatagcttcagcaggagcaggatatatatataccacagagactttagaaacgacagtgcagggcttctttgaaggataaactgcccatcctagctctctctctctctctctctctctctctctctctccctctctagatggagctccatttctctttgttgttctagcaactgtgaataattgtaattatatagcttagattactagaagaacaatacatattatatcaggaatagggctcctctgtacttgcacctgcgattgaggaagaaacttgacatggagttgaaggtagttttcattaaaaaaaaa

SEQ ID NO: 94934 - DNA, 639 bp, Triticum aestivum
  unsure (1)..(639): unsure at all n locations
  Clone ID: PAT_TA_94934
aaacaaagaggggatggctctctagggttcgcccgccaccaccgtcgccggccgcgtcgccgacaaggcgtgtggatccggtctccgccgccccggccatacaccggccgcatcagatccgtcacgccgccatcccttagcacctgctacccccgctctcagtccgcccctgtgctccacctgcgccggtgccggagattcagctgcaccacgccggagcttcagctgcaccacactggaggccccccttgccccgactccacctcttcctgcccgactgcaccagccctgccccatctcctacctttgagaagatgtcaaaagctaattggagtccagaaatgaccaccattttttgcaatctcactgctaaggagaaggaaaaggggaatangcctaccaaaattttgaaccctgttggatacaagaatgtagaattggctcnttcagcagacggaaaacttacagtagctgcattcaaaaataaatggggaatttgaggactgtatanggatggtgatctaaagaataatctacggactgggtggatgataaacaacacgtgattgcgatacaatgtggaaaagcggtgaagaaacagaatctgnattctaagtgcctaaatnacaatgacacagt

SEQ ID NO: 94935 - DNA, 633 bp, Triticum aestivum
  unsure (1)..(633): unsure at all n locations
  Clone ID: PAT_TA_94935
tttttttgttcaaaccttgctaacaatatttaattaagccacccagcacgagaatcacagagcatgatgcgcaccacgcccccattttccccataaatttgcccctcttccgtctctgctgagtgcaacaccgccaactttctacaaaactaacgacaccattcaccaatatttcagctccacttcaacaatgaccacccagctcttcggctcactcccacccagattgcctttcaagtttttgacctgacacgacccacgattttcccagtagaaacgtctttgaagctctttttattaacaagtcggcacgacgaggctcatccggggacgttgaagtggaagagccaggatatgacgaaggcgaacaccatgcaggccaggaggaagttgaggaaccggtggcttgccagaactccgcgtctcgttcgccggcgcctgcgtagctgcggagttgcccgattcgttccactgctccatgaactccgcgtcaccgaagcaaacacttgcatgcgtcgagcgcagtntcgcaaactgttgccctgatctgaacaagtctcgngcatgctgtggcnaagaagnctcttnaggacagccacacatncgngccgatcgggngngcccaggcagtgg

SEQ ID NO: 94936 - DNA, 612 bp, Triticum aestivum
  unsure (1)..(612): unsure at all n locations
  Clone ID: PAT_TA_94936
gctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccgtttaggcgacggaagtttgaggcaataacaggtctgtgatgcccttagatgttctgggccgcacgcgcgctacactgatgtattcaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaacgattgaatggtccggtgaagtgttcggatcccgcgacgggccggttcgccgccccgactcncaagaatcaatgaacctacaattanaggaagagaatctaacaagttccgtagtgaactcggaggtatttccgacccgacaaanaangccagcgtacaacgtcgnacgactctcccggatctcacactcctctcggcgg

SEQ ID NO: 94937 - DNA, 646 bp, Triticum aestivum
  unsure (1)..(646): unsure at all n locations
  Clone ID: PAT_TA_94937
cgcgatctcaccgagaaaatcctcgaccgaccgaacgacaaggccctctcatcctcctcctccaagatgcagatcttcgtgaagactctcaccggcaagaccatcacccttgaggtcgagtcgtctgacacgatcaacaatgtcaaggccaagatccaggacaaggagggaatccctccggaccagcagcgcctcatctttgctggcaagcagctagaggatggccgcaccctggctgactacaacatccagaaggagtccaccctccacctggtgctccgcctccgcggaggcatgcagatctttgtcaagaccctcaccggcaagaccatcaccttggaggtggagtcctcggacaccatcgacaatgtgaaggcgaagattcaggacaaggagggcattcccccgggaccagcagcgtctgatttttgccggcaagcagctcgaggatggncgcacactggctgactacaacatcaagaaggagtcaacctcaactggtgctaagctccgtggagnatcaantctcgtcaagacctgacggcaagacatcacctggagtggatnctcgacacatcacatgtaagnaaagtcaagataggaggttccccgacanaagctatttgcggaacaantagntgcgact

SEQ ID NO: 94938 - DNA, 622 bp, Triticum aestivum
  unsure (1)..(622): unsure at all n locations
  Clone ID: PAT_TA_94938
aatggctccagctgaggaagtgaagagaattgttggcccgattttatttactctacgctcatctcctgatgcaacatatgtgatgcttggcaacatactagtttttgccaagactgccccattgttgtttgcttcgtattatgaagatttcttcatatgtgcttcagacccgtaccagactagggctttgaagcttgaaatactcaccaccattgccacagagtcatctattccagccattcttgaagaattgcaggattatattaaagatccgaataggagattcgtggcagatacagttgctgcaattgcattgtgtgccctgaaactcccctctatcacctccagttgtcctgagggactttggcacttgtactgtacgaattgtcnacactaaccagttcacttgaatgaagaagatgcnttttagtcaagccacctgtcaatcaaagaaatatgaaaatagatgcaacatctcatgagaangngatatccgctggtcgtgtccggatacattatggagctgccgcacgncctaatattgganatggngaganacctacggaaaccaccaaagtacccattgtctaataccggnaggccttgcncgaatgccannaan

SEQ ID NO: 94939 - DNA, 476 bp, Triticum aestivum
  unsure (1)..(476): unsure at all n locations
  Clone ID: PAT_TA_94939
caagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcctgcacatcgatcatatcgatttactactaccataccatgttaccgctactgattcgaaggcttactatcacctgactgcatcaacatcaaggtgcatgccatcttgttgttaacagccccctaaataanctccctnggtttaactaaa

SEQ ID NO: 94940 - DNA, 632 bp, Triticum aestivum
  unsure (1)..(632): unsure at all n locations
  Clone ID: PAT_TA_94940
ctcgtgccgaattcggcacgagattccccaccagccccctcgcaccttccggcgaatcaccgcacctctccccggcgaagcagcagcgtccgatggcccccaaggcggagaagaagccggctgccgcggagaagactccggcggccgagaagaccaccgcgggcaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatccggtatctcctccaaggccatgtccatcatgaactccttcatcaacgacatcttcnagaagtcgcccggcgagtccgccaagtcggccgctacaacaagaagccaacatcactccaaggagntcagactccgtccgctcgtctccnnggggagtcgccaagaagcctctctnaaggaacaaggcgtcacaatncaatcccctaanatagtgttcccgtctcctggtggtnnatggtccccgnanggccgtanngttcngacaagtccntgttctgtctggggtngganaaagttnaatccgggatcatacttgcnatttttggcaaaaan

SEQ ID NO: 94941 - DNA, 328 bp, Triticum aestivum
  unsure (1)..(328): unsure at all n locations
  Clone ID: PAT_TA_94941
gcgacggtggcggccgtcgtccatacgtcgactcgctcatcgacctacgcgtccccgacggaggcaagggtgacggtgccggccggcgcgcagtcagggacgacgagttcgtgaacctgctgtcagagtttctgggcgctggcacggggacggtgatggcaagcctgggaatggaccctcgcccacctgggtaaacgaccaggagatccaagaaaaagttcgggacgaggtcgacggcgccggcggggccgttgatctccactccaagcagcaggagcctcatgcctgggcatgccgttatctgaccgcgtccnaaaggggggggggg

SEQ ID NO: 94942 - DNA, 481 bp, Triticum aestivum
  unsure (1)..(481): unsure at all n locations
  Clone ID: PAT_TA_94942
cgcaaccaaaaaaccatcaactgacttcacaccgtctaaaggctcccaaggcagtgtctccaactcgtccaatgcgacacgcgtcggttctgcctgtgaaactgaggggaagtggaattgcatcgacgaaaagtcttaccaacagtgcgcaagcggtacttggtcagttgttatgcccttggctgctggaaccatgtgcgaaaagggcgtcagtgatgctatcaaggtcaacgcaataaaacgcgcaacattagattttccacatctcacctacggcgtcatcttgggtggctccgagaaactttggataacccttgctgggcacgacgtaatcaaatttatgagaatattgggggaactgcaaaggaatgggtttagcangtatgttactttccctggtcatattaagataatggcttgtnnaaatatcgactggctaggcgtctaacaacctanacataacatgagcaatgaacaacaa

SEQ ID NO: 94943 - DNA, 564 bp, Triticum aestivum
  unsure (1)..(564): unsure at all n locations
  Clone ID: PAT_TA_94943
tctccatcatcacattgaatagccacatgcaggcggcctgcagagtaatccgagaagatgctagaaaagctgcggccggggagtcttcgtttccaattccagaccccgccgctaagcatggagaaataaatactcggttctggcctctcaggttaccaagaattaaatggagataaaaatgttcaaagacaacgttatagttacctcaaattagacctagactgcaaattttggggagtcttcaagtgtgtcaacggaaattttttcatgtttaatctcaaggctcccatcatcattggataatcaagattcaaacaaatccctacggaggctatgactatgaggaacntcacaatgggaatatcaagctaccaatcccatctgatttatgcccacgttggtanatccatccaatttaacctggagntaacaanaattccgacccaaattactgaacatctaatataaaccgggtatattnggnatcaacatnaacaaacccgggctattnttatgggattggtaacaattctganagttcaatggagttcngtacccccaaaa

SEQ ID NO: 94944 - DNA, 619 bp, Triticum aestivum
  unsure (1)..(619): unsure at all n locations
  Clone ID: PAT_TA_94944
agtatgaccattagcaggttatggcttatgttctacttttggtttatactcgacgccttgctgagcaaccttctctgttggtcacctaaacttcccccagactaaatacagtatatttaagtggtttggtcatgtatggatttgtttcccacgtgccatatacggttgttagcacctccacagaatacatgcaggaccggtgatcaaatttctacagtgcaaggtgtgctaccagcaagagttaggcaagaagaggcccacaagaggctccgtccgagcttcagggaggccatggtatgagctactaaggctgaaagcaacgagaagacggtgggactaaccccaagaccgaacctccgtaacggatagccatatgccantcctgggtctcactgatcttggggcttcctngggaagaccccaggatatacaacgctatgccacacaactttgtcaataaaactttaagaccgtncacaaaacacaacatttagttntcccctaactaaacactccaagctgatatnggacgcataatgntggcggcctacangatgacaggctaataatgncatggctggaaagaatcatacgggatncaacnatgncacnagaangt

SEQ ID NO: 94945 - DNA, 603 bp, Triticum aestivum
  unsure (1)..(603): unsure at all n locations
  Clone ID: PAT_TA_94945
gctttgtgtacaccattcggctataaatagtggcgccggtgggaggctatccattcaattcaattgtgctcatcatcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtgggtccgtcctcggcgtggcgcctgagaacaaggcggggcagttcgaggtggccgccgggcatccggcgaaggctgcagctgcggcgacaactgcaagtgcaaccctgcaactgttaagctgcatgcaccctactacgtgtgttggtgttaananatacctgaataacagcnccgatctgatgagtccacangngccttgcctntcctgtggtttgctgcccctcnccaanctctgccagggncctgggtgnagtgntgtgaantcccgtaatgctcacaacccananggtgggngnaatngtagatgaagttactattactaaaaaaaagggggccggtcaattcccanatn

SEQ ID NO: 94946 - DNA, 598 bp, Triticum aestivum
  unsure (1)..(598): unsure at all n locations
  Clone ID: PAT_TA_94946
cggcgtataaatcagttgagccatttgtagtcggacttgagttttgtccttttagcgacccatttaagtgttgggccaattcccggccctgtgtgcctttcggcctgttaacggaccataaatgagttgggccatttgtagtcggaccttagttttggccttttaacggcccatgcccttcatggtccaataccagcccagtttctcttccggcctgctaaaggcccacaacacagttggggccatttgcaatacgacctgactttcggcctcttaagcagcccatgctcttcatggtccagtacaacccgctgtctctttcgacctgctaaaggcctacagtatagttgggcatattanccaaacttaagtaacngcctattaanggccgtntaaataattgggccactgttcccgctcaaagtccggcgttaacgacccggagnangagaccgacattaatccngacnataacaaccataactaaagggccacnaatttgtanagtcttangcaaattaganattggccatacaacacaattntcaaggncaaaacgttaaccaaggttncatanaggaananatgccatcacatn

SEQ ID NO: 94947 - DNA, 603 bp, Triticum aestivum
  unsure (1)..(603): unsure at all n locations
  Clone ID: PAT_TA_94947
ttttttttttttttttttttttttttttttttttttttttttttttttgcacagtcgttaactcgcagtaaaaataaatcacatacattctggtaaaaaagaaaggatagttcagttttcaaaacaagcatgaagcgtcgattggaactagcaaattcaaacataatcatgccctgttgactgatacttagaattaactaggctgcatccacgatcttcccttccagacggaagacagcacaaccatcaggtacataatttgcgaacgaagcaaccaaggagatacgccattgacagatcacagatatgcttctgaaagagtatctacccgtctaaaaaacaacagctganagggtcggcaacgggataatcctcggtatccaaaataagtgtcccaacaagaacaacactccaatattggatacaanggtcaggtgaaggcctggttccacttcaagcancatgagttgataancatcaattcctgtccatgtcaatttcctacaacccaaatttgattcctttacactttgctcaaaacaagactggaaagcaacactcccacaacttggaatctaatacaaacttgaaaggtccaaggat

SEQ ID NO: 94948 - DNA, 614 bp, Triticum aestivum
  unsure (1)..(614): unsure at all n locations
  Clone ID: PAT_TA_94948
gtcttccatttcaattcgacgaatttgtttccacggatcgccagaagcaatcagcaaggaacaaggatcctagccccccaacccttaaattcacaggcacgtacatatatacacaagcagaattcgggtagaggaagcagatcctacatcaggagagagacggggcattaggagactgaaccgtccgagcggatccccacctcagcagaccctggggacgaagcgcagcgcggcgacgcgggcggcgagaagcccgcgagctcccgcacggcaaactgggtgcagttgggagagcgcgatgaggcacatgactcgtagatcacgccgagcgccactcccgccgccgatnggcggggggcggggacgttcnggtccgatgatccccaaccttggacaaatncggaccccgaaacatggtccacccgccgcggccgccggccgctcccgccactgccgggtcgaangggcctccccgtcatcgccgccgcgccggaatgncttggnacggcggtgcncccccgcggcgacggtggccaagccaagcngagnccgcgctgatggtntggtacggaanagtgctnnggcggngaaaccgcttgctgcgggaaaaccgc

SEQ ID NO: 94949 - DNA, 417 bp, Triticum aestivum
  unsure (1)..(417): unsure at all n locations
  Clone ID: PAT_TA_94949
gttgcttgcacaancacatggtcccaggntgcgatcnatnaaccaactccanangntagcccgatttcatccgcncagcttnatgggcgccacttcgccngantccggcnacctcatcctgntcnanccggcgagcccngggtccaaggtcnccgtggtgaccatcaaccgncccnatgcgctgaatacgctgacgngctcnatgatgatctccctgccactcggcgttccggcggttggacgccgacgacggattgacgcngtgggtgctcgccgggcgcggtcgctccatctgcgcatgggtggacctcaangcggcngaagatgtcttcaaaggggaacttcaaggaaccactgctaanccgttgcncaaattgagtctgccggaagccatcntcngcctttacgggttgacgt

SEQ ID NO: 94950 - DNA, 608 bp, Triticum aestivum
  unsure (1)..(608): unsure at all n locations
  Clone ID: PAT_TA_94950
tttttttttttttcaagccaaaaaatggtgctgcctgatatctttatttgatttaacctgttcatactcagacaaaatttttctactttttgccctttctccgccactgcttctctcgctcataggcatttgcctcttttccctcttccccttgaatctcagcgatgagtcgtttgtacttcttctcatacgccgcatctttctcctttttctcacggagactctcatgagcaagaattttcgcatccttgcgtagctctctaatagcaccctttttctctctcttgtgctcttttttcagttttgccatctcagttcgagttttatcagggtcntantgacgttctggattaaagtctcttcaaattaggcaatgatgttttaatggccaaaggacggggtgatgcaattctanggggcggcgctgtagctnggctttantggttaaggttccaattctggtggagctcctaatcaattctgggtagctccggnaagatgagatggatggatagcactaattggttgaacaattctaaacagnangaagactcaataaggccntttaaacaaatgntgcgcgcacgnanttaagtgaccaatantan

SEQ ID NO: 94951 - DNA, 643 bp, Triticum aestivum
  unsure (1)..(643): unsure at all n locations
  Clone ID: PAT_TA_94951
tttttttttttttttttttcaaaataaatgactaacacagggcacgtcagtcctgttatgtgtcgccatattcctctttatttgaagttattcggtaaatatggatgggcgcggcaacatgctcatcaatgttgtagtaatgtttaaggtgtcagggccacacggcttgtaaagggtaagaaagtaccatgtgacgactaacacagggactcccatcaccagcaccctgaccatactactcttgaaacctttcacgaaaacatatagaagaaacagcgtgggcatagaactggtcacgaagtccaggccttcaagggacatagcaaccccaatacggtaatgctcctggagccaaccagtgaaggcgagaacaagggtttccgtcctggggatcccnttgccctcngntcgaccaaccaagtgagataggacccacatttncagaagaacccatcatattntggnaacgggatccaatgggcaaactgcaacaattcntagnatggnaaatcacaaagctccaatctggatacacaagactcttaatganaaaacgctccacatacagaagntcaggatggtctcaaggctgnactnntcctcgtcccgacacagagcacgttgnacnatncgaattncccag

SEQ ID NO: 94952 - DNA, 329 bp, Triticum aestivum
  Clone ID: PAT_TA_94952
agccacccgtggttaaaacaaagggactagggagatcgatagaagcagagggcatatcattcttgcgtgtagaaaaggtttagtacttcaacatactactctctatgtaaagaaatacaagagcatttttaatgatctaaatgctcttatatttttttaagaagggtaatgtaccagcaagacgttcaccacatgcatgcgcacttatttttatgaacgtatgaacgcaagtgcatcccaacctatgaacagaagcggttgtccgtccgtccgtcgtgacaattatccttatagtcgatgaaaattgcccaccactgccatggtaagtg

SEQ ID NO: 94953 - DNA, 652 bp, Triticum aestivum
  unsure (1)..(652): unsure at all n locations
  Clone ID: PAT_TA_94953
gcgcggtcggtcacgtagtagtggcggaaaggatggatcgctggcgcgggagcgcgctgcggaagccgccgccggcgatagacgcgaggcgcgccgaggcggagaggggcggcggcgagacgggcgagggccgcgaggagccggtgagcccgacggggcggctgttccgggagccgcacttcagctgctacatcgtgtccgtgttcggcctcggcgcgcgggtcgacctggccgccgtccgggtcgggctcgaggccaccctcgcgcgccacccccgcttctgcagcgtccaggtgatggacgagctggaggaggacgcgaccccaagtgggtccggaccacggtagacctcgacgacactcatcgtcccggacctggagccaacggcacgtcggcagaccagacaggccctggagaatactgtctctcttccangctccccaatggacatcccgccgctttggaactcactcctcnattccaactcgangcgccgccgtctctgctcgctgcacatcctccgcnacgctgnnctgttcctctnatccttcaccgcggcncggacaaaancctgccgactgcacacgggcgccgtccctgccgttagcctgcttngccttgacccgctatggnnctgggccccctgtcttnt

SEQ ID NO: 94954 - DNA, 621 bp, Triticum aestivum
  unsure (1)..(621): unsure at all n locations
  Clone ID: PAT_TA_94954
ggggcttgtcataccaagaaaatctaaaaaaggaccacggagagcaaaatttgttagagaacaaagcacgcaggaggttttgaagtagtgtttgttttgcttcatcacgacatttggacaaacggcactgtggcattaacatgaatattcttaatgggagaagacgaaaagggaatggtgaaaatactgtgatgctgatcggtcaaggtatgagtgtgatccgaacaaaagatgggatgcattagcttccaggttaatttgtcacagcctatcaagttcatactgagatgaacaagtgttggagatgggatgtttcactcaagcatgacatcatcatgggacactgttattcaaaaacaatgccccttatcaacccgtacttggagtaaccttacaacgtttaaaggaaattcccctgaatccgacncctaatgtcctcccnatacaaaagaancgactcnaacgaaggaaacatacacacgagcaaccatggngccctccgtctctgggtnaaacatatcaaactttggacagggctccgggtgtctcaancccgcanacangtcaggcaaanaatccgtaccacttcgtggtggcagtnttcatagtgcattgaccaga

SEQ ID NO: 94955 - DNA, 201 bp, Triticum aestivum
  unsure (1)..(201): unsure at all n locations
  Clone ID: PAT_TA_94955
tttggtggtttttgtcccgcggcctctgccgcccgcccgcgcgcgataccttcccctcccctcccctcccccgtttagagctcacagaggcccgaagcagccgagcagcagcacagcggcgaaaagccaagccatcccagtcccaccgaccgggcagctgcctctccagatctcgcatgcgcggcgcgnnaanaggaagga

SEQ ID NO: 94956 - DNA, 653 bp, Triticum aestivum
  unsure (1)..(653): unsure at all n locations
  Clone ID: PAT_TA_94956
tttttttttagaaatttcaaattcttatttcaaaccgcactaaacagaagcaacaacactgcatttggagtataaaatctttgatacaagagatactagaatagaagttgccataataaattaacaagttccacgatgacactcaacattatttttgaaataaattcattctagtaataacagaggaagctctttctttacatgttgcccttctttcgtcgatgaagatcccagtttatgctcgcatggaagtagtggagaactggtttgcccttttgcttgcacaacgtccatcgagcctccgaacaatgctctcgattgagggtctgctcttccgatcaatgcgcacacaatctagacaatttcaatgcatacctttacttcctgggaggcatttgcatcaacttgagtatctggacgcatgtgtcctctgtccaattctacgtacccttcaataaaccccctgctgacggtcatctgttggggtatctctcgccgtggtatccgaagataatagccnaacatatagttgacgagcgagattacccgtaaggatcgggcaagtaccgtagtcanacatcgtgtgttgcctgttgtctgcaaacctgaagcaaanccattcgacagtatggcaanaattggntaacaangna

SEQ ID NO: 94957 - DNA, 271 bp, Triticum aestivum
  unsure (1)..(271): unsure at all n locations
  Clone ID: PAT_TA_94957
ttcgatttgggtttgggttgctgccaggaggaagaagacnantcnccatcgcacatcaacanccgccgcnantctcccggcgggcccgctccggancggcgcccaccagccgccggcgagctgaccgagcgaaacannagcgaancngcctctactccgtgttcgtttanaaaccggcaccatcngacganggangacaccagncagtcacgcacggagcgganaananaggaaaccaacacagcacattggcgccctccangcatcgtcg

SEQ ID NO: 94958 - DNA, 249 bp, Triticum aestivum
  unsure (1)..(249): unsure at all n locations
  Clone ID: PAT_TA_94958
cttccagatttccgtgcacgantgctccgatcacctcgtctgcggtcacattgagcgccttgagcatgatagccacgttctgcagcctctttgggtcgagcagccggctgtgctgccctcctctcgctgccgcctgaccggaattccccgcggnggnggtggcgctgttttgggggaacaggttctccattgccgcctcatccacgcngaatgagtcggnattcntgaccnggtcccagacngtggcgc

SEQ ID NO: 94959 - DNA, 629 bp, Triticum aestivum
  unsure (1)..(629): unsure at all n locations
  Clone ID: PAT_TA_94959
gcgacggcatctggccctcgggccgcaaccgccgcctcttcgagtacgacggccagcagcaccgcctccgcccgcgcctcccgcgcttcgtcggccgccgcggctccctcgtcttcgacctccacggctactactcctccgcctccggggacctctgcatggtcggctcgggctccggccgcgccgccgacgggcgccccgtcgcgctcctcgccgccgtgctccgcctccgcttcccccgcnccgccaacctctccagccccttcgtcaccggccgcctcgagagcaccggccctggccctggcgtggcgttcgagcccgtctcgctcctcgcctacgccgaggaggggtacgcctacgccgagagcgcgtcctgcctcgcccgcccgccgacggtcgcgactccgcanctgttngcngaagaaantcagntgcccngcctaagagctgtnanccggggtaagcnggcttacggaacggggcantcggcgctctnccngggaatacagacgcnatgtcgtaaaaggnaatnnctgtcaagncctgcgttnaagntncttncacattagttntcagtntattaggancaaaagtattngganaggntcggataatcaangtncttangt

SEQ ID NO: 94960 - DNA, 453 bp, Triticum aestivum
  unsure (1)..(453): unsure at all n locations
  Clone ID: PAT_TA_94960
ctgcccaccacctcccttactcctcgccgcgccgctccactcctgtccccgccggcgtaccagctcgatccagcggctagccagccatgtcgggaagctactcctcgcggctccgcgccgggggcggcggcgggggcctgggcgcgacgacggtgctggcggccaaggtgggtttcgcgtcgggcgcgctggccgccgccgcctgcatggtgccgcagtcgtgtccgccgccgacgcttcctctggaantctacttcttcgtcaacgtgaacttatancttcgtcatctggnantttcccgacagcaanaattncaaagccgaaaaacaacaagnagnacaagnaccctgggaacgttctctccacaacaaactgccgccgcgggctctgtcanacggacaagccntctggcgcctnaactaggtngatttngcccgcccgcttttcccgcgc

SEQ ID NO: 94961 - DNA, 319 bp, Triticum aestivum
  Clone ID: PAT_TA_94961
gcctcctcctccaccgccacctccggctcaaccctacgccgtcgctacgcaagaacaaggaaacggcgagcccaagaaggacgtcacggcggcggccatgaacggcgacgaggccaagaaacagagcgacggcgggggcaagaaacaggggaaggcaagaaagcagaggacgatggggaaggacgcgaagccggagcatggagcgcagcgtgagcctgggacaccggctgctcatcaactcttccctggccgctctccgttcggccggaagaagaagtgtcgcccaacccgccgcggttcgcccccgccaaggacggcc

SEQ ID NO: 94962 - DNA, 230 bp, Triticum aestivum
  unsure (1)..(230): unsure at all n locations
  Clone ID: PAT_TA_94962
ctcgagtttttttttttttttttttcagagttcgggcaaatagcagcggcagatgatcaatgtgaccgtatatttctccattccttcaattcaataataatcaagaaagcatacactatccatggactgcagagcagaggagctaaaaatcctacagctcaatggcgatcctgtgaaccctttccttggggcaatggcatggactccantccgaggggggggcccggtac

SEQ ID NO: 94963 - DNA, 575 bp, Triticum aestivum
  unsure (1)..(575): unsure at all n locations
  Clone ID: PAT_TA_94963
gcagacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatccgacgccaacggcaggaaggtgggcaaagaagggcgtgtaccattccgtttgacaagtacggcgccaacgttcgacggctacagcccaatctacacgccaagangaatggtctgaatctggtgaccgctacgcccggcgggacgaccggcttcttatctgggcnttaacntcnccggttcctcggggggggtctncctcgtctaaaaaaacaaagttctcccccggtaaaaaanaattacttntaaaaaagggcggtcctgcttcatganntccccgtaancaaaaaacacccccgngatnttgcaanaacnatcaaatatnttccanaaatggtagtgattactaanncgttacananatccacttgaacgtaaaaaaaaaaaa

SEQ ID NO: 94964 - DNA, 592 bp, Triticum aestivum
  unsure (1)..(592): unsure at all n locations
  Clone ID: PAT_TA_94964
gcggtggcggcctctcaccccgtctccggcatggacgtcctggcgccgctgtcccgcgcgcatatcggctcgccggccgcggcggccgcctccgctcgcccatacgttcttcatcgtttcaaccggaggaccatccgccgggaaaggcgccggcctgcgctgccgccggcgcctgctcagcgcgcggggaagagcgcccggctccggatgacgatgaggacgacggggaggtggctggntcgacgcagcggtggcgctattcaaacggcggggagtaccacgcctgccacgacttggtagaggactctgggtacaacgcccnaagaccccggccggacgctcctccaacgcttcctccaatgcgccgttagcttccaacaactcttnaaaccaanaccaccgcggngccatgatggactccgggaaagctctgcaactccgccgcctgcnctgnaggacgacggngacaaaggctttctcgatcccggacaaggcccncctgtnaattctctaacgcaccaaaaaganncccgaatttacgacaacntgctggcatggatggtcccnactctacaactgtcggaatnctgcg

SEQ ID NO: 94965 - DNA, 596 bp, Triticum aestivum
  unsure (1)..(596): unsure at all n locations
  Clone ID: PAT_TA_94965
gccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagttgagacgatgggggataagcttcatccgtccaagagggaaacagccggatcaccagctaaggccctaaatgaccgtcaatngaaaaggaagtgggggtgcaaagacancaggagtttgcctaagaacaccacctttaaagangcttatactcactgatttgacccctttccctgaaagatgaacggggctaagcatttgccgaactgttggatttccaaatcacccgtnaggganctttcccccttaaaagggaacaaccgcnaaancgggtccacnaaacggaagcaaaantccntntaattacgaaactgggtgaganccaatgcccgaaaacaaggntctcncaaaggtntcaacggaggtgannaggcctaaatagggcnaaagggtatcatgcacagtatantccgtcancctgt

SEQ ID NO: 94966 - DNA, 164 bp, Triticum aestivum
  unsure (1)..(164): unsure at all n locations
  Clone ID: PAT_TA_94966
ggtggtaccactcgcctcgtctcggagctcccgcctcgcctctcctgcgcgtcgcggtgagggtacngcnggccatggngtaccagtaccatcaccagnancacncgctggggatggacccggcggtggcggntgggaaccncngcggcagcttcgngccaggc

SEQ ID NO: 94967 - DNA, 259 bp, Triticum aestivum
  Clone ID: PAT_TA_94967
ctcgcctcccctcccctcccctcgcggcgtcctcttcccgccgcccgaatcccaccccagccggggccgagctagaaggaggagcggagcaagatgcccccgaagaaggcggcggcgtcgaaggccgacgtcgcgaagaagcagaaggtcgtggaggacaagaccttcgggctcaagaacaagaacaagagcaagaacgtccagaagtacgtccagtccgctgcaccagtccgtccagcccaagcccgaccccgaccaa

SEQ ID NO: 94968 - DNA, 241 bp, Triticum aestivum
  unsure (1)..(241): unsure at all n locations
  Clone ID: PAT_TA_94968
gcagaacaaatcaagcaanctctcctctcactcgtttcntgctcggttcatttgcggcgtcancgatgggcgacctgattccggggttgccggaggaggtggcgacggantgcctcancagggtgggcttcgaccatnctgcccgccgtgcnccgcatctcgcggcagtggaangaggangtcgagtcgccggcactacngncgcctgcgccgcgccgaacgggctggtnntccggtgctc

SEQ ID NO: 94969 - DNA, 340 bp, Triticum aestivum
  unsure (1)..(340): unsure at all n locations
  Clone ID: PAT_TA_94969
ctcctccccactcagtcctcggttcccggtccggtcccgttccgttcgttagggtttagtagtagcggggaanaggaaggaatggcggacgtcnagtaccgctgcttcgtcggcggcctcgcctgggccaccgacgaccagtccctccagaacgccttctccaagtacggcgacgtcatcgactccaanatcatcactgacagggagacnggccgatcccgcgggttcgggttcntcaccttcgcgtcngacgangcnatgcgccangcnatcnatgcatgaacnggcagnacctgggacgggcgcaacatcaccgtcaacgatgntanttcccgtcgct

SEQ ID NO: 94970 - DNA, 580 bp, Triticum aestivum
  unsure (1)..(580): unsure at all n locations
  Clone ID: PAT_TA_94970
aaagcaccgtcacaagaggactgccgatctcaaaagtcgtgtactcctttctcaacgacacgctgtcggcatcgttccattacccaaaatggaacaaggggcgagtcatatgcctgaagtcccagctgaaaaagctgcaggcggccatagattcctcgaacggcgcggccgtccccggcttcgtccacatgacggactcccgcctgccgtcccctggctcgaaggtgtacacccgggagccccaggtggagaacggctcggcccatgcccattccactgctgaatcgttgggtagaagaagaagaaaaggatcnggactcctcncgctgtgagctcccaagggtgcagatacngtacaatcnggttttgagccaaagggaagacaagggcaaaataacaattttggggttggggatcaatccgttcaaatnntcangccgcgcgacaagaactgacatacaccctttgancggttcctgctcgtgataccgtggtgtgctctcgcnctaaaattgccatctgccaaaaaagtctcttgaanactccgcacttggcantcagaatcaggtancnaggatta

SEQ ID NO: 94971 - DNA, 644 bp, Triticum aestivum
  unsure (1)..(644): unsure at all n locations
  Clone ID: PAT_TA_94971
gcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaaggagcaacctgcttttgacaagaagcagtttatctctcacatgaagcgctacatcaagaactcactgccaagcttgaaggggatgacctagatgttttcaaagaagaatgttgagtctgccacgaagtatctcctaacaagctcaaggaccttcanttcnttgttggcgaaagcatcatgatgatggcggcntgtgttccctactacangaggaactgctgatcaactttccgnacttgccatggctgaanagncaatgcnatgganatatgcnaaatcttgggncncataatttgcccgcccaagtanggtgcatcaanncaanttgggcatacacaagtaatgcncaaantcgaaatgggattcttgaaggaacnaattgggngtggttgcannccggttaca

SEQ ID NO: 94972 - DNA, 352 bp, Triticum aestivum
  Clone ID: PAT_TA_94972
gcactcgctgggatccaccgcgacgtgatcggcttccgtgaagcccaggtgggagatgtcggtgctggcgagtatgcgggcgatggcagccgcctgcatgatcatgtcggggcggtcgggctcggcgaggggctcgtcgtggtcgtggaggtccgtgccgagcgtagcggggagggtggggaagcggcagagcggcggcgatctcggagtggacggtgttgggcaagcggcaggcgcgctcgaagccggccctcccaagctccctcccgtcgccgtcgccggcgccggccggaagtccatggccggcgggcaagcgggcgaaacctagatcatttcaaacgggaagaagcag

SEQ ID NO: 94973 - DNA, 594 bp, Triticum aestivum
  unsure (1)..(594): unsure at all n locations
  Clone ID: PAT_TA_94973
cagcagtgcagcacctcccttctacctcctctgctttgcattcctccttccagctccagccgcaatcaatggccgccatgaagatcaccctcctcgccgtggccgcgatggccgtcttactaggcagcgcgtcagcggtaacctacaacgtcggcgatcagggcggttgggccctcagcaccgactacagcaactgggtgtccggcaagaagtactcgaccccgacgcacgacgtggtcgaggtcagcaaggccggctacgactcctgcagcaccgacggcgccatcaacaccttaacctcggcaacgacgtcatctcctcaacgccaccggcaccgctactcatctgtggcgtcctaacattgcaacccgccgccgccgcaacatgaagtctgattgantcgctcnggtctctcgcgtcgtaacatgcaangcagtctgggcnananctccccggggccgcctcaaagcgtactcgtcgtgcanagaagattggctctccctctgcggcgtccaaggttgancataatgatagtgcgncgaanagactaccttgtataatacaaacgagtatacacggngaaaaagtatcttt

SEQ ID NO: 94974 - DNA, 596 bp, Triticum aestivum
  unsure (1)..(596): unsure at all n locations
  Clone ID: PAT_TA_94974
cctccgggctccggacccgctccgccgtcagacgcctgacctactcgcctagtcctcgtctgatctccgccgcctccggcaccgcctgccgcccaccggccctcgcgtccagggctcccggcgttctccatccccggctccccccacagcctaaaaaactgcaggatggagtcagcatccaaggagaaggtgacagcgtcgaggtgctccacacacaaaggaggagggaacacacatctttgagatngccgggtacagcctcaaagaaggatatgggtgtcnagaaattcgtccggtcngtcaccttcatgtcggtgggtacnactggtcaacanattttatcccgaaggtacaacaatcncccgaanggttaatgggatntgtcttaactaatanaanatccnaattgcggnattcttcggttggntggnaacataanaggttgatggtaatgttaccaacataagggtnagtcaagacaagaaatctatacacgtaaacaaanatctagnaacataatactaggtattcanacatgatttcgataanacagtataactggannaattgncactaataggatcaacttgaaagnn

SEQ ID NO: 94975 - DNA, 473 bp, Triticum aestivum
  unsure (1)..(473): unsure at all n locations
  Clone ID: PAT_TA_94975
accatctcaacagtaaccctgagtccatagaaacaatggaggggctcggtagatccaagataagaaggaaatatcttgacggtgcagaaatattggctttgattaaagtctcagaattgctcttcgacaatgtattcgggataccaacggtaacccgtctcgatcattacccgaactaacatagcagtatgaccgggaacatccgaggcaccgggtcaggtgaaccacttggttttgagcacgagtggcatctgaaagcacaaccacaattgcaaagccttanatttctaaggaaaattggcagcataaggttntaanccttanaaaaanttttgagacattcacaatagttttcatnccacccaacaaatcatatcaagggtccgattcacggggaacaatctaaaagttnaaactgnactgaggtttttacacaacctaaaagctactacgattatnagacttaacctgta

SEQ ID NO: 94976 - DNA, 675 bp, Triticum aestivum
  unsure (1)..(675): unsure at all n locations
  Clone ID: PAT_TA_94976
gcaccaggcgctactctcggtcaccacattcccggtcttcgccttcttcccggcggtcactaagagactcttcggcagacgctgggcggcgtgcctcgctgtgcgcaggaggcaggacgaggtattcgtcccgctcatccacgcgaagcgcggcgacggtgacccgccgtgctacgccgactccctcctcgccgtccgcgtggccgatgagggcggccgccagctcactgacgccgagatggtcgccctctgctccgattcatgaacggtggaacaagataccacggtgaccttgctggagtggttcgtgggccgactccgtgcaaaacccgacgtccaaaccaaggtctacgaagaagtgaaaagtaatccaagantcaacaactgcaagcaatgcctactgaaggcgttcggnnngggggccnccggtaccaattcncctatannancctattancgcgtcantggcttcgtttaaaactcttacnggnaaactgggttaccaactaacgcctgaanaatcccntngcaactgggtatacaaaagccgacgttgccttcaaaattcnanctatgcaatggaccccttacgggatanccgnggttttggtaccactacgnaattcaagccnagccgccttctttctcttccatccngttccnaacaangggncn

SEQ ID NO: 94977 - DNA, 624 bp, Triticum aestivum
  unsure (1)..(624): unsure at all n locations
  Clone ID: PAT_TA_94977
gaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactgggtggttttgaggctgggtatctccaaggatggccagacccgttgagcacgcctccttgctttcacncttggagttgagcagatatctgctgctgcaacaaattggttgcaacatccctaattccccaaagncccttatnaggnattttcnagggatccctttcnaccctaaaaagggtgggnaaccctnanaagtgncttttnncccactccnggttttnngggggcnaanatttnaangccacnacctttanggggaaaaggccaactttttgaggccttgncaatttaangacccaaaaggccnaaaaaacccgggtttcccctaagggnntanaaaatgggggatggaacgtccgttggcctgtaaaacgggtataaaccggaaggtgtacnttgccatggctnnactaggaatcgttatncaaatnctcnggncttctggnaatcggttaataaatttgta

SEQ ID NO: 94978 - DNA, 590 bp, Triticum aestivum
  unsure (1)..(590): unsure at all n locations
  Clone ID: PAT_TA_94978
ctcgtccccgacctcggccgctcggctcccgatctcgccggctcgccggacgccgtcgcccgtggncgcctgcctctccgccccgccccagccctcccgcccgaccggcgctcggcaccaccgggcccctctggngcccctgcaagccggcgcccgccgcccagtccgctctcccccgactccggcactcggccggcagcaagccancagggcagcnctgcccggcggccagcctttagcccgatttgagtacttganggcggntgtgtgaatggctcaacnttctgtcattcttgcnactgcaagttatgaccacacaatcannattttgggaagccangagtggtcgctgttaccgcactattcagtatccagactcgcangtaaatcgccttnatataatcccngncaaagcgattcctagntgctgctggcaattctcatatnggcttnttgatgtnaactcaanagcnanaaacggtaattannatgnttccatactagtaatgtgatgctgtggggtcattgtatggaactgcantaccaagntcnaggatgaccgtcaaattngattacggacgcagtttcac

SEQ ID NO: 94979 - DNA, 277 bp, Triticum aestivum
  unsure (1)..(277): unsure at all n locations
  Clone ID: PAT_TA_94979
gtcgcgcctctanncgctccgccaccactctacctgctccgatctgacgccgcngccgcctcngcatcggccgcagcangcggngtcgccccccatcccgcccgccaaatccgcggcagcgcgcgcggtgncgccgcagccatgcncagctcgcccaaggtgttctcctcctcggccgccgcagcctcccnccgctcctcgctccgccgcctcctctcctcgcnggacgtctccgcggcctgcctcctcttcggcctcgccgggttcctcgccgccg

SEQ ID NO: 94980 - DNA, 629 bp, Triticum aestivum
  unsure (1)..(629): unsure at all n locations
  Clone ID: PAT_TA_94980
gctggatgagtatgcaagggcaacaagctcttgccatgctttacccctcactgctattatccccgtgtcaagcagtgctctaccatcatctagaatggcctggccctccacaagctcgctcactgtcggcttctgcaggagattatcaaccaaacagagagaacaattctgcccctcggttccatccttggacgccaccaccactccatgattagaggccacatcgagcgtggtcggcgcggtgacgatgcacgcagcgtcatcggggaggagtaggttcgaggcatcgaagcacgggaggacatccccggtcattatgaagatcccaccttggntcttgantgcttgccttgcgctggctgagacgcgangatgtggtcgangagcancgggactggcccgtcggggttgtcccggcaagtaaggaccggnaggaaggctncccatggggtcgccacgggacctctggcgtcgccgcggcgtggncacagactgctcctggcatgaangacacgaggcanaggaccngcgnngagaccggtcctcgggaggaacggtattctccttggngctggaacangttgngcnaggagcangctnacctgtgnncgnccatcgngntcngtcgg

SEQ ID NO: 94981 - DNA, 514 bp, Triticum aestivum
  unsure (1)..(514): unsure at all n locations
  Clone ID: PAT_TA_94981
gtttcctttctcaaagcatctcaacgatgatctcatgttgctagttgtgatgtttttgatggttgtgtggtaggaattcatttatatacaataagaccatatctagccatgtgctatgctttcaagcaaatatcttattgggtatatctatgacttccttttgggatatcttgttccttccgtgttgtaactatttcgggtgtacatccttctttgtagatatatatccgtctacctataaccttatacacttggagagaaatacatctcctagatgatatcctttctttcaagtccaccttgtattccttangtnatttctttgggnggtccgtgaaattttttccttcaaatggatgtctaacncgttgcancttgatgcanctggttggtgaanatattccccaagctggtcttgacaagcatcccttgcctggngagnttgntttccaactcaacaagggtngcanaacatgatcctaattactttaagnaactggggnaccattgaagt

SEQ ID NO: 94982 - DNA, 513 bp, Triticum aestivum
  unsure (1)..(513): unsure at all n locations
  Clone ID: PAT_TA_94982
ctcgtgccgaattcggcacgaggaagcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgagttgaggccgccggcgccaccctcctcgtctccgccaccgccacccacaaaggcgagtccggcggaatggagatggcggccgagaacggcggctgcggctgcacccagtgcaagtgcggcaccagtgcggctgctcctgctgcagtgctagttcatcatcgatcatgcatgcaccgtnccgtngcgtgcatcatcgattgtatcgatctactactaccatacatgttaccgcaacctgattnaaggctttatgttccaactggactgcatcaacatcaagtgccatgccatgattgtaaacagccccctaaataaaactcccttgattaaaaaaaaaaaa

SEQ ID NO: 94983 - DNA, 591 bp, Triticum aestivum
  unsure (1)..(591): unsure at all n locations
  Clone ID: PAT_TA_94983
accaaatcccctcccctcccgcgtcccgacgagcaccagcggccagacatggacgcctcagccaccggagccggagcgaaaggggaagaagggcgcggccgggcgcaaggccggcgggcccaggaagaagtcggtgacgaggtccgtcaaggccgggctccagttccccgtcggccgcatcgggcggtacctcaagaacggccggtacgcgaaagcgcgtccggcacgggcgcccccgtctacctcgcggccgtcctccgatacctggcgcggagctgctggagtcgccgggaacgccgccaaaggacaacaagaatcccgcatcgtgcccaagnactgctgctggcgttaagaacgacaagactcggnangtgctggcggcgtcacatccgaacgcggctnctgccaacatcaaccccttctgtcccaagaaacgngganaangacccaatnccccaaanaaacgccaatcccaaagaaggcgacagaagntnnagacagacacatcattactgtanaataatggttcatgtaattgnctcaagaagaaanatnanaatctcctcattggtaccgtgtaaaaaaaaaaaa

SEQ ID NO: 94984 - DNA, 497 bp, Triticum aestivum
  unsure (1)..(497): unsure at all n locations
  Clone ID: PAT_TA_94984
ctccactccactcaaaaacaaccgcgccagccagccacacagtcccgaccagccagctggtcgcctcactcctcgctcgtgcgcgttgtccggcgagcaacgctcgctacgcgcggcgcgggtcatggcactcctgctgctgcgcggctgcctcgcgccggtcaacgccgccggcccggcgttccggccagcggagacgacgagccggcttagttaccgccggncgtcccggttcggcgcggtcgtcgcctcggccgccgcggcctcgccctccggcggcgacggcgcgaccgccgcggtggacgcggtgctgcgtngctcggaggggtccaaggccaangcgcgcnactacngtgggaccaacggcgncgcttttccngnaccggcaggtcaangaccatcgagacaccgtcgagaggatatcttcgatttccggttcctgntctcntcgcngttncggatngctggnnggctcctcctctgcttctcaatggctg

SEQ ID NO: 94985 - DNA, 632 bp, Triticum aestivum
  unsure (1)..(632): unsure at all n locations
  Clone ID: PAT_TA_94985
cccagatggcatccacctcgccggaacccgcagcgaccgagaccggcgactccgtcaaaatccgccgcctacagatcgccgaccgcgagaggggcttcctacccctcctctcccagctctcctcctgcccggaccttaccgagtccgagttcgccgcgtgcttcgccgacctcgcggccctcggcgacgaccacgtcatcctcgtggccgaggaccccgccgcggctccggagcggcggatcctctccacggggtgcctcttccgtgggagcgcaantcctccgcggcggcggcaaggtggggacgtggagacttgtggtcgacgccgccgcgcgcggccgggggtcggggtccgcgtcgtgcgccgctcgtggagatcgcnaaanggggccggctgctacaagncatcctggaatgcacccgggactgcgcgctactacgccaaatgcgcgtntggaaaaggggttaaaatggcgtgtantcngatcatcaangggtaatcaatggcaatataatcaatctgaaaaatagtatgtatgggtgagtctaactgctgattcaatataaatggncatnanaacaacttgggtaatcttcaaaatnaactttacaggncgnangcgantcaatcc

SEQ ID NO: 94986 - DNA, 643 bp, Triticum aestivum
  unsure (1)..(643): unsure at all n locations
  Clone ID: PAT_TA_94986
ctctgaccgcgtgcctgttgaagaatgagccggcgactcataggcagtggcttggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaatcagcggatgattgtggttaggggtgaaatgccactccgaacccaagagctagctggtctcccccgaaatgcgttnnaggcgcagcattgactgggcatctaagggtaaaanactgtttcngtgcnggctgcgccaacggtaacaaatccaagnaaatctgaatactaaatatgacccaaaaataacaagggtcaaagtccggcaattagacatggggataactcacctcgagaaggaaanacccgtttacaactnaggcctaaagacgncaatgataaaggagtngggtcaaanacaacaagaggtncctaaaacagcacccttaagagncgtataccactatcaacgccttcctaaataacgggctaacatttccaactgtggattcaatcatcganggaacntcccctaaggacacccaacgggtnacaag

SEQ ID NO: 94987 - DNA, 280 bp, Triticum aestivum
  Clone ID: PAT_TA_94987
gtggccgcctatcctcatggacctcctcggcgtctcctacggcctcgacggcggcgacctcgcgcccgcgtcatctgggccggcccctgtggcagtagtaccatggtcggagcttgcggttccgccgtggccgcctatcctcatggacctcctcggcgtctcctacggcctcgacggcggcgacctcgcggccttggcgcgaagacagtaccgccacctcgccttcttgcagctgctcaacgcgctccaaggaaggcgatgccaatgccgacggcgacgc

SEQ ID NO: 94988 - DNA, 494 bp, Triticum aestivum
  unsure (1)..(494): unsure at all n locations
  Clone ID: PAT_TA_94988
attccacgcttcaccaatccaggaggaagcataatatgtggggagctgataccagagaatacaacagtctctgtagcgttggtaccagccagtacgagtccagatttttggactgatgccgatgagtttgtccctgaaagatggtgcaaagaagagagatgtcccgaaaaatatcggaatgacaatagaaaagtgatgcaaccgttcagtattgggaccaagaaattgcataggcaagaacttgggccaattaagagatccgaccaatcctaaccgtaatgctgtggaatttttgacttccgantccaagcaaagatagcataaactgggaaggttcaaaaangtatccgggtttggggaaaaaaaccgttgcatgttaagttggatgtccaagaaagtgtgaaaacagtttatttgtttgcaattactaatccnatttgggtggtccnaggatcgcgaatacttctatccgtnaacctcccaatgggctgcaa

SEQ ID NO: 94989 - DNA, 625 bp, Triticum aestivum
  unsure (1)..(625): unsure at all n locations
  Clone ID: PAT_TA_94989
acagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcangtggtgcacgcccggcaccgtcgcggcatagnnttttggccgccgccgccgctctccggttggactcccccggaacggacaactccgaacgaggcaagggactttcgacctgcccctgaagaaccggttctanctgcagccgctgcaacggcgggaggcggcggtcccggccaaggattcggccaagaatcctcaactccaagcgctcatcnacaagaacaatggcgtactcaagaacactccgcctgaaggctcctactgcgctacgactcaagacgtnattctcaagacacaaggaggaaaaaggcctaaggactacggaaactctngcanctcangggttacatnaccannttaggcccacnggcaaatttangaaacaancttttggattccccaagtngnaatt

SEQ ID NO: 94990 - DNA, 623 bp, Triticum aestivum
  unsure (1)..(623): unsure at all n locations
  Clone ID: PAT_TA_94990
agcatttgcagaatgccctgatgtcacactctcttagttatcatcaacatattggggttcagaaatcaagttatcagttatgtcaagcattggacacaacaaaaccaaaattcagtcatgaaaagaacacctaatcatgaattaccagcttaatacgatgagtcgaaattttgttgttgcacacgcagctacccattttcatagcctgttcttgggttcatgtaaatctgaatctagcaggcacctcccctatgcaagtggctgcatagcttcaagcaatgtgtgggtgcagcttgctcctggagggcatatgaactctccacaaataccttctccgctgggcaccaccatattatagtatctccgccatgatttaacatccatttccttaaagaaactcataacatggtaccgggggctgaccggcctccaagctatgaatggaccatancaaggcgatgacaatgtactcngtccaacccactcgcagttaagaatccgacatacgctcaacactcattgactccnancaaaacggaactgggnnanaatgcggactcggatcgacacctaagtctctaaatgtcacttgnggaactctcncanaattcanaatgnagccg

SEQ ID NO: 94991 - DNA, 602 bp, Triticum aestivum
  unsure (1)..(602): unsure at all n locations
  Clone ID: PAT_TA_94991
ggtggggtctgctgctattccttctcgggatataacatgtccgaggaatccaacttccttcacccaaaattcacacttgctgaacttagcatataactgatgctccctgagcttcttgagaagaaaacacaaatgctccttatgctcctcttcattctttgagtaaaccaatatatcatcaatgaacactatgatgaacttatccaaaaactccataaacaccttgttcatcatgttcatggaatatgtangtgcattagtcaagaccaaatgacataacagtataccatatagcccgtaccttgtgggnaaaagtgtcttaaggtaaaccttctctcgaacctcaactgatggtaccttatcgcatttatcctgggaaatactttaactccttgcaacgggtcaaataatcattgtcatccgnatgggtaattgtcctgatcgtcacttaatcaaccacgatatcaacaacanccttacgttcaacctctatcactagaatacggggncccaangngacnacttggganaaataccttatcaatancctaattgctccnantcccaaaccttggagnncaanacggcctaaatccccggcg

SEQ ID NO: 94992 - DNA, 259 bp, Triticum aestivum
  Clone ID: PAT_TA_94992
aagtaatatggatcggagggagtaatgtagtatatgtcccaggtaatgtagagtgagaagagaaaatgcattctaactgtacagagttttgaggcttgatggaagcaacataaagcatactccgatttcaactctctaacagcaggtcaatgcaccaagtatagcctttttggggcaaacgttactttagacaacatgttactaagaaataagaactctgaaaggtaagcttgcttctgggtgtagctccggggggggg

SEQ ID NO: 94993 - DNA, 629 bp, Triticum aestivum
  unsure (1)..(629): unsure at all n locations
  Clone ID: PAT_TA_94993
ctcgtgccnaattcggcacgagagcaggcancaggaaggaaggaaggaanggangtggagatggngcccatcanactgtacgggatgatgctgtcncccaacgtgacccgcgtggccacgctgctcaacgagctcggcctcgacttcgacttcgncgacntccacctccgcatcggcgcccacaagcagcccgacttcctcaanatcaacccttttggccagatccccngcgctgcangacngagaagaagntgtcttccangtccgcncgccatcaaccgggtacatcgcgaccacattacngggcggccctgctgccgacnccgtccagncaatctngaagcgttactgggangtggaatcccaccactctacccncccggagcngactctggtnttccaactgctcatcaancccanctgggcccccnacnangcggnccacgtggacnagaaccccgcgacttcgcaanttgtcaacttcaacnagccactcnccccgggaaaatactccnggggatcctnaactcgctaaccaanaattctactctnatccacaatcccaaaggggactgnnctcctcccaataagctgtggaagaantccccccnctgggaaactgcncatcc

SEQ ID NO: 94994 - DNA, 626 bp, Triticum aestivum
  unsure (1)..(626): unsure at all n locations
  Clone ID: PAT_TA_94994
gaacgaacgaaaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttccgctgggcaagcagcttgaggatggcaggaccctttgctgactacaacatccagaagganccaccttcaccttgtcctccgccttccgtgggaggcatgcagttttccgtcaagacgtttgactgggcaagacatcaccttnaagtggagtccgtcctggacaccatcgacaactcaaaggcaagattcaagacaagganggatcctccggacaacaacgcctcaacnttncccggcaaacaactggaggatggcgcacctttctgacacaactccanaaggatcaacctgcactttctcgcttagggagnatgcanttnctcanaacccncggaanacaanaactnggnggancccnaacaatnnaaattaggcaattaannnagggggatcncggaaaagccatntttg

SEQ ID NO: 94995 - DNA, 638 bp, Triticum aestivum
  unsure (1)..(638): unsure at all n locations
  Clone ID: PAT_TA_94995
ctgttctggtgtgctggtcctacggggccttagcacgatgacttcccgactgtctactacaacaagttgtgcccgactccggcgagggaggggtgatgatggcggtacgccttcaactcatttcggtgattgtagtcgtcgctagatggtctacggatctggatgtaatttttattatttctaagtgttcgttgtactgccgtgatagaagatgaatagattgaaattttctcgcaaaaaaaatatatgtgcaaacaaacaagagagagacagagatgacaagaagaaaagatgggacaaatgcccccctcctgcaatttnaacgggcacggcaagcaaaacaacgcaaactaaccaccttaaccaccttcttccttacaacggccgtacttttctccccgctnnaacantacgcgattnccntgctccgggtccttgaacgccaacaaanggancccnaacntacggtcaatcgganctggcacaatggggggaanacccgactctcccggggcnaanatnacggttaaanaacaactccgtnttgccatcnctcgaaccccttntgtttcacaaantcaangcaagcacgcanctcactccctagccgacaagtcanncccggaaaaanatttaag

SEQ ID NO: 94996 - DNA, 637 bp, Triticum aestivum
  unsure (1)..(637): unsure at all n locations
  Clone ID: PAT_TA_94996
tgacaaagggaatatattaatatcgcggagataccaattacacctagcctctccaaccacgaaatgtcctaaagacattatggatgcacaaagccaaaaaacaaagaagaagaagaagaagaagaagaagaagaagaaganagaaagaagaagaagaagaagatcccgctacggcgatcaattccttgtacctgcaacatgaaccaccaccgagacaacacccgaagttcaaattctccaaaagcggcgtcaagaaagaaaacagtgcacaaccaccgtcggcgtccgatcataggtcttaggttttcaccctaanaaaaaatccacgctcaaaacaatgccttcaataagacattgtcnagacacaaccaattaaggcagttttgggttcaccttgaaagctaagactctgtcctgtgttgtcgccccaactngcggatgccgctngtacaagtcacgggacacaaacaaattcccacgcctggaagntcgtccgcattactaggctanactcactcctgccgaatccgacaaggggggcccgttcccatnccctatangatcnnttcncgcccacgccnntgtttaaantcctacnggaaacctgggttccaattanncttngaaatcctttcca

SEQ ID NO: 94997 - DNA, 595 bp, Triticum aestivum
  unsure (1)..(595): unsure at all n locations
  Clone ID: PAT_TA_94997
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaanggcaacgccttccaccgcgtggatccccgacttcatgtnccaaggcggcgacttcaccccggggcaacggcaccggcggcgatccatctacggcgagaatttcccgaacgagaattcgtccacaagcacacaagcccgggattctctccatggcaaacgcggggcccaacacaaacgtcccattcttnatctgnaccttccctnnaattggntcnacggaacacttgncttcngcaagnctccaggnatggactcctcaagaacatccaaaagngggtcccgaaacggactgtcaacaagtgtcatcaacaatgggcantctaantcgcngnccggtcccttccctntntccnccct

SEQ ID NO: 94998 - DNA, 159 bp, Triticum aestivum
  unsure (1)..(159): unsure at all n locations
  Clone ID: PAT_TA_94998
ctcgtgccgaattcggcacgaggaaacctcctctagtcagttttaatcctcgcaacgttcgattgtcatatgatggcggagaccaaggcggtggctgctgcggtgccggtggaggcgagtccggtggaggtggagaangactatnnctgtgncatgcca

SEQ ID NO: 94999 - DNA, 598 bp, Triticum aestivum
  unsure (1)..(598): unsure at all n locations
  Clone ID: PAT_TA_94999
gcggcttcgcactgcgggccaattcacttggccatctggagcagatcaaaagctatgcccctggccgtcaggtcagatttggaagtttaaactacacgggtgacatccgcggggacttgatcttcgacggattcgagccactgccgagcgcgccacactgtcacgacgagcatgatctagctctgccgccgaacagtgtcctggaggccgcacccgcatcggcttcgacccttaattcggagccaactgcgctggtcgaggacgggtggttggatgccgcctcggggctgcgatctcaatggcgatcaagccgaacaccaaccccgcactccgcgagactcgtgactccaaaggagccggactcctctccgggactccgaacctccgcgcccctgccaatcgaatccgattgcacgccgatnatggagtttacnacatggacatcttcagcacttgcctttcggcgatantttgaagacactaaatcncctcttataagagagcctggccggactacgtcagcaaggtggacacggncataanaatnaaatcaccacancacttgtncacatcacantaacnantctcnatcaatcga

SEQ ID NO: 95000 - DNA, 583 bp, Triticum aestivum
  unsure (1)..(583): unsure at all n locations
  Clone ID: PAT_TA_95000
atccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacctcccccatgttgaccgccaagattatcaactgattgacataactgatgatggatatgtcagccttctaactgagagtggcaacacnaaggatgacctgaagcttccactgatgatgttctgcntgggcanattaagacgggattnctgatgggaaggactgatcttcgtattccgcatggtgaaaaanaatngcctttaaggaancgtggtggcaaataacnactgtcntgttccactgcnanctgggancaagctttgg

SEQ ID NO: 95001 - DNA, 593 bp, Triticum aestivum
  unsure (1)..(593): unsure at all n locations
  Clone ID: PAT_TA_95001
agaatgctagacctatccggcaataatctcagcggatcggtgccaccttatttattgaaaggttgcggtcaactcattatgttgaacttgaggggaaatcatcttggcggaacatggcctgacgagactagcgaatcatgtcagttgcagctgatagatttacatgggaatcatatccaggggcgcctcccgagatcgttggctcggtgccaatatttgatagctcttgacattggtgggaaccatttcgaggactctttccctatatggatgggccagctaccgcaactccggctactcatcntgagaaacaacaattttcatgggcccgtgagcatcctcctcntgtggagaagaactcnactgcccgattactttcccgtgtacnaacaatgacctncangaaatcactcaaaggtgatctacaacagatttctcaagagtttcaagtccaaggttggggtccgaacaaaacatgcagaatatgatgattatactanntgtctgcgaaacaaggatttattccaactggtggcggtgattggcataaacacataatangggtaaaatcattacgactgtgggatnncttt

SEQ ID NO: 95002 - DNA, 434 bp, Triticum aestivum
  unsure (1)..(434): unsure at all n locations
  Clone ID: PAT_TA_95002
ccactccaggccgtcatccccaacccaccatgaggacgaggatgccgagctcaggcggcggcgctggtccgggcctccgagggatcagaccgtcctccgtcgacctctgcttcctcttcctcaagaccttggccgcctggtgcagggagaccgcagctccgcgctcgtaggcctgcccaatcctcctcttgctcctcgcgctgctcttcctttccccgcccccacccccgcaagtgccgcctcgctgttcccgctcgcggccatctccaacgcctcctcccacgcctacgcccacccctgatgccaccttcttcgatgcgacgtcgtcgacaccgtcgccaacaagtatggctgggacccgtcacggagtccgggtctggccgctcaacacgagggcgcgctcgtcggcgccgttaancggtacaatttcgccg

SEQ ID NO: 95003 - DNA, 608 bp, Triticum aestivum
  unsure (1)..(608): unsure at all n locations
  Clone ID: PAT_TA_95003
ctcgagccttctcttcagatcaccgcccaccacctgcttttctccccctcctccgatccacgttggggcactgtgtggataactgtatatactactccacctcggcgactttgctactgccggcccggccatctccatccaccgtctgctcagctccaatccgctccagcaggccgcctcgccgccactgcatctctctctctctctctctctctctctctctctctctctctctctgagctcggagggcatccttggtgttcttagcggggatggaagcggncttgctggttctggatggactgcaaaatctcncacctcttacttctgcttatttggtgtgcttatccgaaatcatctccacttaaactcgtgttgttgatttttttttcctggattcagtctgggntcacttcgacgcaantatccagtttccctttagtgnggagtnaaggaggcaatcccttttgatngaancgctgctcatggaacngcctttaaaanaaaaaaaaantncgagggggggccgggnancaatnccccnaaagngntctataancgcgtanggncgtccnttaaacgtcgnacgggaaaaccgggtaacaatt

SEQ ID NO: 95004 - DNA, 604 bp, Triticum aestivum
  unsure (1)..(604): unsure at all n locations
  Clone ID: PAT_TA_95004
acacatggccatggccgggctaacaagctcaaccaaccaaccaagaatggcgccgccaccagggaggaatcccagcatgcacacgtaccacctctgcttgtgcttccttctccttgcgtccaccgccaccctctcggccgctgtcaccgcttcctcttactccatcgcctgcccatccctgccccccgccaacgaccgccacaccgacgctgacgacgccctttccctcacccgctccttccagatctccgccggccagttttccggtggcgccgccggcctgtttccccctgaagatgatgatctctacaatgaccgctcgtttgcttttttcccacacggcatctcccgcaccgaagaaccgggctctcctccaactcaacggcacattcacctcaacggtggacgccgcgacaattacagcttcctgcgtccgtctcctcctcctcgacgggactantcctcggcctctctgnagtctgatggtcgggatgggnacgancgcccaaggacggtccctaagcatacccgantcgcctcggctcgggtccgaatctccagctcgcnatnctttgacggatctgangnngtcggctggattccn

SEQ ID NO: 95005 - DNA, 168 bp, Triticum aestivum
  unsure (1)..(168): unsure at all n locations
  Clone ID: PAT_TA_95005
tcnacggccaagctagcccncntcgnatcaaggaaggccggagantgatnagtttgatatggngatnangaacntgacngnggcnacccggtcactggacggtgacatgactgtggactacttcaatgagtgtctcctgcggttcgacgtggatcncnactgccgcat

SEQ ID NO: 95006 - DNA, 490 bp, Triticum aestivum
  unsure (1)..(490): unsure at all n locations
  Clone ID: PAT_TA_95006
gcaagccacactctccagcaccagcaggccggcggcaagcagcgcaagcacagcagcaaatggctaccatcagcgccgccgcggcgaccaccgtcgtcgcccgtgccgccatcgccaggccgcaggccctangtctgccccagctgaggacgangagcgagagggtgaggtgcanctactccaaggacgccaaggaggcgaccccggcggccgccgtccgcggggccggcgcgtccctgctcgccgcggcggnncggtgaccgcgtccgcgnggccggnnctcgctctggtcnncgagcgggtgtcgangncggcancgggctcannctgnggctgnncaacantctgctggggtggnttctccctgggcgtcntcgggctcaactggtcgctctanacgtctanactcnggactccacangacaagagtccggcggctctcgtctaaccatggcnttcgtctctantaaccgnttnaacatcgcaagat

SEQ ID NO: 95007 - DNA, 577 bp, Triticum aestivum
  unsure (1)..(577): unsure at all n locations
  Clone ID: PAT_TA_95007
gttggagtaaaagctctccactacagttccatccataagaaaataacaaacatgcgaatattcaagaacttatggtgtcattccttgctactgatcagaaaaaaatctcacaattatagagtattttcaagcataccaaattatatggttgtgtacattgagaccacataaaccatatatgatggattttttgccatagtgttaagaaatagcatcacagttagaaactattttgaagcataccaaattatataagtttgccggcatctattaggtgtatgttgtcctttcagcgatttaggcatactgtagacacacatagttcgtaggaaaaggaacatgctattgctcatcactgtaagtatgtacgcaagataaatttgcatcatgtagtagtgaataccctaatcatgataagttccctaagcacttcttgttcaagcacatctgctatgaaancttanagttttttatgcacattncagcacagtagcaatgagaatctacgctacactacgcaacccatggcacggtacacgtggcancggcaaaaagtcggggaagggtatggaacacc

SEQ ID NO: 95008 - DNA, 592 bp, Triticum aestivum
  unsure (1)..(592): unsure at all n locations
  Clone ID: PAT_TA_95008
ccccccatccccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaccaagtactactgcaccgtcattgatgctcctgggtcaccgtgacttcatcaagaacatgattactggtacctcccaagctgactgtgctgtgctcatcaatgactccacactggtggttttgangctggtatctccaaggatggcagaccgttagcatgcctccntgcttnaccctggagtgaacaatgatctgctgctgtaaaagatggacgcaacantccaagtctcaaaggccntacaggaatntnaggaatcnctcnacttaaaaagcggtaaacctanaag

SEQ ID NO: 95009 - DNA, 240 bp, Triticum aestivum
  Clone ID: PAT_TA_95009
ctctagttagatccttcgagagcaatgggaggaggcaatgatggtcatgggtacccacccggtggccaggggggataccctccggcagggtacccgccgcagcagggaggttaccctccacagcaaggaggttaccctccacagcaaggatacccgcctgcacctggagcttacccacctgcacctggggcataccctcctgcacctggggcgtaccctcctgcacctggagcgggaggc

SEQ ID NO: 95010 - DNA, 266 bp, Triticum aestivum
  unsure (1)..(266): unsure at all n locations
  Clone ID: PAT_TA_95010
tgancgcaggcggaggcggncgcnacgatgagggcggtggcgatcgcganccccggcgggncggaggcgctgcaggtgcgcnaggtggaggacctcccggngccggnggagggcgangtgctcgtcgnggtggangcngccggcgtnaaccgcgccnacantgtccagcggtaatnncngtacctgccgntctcgggcgcctccacctacccgntncctcgagatgctccgtcaccatcctcnctctcggggacancctnccacgc

SEQ ID NO: 95011 - DNA, 619 bp, Triticum aestivum
  unsure (1)..(619): unsure at all n locations
  Clone ID: PAT_TA_95011
acgacgacgctttgccccattggctcatttgctcggttcgatatgaccagcagtagcacgctcactgttaccaaatcgccgccggcgctcatcccgccggcggggcccactccccgcggcacactctcgctctcctccatcgacaagaccgtcgccggctccggcttcgtgtgccttatccaggtgttttcccctccctcgctctccgccgcccgcagagacctgggcgccgccgcggccgtggccgcaatgcgtgatggattcgcgagggcgcttgtaccgtactacccagtggccggacgaatcgccccaagcggcctcgcggtggattgcaccggcganggcatctgggttcgtggaggccgccgcgagctgcgtgctcgccgacgtggacggctcgagtgctgcccgcttccatcccacagcagctcctcctccgcgcctcccccngggagaactcaaggctatcttcatgtcaaagcgacaggtcactgcgtggttcccgtcggatanctcagnacgcgtgttcaacggaagggcgggnatttcgacggngtcggancaacccggggtaaggacttgtantcgtatggaccaacattaaaacccagcncncngg

SEQ ID NO: 95012 - DNA, 579 bp, Triticum aestivum
  unsure (1)..(579): unsure at all n locations
  Clone ID: PAT_TA_95012
ctcgtgttcagcaagatggtaggaaccatcgatgaagtatgcgcgagttgggccggcccaggcgcgcgggatcaagtgcctcgttttttgttttgatttttttcacattttttgtttttgtttttctttctttttttagttatatttataattccaaaaaatctaaataaatatattaataaaatcactctacgtaaaacatttaaaaaatgtagaccaagcatttgaaaaatgttaaatgcatatagagaatatcgttatcacgtatacgaaaaatgtatataaaaattataatgtgtatcaaacaatttgatcatgtatttaaaaaaatactaaacaagcatttgaaaaaaaaacttgaacaagtgttttaaaaatgttaattaagcatttgaaaaatgttaaatgtgtacaggaaaaagttgaccatgtattaaaaatatggggaatttaacctgtatatggaaatgttaattaagctaagctggggactttacattcagcccttaacccgaaccaataccaaattcccttaaattgaaacgggccaaattgcccttgcgtaagtgannataaaaa

SEQ ID NO: 95013 - DNA, 372 bp, Triticum aestivum
  Clone ID: PAT_TA_95013
ttctgaaagcctcatttcccaagaaaataaaagctctcaaaccctcaaatatcagcacaaccagatatacccatggcattcttgggtagtagtagagctgccggccgtctcatggtgctcctccagatggctctcttcgtcatcgtctcggcgctcatcatgaacagctccttgtgccttgcagcggccggccaggatgacattgcaggctctgggtctcggtgtatcggacagaaatgctctgggggaactcattgctgccgtggtgtaccactggttggtgaccgaccctaattagcaatagattagaggtgggcgtgcggcaagccatgtgacacatgtctttctttccgtatgaataaatggttgaat

SEQ ID NO: 95014 - DNA, 584 bp, Triticum aestivum
  unsure (1)..(584): unsure at all n locations
  Clone ID: PAT_TA_95014
gagggcatcccaccagaccagcagcgcctcatctttgctggtaagcagcttgaggacggtcgcaccctcgctgactacaacatccagaaggagtccaccctccacctggtgctccgcctcaggggtggtatgcagatctttgtcaagaccctcaccggcaagaccatcaccttggaggtcgagtcttcggacaccattgacaacgtcaaggcgaagatccaggacaaggagggcatccccccggaccagcagcgcctcatctttgccggcaagcagcttgaggacggccgcaccctcgctgactacaacatccagaaggagtccaccctccacctggtgctccgcctgcgtggtggcatgcagatcttcgtgaagaccctcaacggcaagaccatcacgctcgaggtcaatctcagacaccaatgacaatgtgaaggcgaagtcaagacaaggagggtatccaccggacaacancgtctancttgcngtaacaactnaggatggccgcacctggcggctacaantcagaaggatcanctcaactgggctcctccaaggtggatcaatnttggaaaaccncacgg

SEQ ID NO: 95015 - DNA, 189 bp, Triticum aestivum
  unsure (1)..(189): unsure at all n locations
  Clone ID: PAT_TA_95015
gaancnctggtcgtgaccgtggctgccttcgtaggnatctccgtacccngcctcctcgtcgccttcctctgccgccaccgcaagaaccgcctcctcnagccggaccancgctgctcgtcntcnncgtccctcncaatctncnccccggtcgggatatcgtcgganntctcctcgtcgtggtctctgtac

SEQ ID NO: 95016 - DNA, 408 bp, Triticum aestivum
  unsure (1)..(408): unsure at all n locations
  Clone ID: PAT_TA_95016
gaccaagcaaccagagaagccgtagcaagttcctgcgagagaggaaagaaatcgaagagggagagatatagtgagtgacacacacagagatgggaagaagaagaagcctggcgccgctgctgctgatctttggcgtcctcgccgtcgtgctcgcggctcttgcgcccgtcgccgaatccagcagcagccaccaccaccaccacggccatggccatcactcccgtgtccaaagcagagggacggnaggagagggggaagcaatcgtcctcggcggcggcggcggcgaangcgagggggagcgcgtggccgtgctgcgacagctgcggcgggttgcaccaagtcggacacnccgcantgccggtgcatggacccggcccggggggnttncaacccgggtttccnggaatg

SEQ ID NO: 95017 - DNA, 617 bp, Triticum aestivum
  unsure (1)..(617): unsure at all n locations
  Clone ID: PAT_TA_95017
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactgggacaatgtggaagctgcctatgttcggatgcaccgacgccaccaagtgatacgaaggtggaggaagtcaaagaaggagtacctgacgcctaagtccgcatcatcggattcgacaacatgctcaagtgnattcgtcagctcatcgcctcaaancaacgggctgcaaagatccggnaaggctaaacagtcntcacnaaggcatatataaatgcattcatttgtaaancgaattgcttggtttcttc

SEQ ID NO: 95018 - DNA, 183 bp, Triticum aestivum
  Clone ID: PAT_TA_95018
ctcgtgccgaattcggcacgagacaacatataattcccatagaaataagagagtgcctagagcacgattacatgaaaaattctgcagtcgatttcaaccaactgttggatccaaatcctcagttgcgatttggcatatttgcattttgcctcaactttagcacagccgttgaattaaaccttg

SEQ ID NO: 95019 - DNA, 572 bp, Triticum aestivum
  unsure (1)..(572): unsure at all n locations
  Clone ID: PAT_TA_95019
gacgaagctcctggctttgatggtttttccgctgagttttaccataaatattttttgaactacaaattaacattttacacgtgaacgcttcaaatacttttctgagaaaccatatcataaaattctaaatatacatcgttgcatgattcacaaataaggtcctattatttataacatattcattcatgcatagaatagactagggcaccctccattcgtgaacacacatgaggtagattttcaccttattcaccttggatcgaaccaactggagcgcaaaaaaagaaaccgtcattcataagaaacgcagcattattcacctgggatncggacgaactcaacggcaagatatgcacgttgtacaacccgggtacgtccgtaccaataatcaantcaacnattgccgnagggctgaggcgtacacngngcatgtgcatgtgcaactggncattccggcanaagccggcgggtgcccccctgaccatgctcagaacgtcgcctccccgccgtggctncaggaaaggaccagaacccggacgtnnatgcncaacggcaaaactgcggggtcgcgc

SEQ ID NO: 95020 - DNA, 650 bp, Triticum aestivum
  unsure (1)..(650): unsure at all n locations
  Clone ID: PAT_TA_95020
ttcaaaacagaaagtatttacctatagaatgttctaataatatgttgaagtcatttaaataaatatgatcatttccctttttggtttcaatcaacagacagtatatagcgatagtcgtagtcaacaacttggcaccgttgggccgcagaataatgcgatggtagtgtatggatgcatcaatatgtttttgtttgcttttagagaaattaatcatctcttgccattcattacagagcaaggaaaactttctctatgacatgggagatgcaaccatcaaacaaacgtccttctaaggataagaacanagatactctatccatgatgaacatgtgcaacaagagaagnaaacactagtgcagataaggttaagtgcacccgtacctttaaactcctaaagcttctttcaacnagcactctgctctcctgctccaaagaaatttatgcacatttccaagcgaatactcaaggctagaaatgaatctgacataaataacaanttcaaggtgagtanaaatactnagatacgaactaagagataaattgagttagttcacaagtngaaaacncgcacattcaattaccttcgtgaaaagtgcagacctgtcanaaaagcatntaaacgcggtaattgnaaaaanatgtacnngngg

SEQ ID NO: 95021 - DNA, 484 bp, Triticum aestivum
  unsure (1)..(484): unsure at all n locations
  Clone ID: PAT_TA_95021
gcggcgcatcctccacggcgtgctcgagccagcgggcgaggccgaagtcccccagcctggcgttgtactcggaatcaagcatgacgttgctggtcttgacgtcccggtggatgatctgtgtgtcgagctgctcgtgcaggtagagcagcgcggcggcgaggccggcgacgatgcgccgacgccggtcccagccgagcgcgggagctcccggggcagccgaggccggcgcgaagagtaagcggtcgangctgcngtttgggcattagtccgtncacgagcagcaantcctcctcgtcccgggacgcaacaaccncnggagcccacaagtttccgtgccgcaanccgggcaacngcggcanctncggcaaggaacnntntccaagcggtccnanccgacctgggaacgcattnaacggcaacgtggtgcatcacttgggaacaagggnggtaaaccgcccgaatccccgctnacgaggatcttgat

SEQ ID NO: 95022 - DNA, 605 bp, Triticum aestivum
  unsure (1)..(605): unsure at all n locations
  Clone ID: PAT_TA_95022
ggccattctcatttcccatcccacaagcttttcaaggcaatgcaaataacatggtgttggctagttggaatttatagaagaagttgcaactaaaagcgaagcacagggaacagaacggctagaattttagctattacgctgccgatagttgctgcaatactggctgctgttgtaatttgcctttatcatggaggaggaagagcaaaccgggcgcgaaaggcatcactatcatatccaactaatccagaggacatacagagtatcgattcaccattctcgatctatcaactcctacgagccgcaacggataacttggtgaaaaggataaacttnggtgaaggaggttttgggtgggtttataaaggaatccttcctgacaatggaagaatacagtaaaagtctcacaaantctcnccaagggatanaggaccaaaataactgtttggtgctaactcacncanattnatgaatctggggttncttggggaanagaaatactgcttgataatccaacaaagcttgnacatcctttgatctganngncatcactnatngggacagattaggaancaagggatgccagnttaanactcatanatccactn

SEQ ID NO: 95023 - DNA, 496 bp, Triticum aestivum
  unsure (1)..(496): unsure at all n locations
  Clone ID: PAT_TA_95023
agcacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagttgcggcaccaagctgcggtgctcctgctgcagctgctaatcattgatcatcgatcatgcatgcaccgcgcgttgcacatcgatcatatcgatnctactactacaataccatgtaaccgctacctgtnnnagggcttatctaaggcacctngactgcatcaacatcaggggcaangccangctngttgtaaaaaggccccntaataaatcncctggtttaactttcaaaaacac

SEQ ID NO: 95024 - DNA, 197 bp, Triticum aestivum
  unsure (1)..(197): unsure at all n locations
  Clone ID: PAT_TA_95024
ngaacaacagtgnaacgaanaagtactctgcttttggntcaaganctcaanaanacanatcgggcaatcgatggctacgttcgtnacgtcgtcgncggtggtgatggggtcggatcgccccggncngaggacangggctcggttngngcatggtggcgcatgcgtccgtnatnatgggagcaccganggcgngtggc

SEQ ID NO: 95025 - DNA, 568 bp, Triticum aestivum
  unsure (1)..(568): unsure at all n locations
  Clone ID: PAT_TA_95025
ccaacctcgaccccaccaccacgtcctcgccaccacgccggagcaagccagcatgtccctgctgctccgttcggagttcgccggaaccagtggctgcgcctcggcctctccttgtccccgtcatcctcgccggtgtgcaccgcccgaggctcatcggggcaccaccaccaacgggcgttccccgccatggcgcctcggcctcctctgcttcacctgtcgcgccgccattgccagtcgtcgaccccacaaccttgaactcctgtgccgaagcaccacctcgagcgtctccttccttgaggaggagctcgacctgctgccggggacctcgccctccaangacctaaacaaccaagccgtgccctccttcccctccttcccgctgctctctctctctctgaaaatccctggctcccatccctgcaagtgtgggcgtcgacgcatggcgccgtgccctcgttgttnacaaaggtgggtcctgatctgggtngctccgctgtgggtcaaaangccgcgtccaagctttgaagcgcgcntnatctcccgagtnctgctngcatggcatcccgcg

SEQ ID NO: 95026 - DNA, 620 bp, Triticum aestivum
  unsure (1)..(620): unsure at all n locations
  Clone ID: PAT_TA_95026
gctctacctcggcccgctctccggcgaccccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccgcaacggcgtcaagttcggcgaggccgtctggttcaaggccggctcccagatcttcaagcgagggcggcctcgactacctcggcaaccccagcctggtgcacgcgcagagcatcctcgccatctgggcctgccangtggtgctcatgggcgccgtggagggctaacgcgtcgccggggggccgctgggcgagatngtggacccgctctaacccggcggcagcttcaacccccggggctcccgaagacccgaggcctcccngagctcaagtgaaggagatnaaaaacggcggctcgcatgtttcangttcggntcttctgcaagcancgcaacggnanggccctcaaaactcccncaatcgcgaccgtnaaaaaacctggctngcacaaatttcccggaannancctagtaattaggngnattatgg

SEQ ID NO: 95027 - DNA, 574 bp, Triticum aestivum
  unsure (1)..(574): unsure at all n locations
  Clone ID: PAT_TA_95027
gagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaatactgatcggttcatgccgggcatgatatttccgcctaaaataaaataaaagctcaagcgagatgagcagcgtcatcngtgcctatcgtgtgtgtgtggcaacaatgcttatacaatatgtctccctcgtcgcntgtttctctcncgagaaaaattggtgttgctgttgtcagctatccggatacctccgtgataacacttaagattgtcgtgntgcaataantagtccctgtcaccaaaaaaaaa

SEQ ID NO: 95028 - DNA, 647 bp, Triticum aestivum
  unsure (1)..(647): unsure at all n locations
  Clone ID: PAT_TA_95028
ctagtctcgagttttttttttttatctatcttgctctgtcctctcccccctttgtgccctccgtcctgccaaagcggcagaaagccgcggctgttcttgattctcgcggggggctgcgccggtcttggcggcctggacgtgaaggaggcgcggcgcggcgggggcgttcgatgggcacggtgaaggcgtgggtggcgggcaagtacgcggagccaatggggccgatgcacgactcgctgcgcgtcgcctacgtggtcttctccttctgcgccgccttcttgctcggcggaatcaaagcgatggtggtcgagccggtggcggcggcgctgatatactggggaactgggcgtgattctccgtgtcttcccggggcaagtctggtgggacatctactcgctcatcaagacggacgcatcaacgcgggcctgaactggcgtggcatcncgctccggtgctgttcnggtctggtcggctgggatctncggancgcctgntggcctggcaacgttctnangcgtggtttcaacttcagggttcggaagaaacangcaanattctgaangaatgggnngaattgggacataaggaactcngggtaggaattnggnattgttcaaccaacgttatagagcccagggcaaacnacc

SEQ ID NO: 95029 - DNA, 656 bp, Triticum aestivum
  unsure (1)..(656): unsure at all n locations
  Clone ID: PAT_TA_95029
ctcgtgccgaattcggcacgagattggttcgtcagtggctagaagaacaaaacgttgggaatataactgttgaaaatgattggttcgtggtggaaagtactgtcagaggagtcgaaaggcttctacacacaaacttcgaagtttatgagaatacactgacaggaaagtctgtattacggacactatcttacagccttcctcgctctctcaagagctcatatcgacatcattgcacctacaatcaaatctctacaccaaggggcttacagatncacgctggtgggactggcctgcngnaagaaatacatgaaaatactgctcccttgatggtgggtgctgctgctgcnttgaattcaaccaatancccttgaaaggttcaaaaaactctaaaacctccgcaatttcaaggttnaaatagannaataancatttgccccaaccggtttcccgaaagatacctcaacacgatgacttaaccnttcctaacacgtaagaaccggatcttcggaatgatttcacggtctggnaataaggtcaacacacaacagacaacagcaatcntgatatggtgagctatcaacantatacctttcngcaancacacactagtatccanagggcacgccaactnaataccaggtgacacttacttatnt

SEQ ID NO: 95030 - DNA, 606 bp, Triticum aestivum
  unsure (1)..(606): unsure at all n locations
  Clone ID: PAT_TA_95030
cagtggtggtgctgctggtgccgcgctcgtgctgtgggactgcggcagcgcgctctacgactcgtacgagctcaccgccttcaagcgccagctcgacgccgccgtgctcgccggccgctcgctctcaatgccgcacctccccgccgccagcccggccgttcagccagccggccgcaggaagcgcgcgaggcggctccccgccctgctccggaggctcttctccaaggtgctgcggctggcgtcngcgcgcggggcgagacacgaccgctaccgggcgtacgagggtacggcacggcggtacagcggaacgggttcccgttgtccgggggctgacttcatcccggaggaagacggcggaaccggaagcgggtctcccccgtcctccccggccaaccctcgcaagngnatcngacngttaatcggaanaagacggacccgatgggattcagtctcttgtattgtaccctantgatgatatantacttngtacaaacatcaaacttaannactgntatnanatatcactcatantctcgtcgcgtaaaattttnntaaaattaagngaacatattngcatgaaaaattggcgtttttaaaaaaaaaaaa

SEQ ID NO: 95031 - DNA, 531 bp, Triticum aestivum
  unsure (1)..(531): unsure at all n locations
  Clone ID: PAT_TA_95031
tcccctccatgccattgccagcacacactagccgaccccagagcaacgccatggccgcagcgagcttcctcttcctaaccatccttgctgcagccaccaccacccccaccgccaaagcgactggaatatccaagtccaacggaagctgcatcccggccgagagggccgcactactctccttcaaggccgacatcacaggcgacccggacaatcgcctcgtctcatggcagcaaggacgacacgactgctgccagtggagcggcgtcacctgcagcgccggacaggcacatcctcaagtcgactccgcaatatttccattcccaacaagtgaaantccctgggtgtccatggtacttngaagacatccctactnggacatctctccggcgcggttgtctcatcaagtccggtgaggactccttaatggtgatacagtacgnctcncngttgggacccttgtccntngggnggtctgccatgtcatgggcgggccgangtctggctgaaggatctgcggaggcgcaggtgccc

SEQ ID NO: 95032 - DNA, 635 bp, Triticum aestivum
  unsure (1)..(635): unsure at all n locations
  Clone ID: PAT_TA_95032
cgaagccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagcactgcactacaagggcagtccgttccaccgcgtgatcccgacttcatgtgccagggcggcgacttcaccaaagggcaacggcaccggcggcganccatctacggcgagaantcgccgaacgagaanttcgtccacaagcacaccaanccgggattctctccaatggcaaagcgggcccaacacaaacgtcccattcttcatctgancntccctgcaatggtcgacgnaanactgncttcgcgagnctcaaggatggactctcaagacnnaaaagngggtcccaacggactgtcaanaatntatgcgatgggcaattaanngtcgccccggcccttntctcccnntcctgcgccttaaaaaaaaccgntccggcgctncctncctccaaaattccggnggn

SEQ ID NO: 95033 - DNA, 352 bp, Triticum aestivum
  unsure (1)..(352): unsure at all n locations
  Clone ID: PAT_TA_95033
atctgaatcgctaaagctcccacctttcgcccactccccctccaccaccgccggcaagaagagcaggggagcacgcggggatctcgagccgagctccctccctcccatggccaccagggtcctcgacacgctcgccgtcgccgcggagggcggcgggggcggcgccgcgctgccgctcaccttcttcgacgtgccctggattttcaccgggcccgtgggagcgcgtcttcttctaccctacccgcaccgcccgaagaatttcgggcgcctcctgcgcgctccttgctccttttcgccgcgctggnantttaacnctttgggngcttcngcctgcccggacggngggganaat

SEQ ID NO: 95034 - DNA, 564 bp, Triticum aestivum
  unsure (1)..(564): unsure at all n locations
  Clone ID: PAT_TA_95034
tttttttttttcactcccgttgcaacgcacgggcttgtttgctagtataacttaatatcatacagtctagcccacacgtacgctcgaatggattttaattaactattattacgtgtatactactccaccaccttccccgatctcgttatgatcgatggccggccgtgtagcagcgaggaacgaattaagaacatgacggtgtcgccttcgacgtcgttgagccacccgaattgtccatgtagggtttggcgtgttggccggcgggtatcctcgacgcatccgcccacgcgcccttgtcngcagtcgcccttcactcccacatgcactgttgcacttnaacccggancgaaggcacaatgnnacctgtccctctctgaactccccttggctccaagtncgacanactncaaaagcnctcnccactgttccccaccggngcacgtanccgtgccggncaactngcctngtcaacccaaggtccggctnacggctggtaacgcgtnccgccgggtgcagcanaatggncacccgacttaaagtgatctcggncncgctttccgcggc

SEQ ID NO: 95035 - DNA, 573 bp, Triticum aestivum
  unsure (1)..(573): unsure at all n locations
  Clone ID: PAT_TA_95035
accaggcccgggcgactgtttaccaaaaacacaggtctccgcaaagtcgtaagaccatgtatgggggctgacgcctgcccagtgccggaaggtcaaggaagttggtgaactgatgacagggaagccggcgaccgaagccccggtgaacggcggccgtaacaataacggtcctaaggtagcgaattccttggtccggtaattccgacccgcacgaaagcgtacgatctgggactgtctccggagagaggtccngtgaaataaatgtctgtgaagatncgnctactgcacctggacaaaaaacctatnactttatgttcccggaatgnttttgctttcctgccacttagtggaagngaaaaagcccttccggggggccnacatcaatgaatacatctggaaaactcggttcaacttgttnaaaccncggcaaggaatccagtaaattcatgggctagctccaaagtaacgagctcaagntctcgcaacgaaatgtcccatcaagcaaaggacttangaaancacntcacaaacaatcgcttagttcantccattaggctcccacgaaatncccag

SEQ ID NO: 95036 - DNA, 618 bp, Triticum aestivum
  unsure (1)..(618): unsure at all n locations
  Clone ID: PAT_TA_95036
ttttttttttttttttttttttttggtatggcaatacattggaattattcaaacagacacatacaaagtcacccttacaacccatgcgcgcccgtcagccgcagcgcatccgacgagccttgttcactccgctccatcacaagcgctgtacaaatcagcaccacacacccactgcggattataagttctacttacaagttacaactaacaacaactgttcgctaccaaataaccgggtacgtaattacggacagcgaaacggacgatgggacagcgcacgcgcgcccgctgattcagagcgcagatttgatcatggcggggaacatgtcngggacgtcgacgggcgggcgcagcagcttgcccatctcctccacgaacttgtccatggcggggccaagcangcacatggggatnacgatgcctcctccccttgccgttcttgaaagggatcaggaactggcaaccccggaangcgccaagccgcctcgccggccgccgtaacgggctgcccaccgaagncangncccaaccggctggcantcgatcagtcncnnaacacgtgaatgcgcgcccggtgacatagtcgcncgacgattncagtcactcgactggccctac

SEQ ID NO: 95037 - DNA, 640 bp, Triticum aestivum
  unsure (1)..(640): unsure at all n locations
  Clone ID: PAT_TA_95037
ctcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcnagcatggcattcagcctgatggccagatgcccggtgacaagaccgttnggggaggtgatgatgctttcaacaccttcttcaagcgagactgggtgctgggaagcatgtcccccgtgctgtctttgtagatttccgagcccactgtgattgatgangtgaggactgggtgcttaccgccagtcttccancctgagcagttatcaantggcaaggatgatgcagcccaacaattcgcccgtgnncattacaccaatgggaangaatgttgatctgtccttgaccgtatcaagaantttcaananactcacgggctcaaggatcctgtntcancgctattgagnggaatggtctggctnggtcgntctccggaacgctctctttataangnnagatcaactgggtcacgtgnccantccagttcactctgtgtngcataacangtctgcacataacctanaatantcttctttaa

SEQ ID NO: 95038 - DNA, 370 bp, Triticum aestivum
  unsure (1)..(370): unsure at all n locations
  Clone ID: PAT_TA_95038
ctcgngnngaattcggnacnacaggggaaccncttggntcaacctcttgnacttcttggcgttctccttcttgttcttcctcttacttttcctccctaccattagttgctttggatgggatttgggagganaanganttgggcactccgtgtgcncttgncantgnatttggngcatcgtttgagttctccacgtganacctcgaagttacaagttganaaccntantactcntgggtgcttgtntgcccttgagcttgttcatcttggntgcttgggcncccaacaccgttngagntgttcccgagntcaatnactgtggtgtnaagcnccgggcanncatcaangtctcnaaatacgtngtagagatg

SEQ ID NO: 95039 - DNA, 561 bp, Triticum aestivum
  unsure (1)..(561): unsure at all n locations
  Clone ID: PAT_TA_95039
agcagctgcagcagccccgtcgatctactccgcgctcctctcccccccagacccggccgctcctcgccgccatggcgcctcgcgtgccctcctccctcctcctcgtcggcgccgcgctgctcctggggcctggcggccggcgcggcgcgggcgtcaacgaaggagggggaacgcgctgtacgcgctgcggatgcggctgtcggaccccaacggcgtgctccanagtgggattccaacctcggtcaacccctgcactgggttcacgtcacctgcganaccgccagccgcttcgtgcgcctggatttaaggaactccaagtctccgggtcaatcggccccgaactcaagcgccttgttnaacttcaanaacctggannttttcaagganaacttcaacggganatttccaaaanaatttngcaactgaaaattngataacttggttngtatgccaataactaacgggaaanccccaaatcgctttcaaantaaancgcttaaatcatgcgtttgaaaaaanaaatnctggttaatncacggangnggcaaatctcaacctaaa

SEQ ID NO: 95040 - DNA, 357 bp, Triticum aestivum
  unsure (1)..(357): unsure at all n locations
  Clone ID: PAT_TA_95040
ctcgcgtcgccctcccgagggctactcgagggttcccttccccggccgccgccaccccccttctcggccctcccctcctcgccgtcgccggaggcggtcgccgggctccccgcgcggccgctgatgaagggcggcggcggggttctctgccgctctgccgctgcgcagggggctagggtcggggcggcggtcctggtggtgcgggcggcgctccccggcggcggcggcntcccttggggcggttggggccgcttctgcctgncntttttggccggcgggncggcgntganttttaaccnttgggggncggttccccgtttccggttccccgaaatntaaaaaacnccntttgggccc

SEQ ID NO: 95041 - DNA, 613 bp, Triticum aestivum
  unsure (1)..(613): unsure at all n locations
  Clone ID: PAT_TA_95041
gatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctgggcgaactgaaacatcttaagtagccaagaggaaaanaagccaaaagcgatcccgttagtaacggcgagcgaaatggggagcagcctaaaccgtttaaaacgggtttnttgggaanaacaatacaagcgtttgtgctgcctagcgaagccgttngattccccaccctaagatngttaaancccaatttacccnaaanatcaataactttacctctngacccccagtaccaangggacgttgaaccccttttaacaacaangncaactttcaangntaanaccccggggntaccnntaccaattttacntttnggaaanggtaaaanaccccatggtantgnaataaactttaacctnnttaaccccaacattggaagggaaantattcnacncntcctttaaaaanaccgggaaccaagcantggttgttaggaaggaccangnncttcaagnattttaaaggatt

SEQ ID NO: 95042 - DNA, 177 bp, Triticum aestivum
  Clone ID: PAT_TA_95042
ctctgaacttcttggtttccatggctcccaaattcgccaagggcaagggggtggctaaagtcgtcgggacggtgaagccgccggagagcgcgctgtccggggaccggacgaagtccgccttcttcttcccctcgacgcttgatgttcaaagagtccgggctccttcaacccctatgg

SEQ ID NO: 95043 - DNA, 377 bp, Triticum aestivum
  unsure (1)..(377): unsure at all n locations
  Clone ID: PAT_TA_95043
ccccctctccgctccgcctcgcagctccccccagatccaaaacccaagcgcgtgcccgcccccggaatccaaaccctagcagcgccgcctgcgatgaggggcctccgggcggacgccggcggcggcggcgcatcctcctcctccgtcggcctccaccgcagagagtcgcgcttcgactcggggcagtatccttcttcggcaaggcgccgcttgagggggttggagcttcggcgggagcctggcggattacgggggggcttgaacggggggnattgccgcgngggtttcggttggcannattaanggtttcttaaaaattttccccgnggggaaaaaatttatttgaatattantttccnnaattanaatttgcacaa

SEQ ID NO: 95044 - DNA, 483 bp, Triticum aestivum
  unsure (1)..(483): unsure at all n locations
  Clone ID: PAT_TA_95044
aagatccagaagttcctgagccagcctttccacgttgccgaagttttcactggtgctccagggaagtatgtggatcttaaggagggtgttcaaagtttccagggtgttttggacggcaagtacgacgacatctccgagcacgcgttctacatggttggaggcatcgacgaaatcatcgccaaggcagagaagatcnccagcgagaacgcttgatgacgaggtgttgccaccgccctgtacaattaattttttgggatttcaactgttcgcccnaacttgctcaacaagcaggagttgccactcctgctnagnatccttgtttttgttcctttttacccaatttacccgttaataaacaactgcagtgacattggttaatcggcacaacaacaacactaccctgggctggnaaaattttncctttttaagcaanttccgacattnataatggttaaattaatgttgttggnnaaaaaaaaaaaa

SEQ ID NO: 95045 - DNA, 550 bp, Triticum aestivum
  unsure (1)..(550): unsure at all n locations
  Clone ID: PAT_TA_95045
gagaaaagtaaaagggttaattaatagaggtaattaggcccctaatctaatctgggccggccccaatcgcacgctcacacactgagcgcacgggcgcgttggccatggacggggccataggcgcggccggccggcggtagctgcggcttgcgggagctggtggggtgtttgccggggcggccggcgcttaagacagcggcggaggccggcggctcaaccacgaagaggcaagcgccgcggcaancgcatgggagtcaacggcagcaactaagaacatgggctccggcttaagcgancggccgggatttcacnggatgcaaaagcccggcnaggcnacaaccggcgaaggcccccgggcggccaagccaagcaacaacggacaacgcaagncaattgcaacaccgtnttcccggcggaacgganaaattaagnaacnccccggcggtttcccggccccgcaanttangcggaacangggccgttagacgncggtcccgcaagcaacagantcgacttcaaccaacttacactcacataggcanacctagga

SEQ ID NO: 95046 - DNA, 524 bp, Triticum aestivum
  unsure (1)..(524): unsure at all n locations
  Clone ID: PAT_TA_95046
tatcaaataacagtttcactgggataattcctacttcttttcgaaatctttcaagtctgactattctaaaccttgagtataaccagcttgaaacaagggacaacagagactgggaattcttaaatgcattgacaaattgtcgatccctaaagaaactatcactctcttacaatcagctccagggacctattccccagtccgttggtaatctatcccccagccttggagancttcggctgactgggaaacaactgtctgggacaantacccccaagagcatcaagaaaacttaatgccttaaccaacttngcactaagcgaaaactattaaantggtaagatccnaaggatgggtttggaaacctaactcccttcaaatttactaaatctcaaanccaaacacttnaacggcccaacccatccggttaacgnatttacatgtgtaattgtaacttggntacaactcattatatatatatgtgataagcaccctaaaaggtgtgcaantcccccaaaaaaaaaaaa

SEQ ID NO: 95047 - DNA, 453 bp, Triticum aestivum
  unsure (1)..(453): unsure at all n locations
  Clone ID: PAT_TA_95047
gaaccccaccgccacccccggcccagccaacacacacaccacaccttcttaacaacaaacacacaccagagctcacacccaacgacgacactcccctgctcccttcctttcgcctctgaaaaactttgaaacgagagaagaagatggacaccatcaccgtctccnaagaatgtgttcggggagttngagcgcaaggtgcagaaagagtactgggaggagactccaaggactcaccgtggatccatgatctcgatcccgcgccaagactcgaacaagagggagaggcagaggtctggcatcctgccgtcctacgcgggaagacggtctggagttcngcgcccgattcgcgcttcaacggcactngcaaggaggccgcacgttatccgttgattcatcgacgcgtcttcaagaaaacagagtttatgggaatctacaagaatacttcatgtgngg

SEQ ID NO: 95048 - DNA, 357 bp, Triticum aestivum
  unsure (1)..(357): unsure at all n locations
  Clone ID: PAT_TA_95048
aactagtctcgagtttttttttttttttttttttttcaggcaaattaagcaanctccgttggntgcatcancatattaaacttatgcaacctctgacncantacaaagcgaaaganttaacataaagtacacatgcatgtaggcacatggagtaaaantcacaaaaaatacaaatgcgttacaccanccatgtacncacgctatctacgtgcccatggtatacacatacacgaagctagctccatccagtantacctcagttcctccgggaacagactcgctcgtacacggacacccgttacaaacacttagatcatggtnctacatactttgacngggttacaatctcgtgccaat

SEQ ID NO: 95049 - DNA, 419 bp, Triticum aestivum
  unsure (1)..(419): unsure at all n locations
  Clone ID: PAT_TA_95049
ggatgctggacaagctgtgggacgacgtggtggccgggcctcgcccggagacgggcctcgacaagctccgccgggccgccgccacccaacccctcgccatcaacacagctgcaggggaggcgattaagcagtcgccgtcgatgccgacgaccccgaccacgccgggtgacgccgtcgtccgtccaacgccgccgcgcggcggancgttttngcggagcgttttcaaccccggggagcaacttggcaacaaagagcttcgggcaacttctttgaacgccgganccaattccccaactttannaaggtttttaaagaccagaacagnanagggcaccancgttatnaaactttggaaaaattaagaaggtccaantttntaacccatttcgcctttnnggaacaaccgttctaattctttc

SEQ ID NO: 95050 - DNA, 196 bp, Triticum aestivum
  Clone ID: PAT_TA_95050
gagagctagctgtgaaaagctctattctgtataggatgaaacgaggtctgtgtcagtgcagtggcaccaaactgttttttactctgtttttctcttctttttctgatgatcaattggaactttcatatatgtatacaatgtaaatatccagtgtggaaatgccaaggaaatcttgggtttcaaaaaaaaggggggg

SEQ ID NO: 95051 - DNA, 374 bp, Triticum aestivum
  unsure (1)..(374): unsure at all n locations
  Clone ID: PAT_TA_95051
agcagcagcagctccgtcgatctcctccgccctcctccccccgcgcccggcctctcctcgccgccatggcgccccgcgtgccctcctccctcctcctcgtcggcgccgccctgctcctgggcctggcggccggcgcggcgcgggctcancgaaggagggggaaacgcgctgtacgcgctgcggatgcggctgtccggaccccaacggcgtgctccaagagctgggattccacctccgtcaaccctgcacctggttccactcacctggcgacagcgccancgcgtctccgctggattaagnaatccaactctccggtccatcgccccgantcaaccgcctttgtgaatcttcaataaccgggactgttnaaggaa

SEQ ID NO: 95052 - DNA, 247 bp, Triticum aestivum
  unsure (1)..(247): unsure at all n locations
  Clone ID: PAT_TA_95052
ttccggttcgggttcgggttctggttcggttcnggtccgagagtagctagcctagtctagggtttccgtagagaggaagaggagaggaagagananatccatggcnganactgagtaccgctgnttcntgggcggtctcgcctgggccaccgangacatcaanctccagcagggnnttcanctattacggcgagatcctcgacgcnaagatcanaanacgantgctaaacagttgangtccccactg

SEQ ID NO: 95053 - DNA, 410 bp, Triticum aestivum
  unsure (1)..(410): unsure at all n locations
  Clone ID: PAT_TA_95053
ccacactctccagcaccagcaggccggcggcaagcagcgcaagcacaacaaccaaatggccaccatcagcgccgccgcggcgaccaccgtcgtcgcccgtgccgccatcgccaggccgcaggccctaggtctgccccagtgaggacganngagcgaagagggtgaggtgcagctactccaaggacgccaaggaggcgacccctgccgccgccgtccgcggngctggcgcgtccctactcgccgncggngggcgcngttacgcgtccgcnggggccggcgctgggctngtcgaacaacggntttcaaactggnggnaaccggctnnancctggggctnnacaacaactgctgggtggattctcctggngtctttnggctcaatctgggcgntctaaacgtctaaactccgg

SEQ ID NO: 95054 - DNA, 596 bp, Triticum aestivum
  unsure (1)..(596): unsure at all n locations
  Clone ID: PAT_TA_95054
gttgcaggtgctaagtattcgaatcagtaacgagatacggactgaagtcaagatactaactaaagagctcaaagagaagttatggagtgaacttgcctccttgctgagcaacgcatgcactctccaatcactcaatctggaaagctgggagtatggtgaatctccatcacctagcagtctggatttctgaatgactctccccgacatccgccactgctccaataccttaatctttgtggcagcattaaccattgcccaaatggnccccgtcactcacatacctcacaantttgaagtgggatttacagactttnacggggacaattattttgtgccttgtgtangttgcccaacctgcaaacgtncaactgctgcaattgggtgcaaagacggaattaattcaatgccgtggaaaaattcccngngctnagacctnaaagnggaaaantccaacatgccaatcccantagntnaatnacaaactcaaaacatttgtaaggtttcttcctccganggaaataaatagggtgtccgttaaaaactgngaactaaaagcaagctcntgtagaaggaactgcaatgactgatgncancaa

SEQ ID NO: 95055 - DNA, 524 bp, Triticum aestivum
  unsure (1)..(524): unsure at all n locations
  Clone ID: PAT_TA_95055
ctgggccaacaagttactcaaatgtggaaaagggttacaatgttagccaccaaaaccagttgttgtcaaatattcatcagcagggatccagtcttcagtcaagctttactgcagtcaaggacagtgccgacgaaacaattgtcaaaccgaagacgtctgactctgtgttcagtgttaatcactcttctgaagaacaggaagatgacgagggagaccaaaatgaggaataccttctgccacaaatagcaacccagctgaagatggatataactgggagaaaatatggacagaagcaattaaagagcaattgagcatcccaagggagctatttacaagtgcacacaccccgattgccctgtccaagaaaaaggtgggacgctcctccaagatggccagattacaagagatatctacaaagagtctcanancacctttgccgcctccaaaacgccgtcaagtaccctttgtcncaatcaatgataacaatccagttccaananaacctgttcgcanaaaggtcaaca

SEQ ID NO: 95056 - DNA, 570 bp, Triticum aestivum
  unsure (1)..(570): unsure at all n locations
  Clone ID: PAT_TA_95056
acacatcctcctctacccgtgtaatcccgttcctccgctgatcaccaaaacggggcacggggtacggggtactgctacgggagtcgggggcggacgtcgaccgtggggatggtagagatggcggccagcgagatgcaacaggccaaccggcgaggctgatggtggtccacggcggcgctgtccgccatgattttgctgtaaattgagggacantggtgccgccgcccatggaattttgctacgtcaatttttggctgggaanaactttnatttttgctggaacnaacctttaattttgctgcaaaggaanaattttttgccaaannaatttttttggccggaaaattttaattttgccnggacaaccttngntttgctcaaaggaggtttttgcaaacaaattttggcggaacncttaaatttcnggaacanattgtttgcgcaaaanatnttgganacaattttgcgggacatcgatttgctgacaatatgattctcatagcaaaatgtctgggcggaaaaanaactgacacagtttttnaacagcaacaactgaccggaatttattng

SEQ ID NO: 95057 - DNA, 516 bp, Triticum aestivum
  unsure (1)..(516): unsure at all n locations
  Clone ID: PAT_TA_95057
ccacaccagagcgccagagcgcggcaccggcatggccatggccccggccaccagcccccgccacctcctcctcctcctgttcctctggctctgcgcggccgccagcacggcctgggcgcatggaggcggcggggacgccgactccggagacgcggacggcggcggcgaggcgaagccggacctgcgggcgcgggggctggtggcgacgaagctgtggtgcctggcgctggtgttcgcgggcacgctggcggggggcgtgtcgccctacttcatgcggtgggaacgaggcgttcctgggcgctgggcaccattcnccggcggggtcttcctcaacaccgccatgatnattcctcaacgacccaacgaacttccggggactcctccccaacagcganacccttcgcctnnatctcgcctgcgccggtactcctcaacatgctcgccaatgcgcaactctcctncgtcnccgcggcgaacgngccngccgccgcgcgcccngnaanaaccaaggaactg

SEQ ID NO: 95058 - DNA, 347 bp, Triticum aestivum
  unsure (1)..(347): unsure at all n locations
  Clone ID: PAT_TA_95058
gccgattaggtgaagcgagattcggaccacttttactttgacttccttttcgcgccatgatttcactcaagatggggtggattctcagtttaggcaatgcatcacagcagttcacacggaaggagtagcatgtctttccgttttcccttgggtcaaaccctacctggcggcgtcagagtccgcgggaganggccggcgcgcatcggggacgggcaggcgcggggccgncaaacgggggaaagggggcggcgtccaaaaggagccggggggnaccgggcctccgcnggaacaacaactccggttggcgctggaaagcccggattccnccggggaaaggcggctccggg

SEQ ID NO: 95059 - DNA, 634 bp, Triticum aestivum
  unsure (1)..(634): unsure at all n locations
  Clone ID: PAT_TA_95059
ctatagttgataggtgtcatggtctacctctagcaattgttaccattggtggcatgttgtcttcaagacaacgattagacatttggaatcaaaaatacaatcagcttcgaagcgagttgtcaaacaatgatcatgtccgagcaattttaaacctgagctaccatgaccttccagacgacctcaaaaactgttttttatactgcagtctattccctgaagactatcacatgtcacgtgaaaccttggtgcggctgtgggttgccgaaggcttggtgggtaagaaaagaaaagaacacaccagagatgggtagcttgagggaaactccatggatttgatccaaccgcaatagcttgaagttgttagagaatgatgacttngtaaagtaacacctggtaagatcatgatatgtgccgtgaacnactagtccgttgctaaagaagaaaattgctcagcanatgattacccacaatgatatgggacaacaagataaggantcngcctccgncataagtggatggaaagcggacgcaatgaaagtaactcanactcaacagtacggnacttgncaactcaccnccgngnagtacctcatttgcanatcacacctgcgtctncgaaancnaacactaggca

SEQ ID NO: 95060 - DNA, 480 bp, Triticum aestivum
  unsure (1)..(480): unsure at all n locations
  Clone ID: PAT_TA_95060
atacagtgcagcctggtgccatctgccatggcggccacgacggcgagtctggcgggtttggcgacggtggcccagctggctttgtacgtccacgggctggtcacgaagatcaccggggcggcggagactgcccggcagaacaagctggagtgcaagaatctcgcgagccgcgtatccgtgatcggcgacctgctgctgcagctgcaggaccggcgggtggcgcaaccgctggccgggctgggcacacntccaggaagcgacattnntcgtccttgcaaagttggacgccgccgaantctttacccgacacaaccgagaagttaaggaatccaacgcaggtttatccaactancctcaccctttgtnaacatactccattancgccgctcnacaanctntctcccnacccaacaanttcttctacaattacnccanatggtttttgtttgcttcgggnaactgaaggggggngntgggagt

SEQ ID NO: 95061 - DNA, 607 bp, Triticum aestivum
  unsure (1)..(607): unsure at all n locations
  Clone ID: PAT_TA_95061
ccgcgtccctccaccactgaccccccgcttaatgccgcgcccgtagtctccgaaacctctcccccccttcttcctcgacgccaccctccccggcccttctctcctcccccgtcaccgccaccaccgcggccgccactccgccctcaaatcccacctcagccgccgctcgcaacccccacccgcgcgtaaatccgccccagatcggcgccgggggagccgtttgatgggcgatctgtgagccgcgacgaaacgcagagcgagctacacacagctcgcagtcgcgccatgggaggaggcccgagatgcgcgctcctgctgctcgtggccgccgcggncgccgcgcttgtccccgcggcgtgggcgcaggacccgaccgcgccggcgcctcgggggccccttcgtggcgcgggacaaatctgctcgatgcggcgcaacgggaanggaacacacgacngcgggattgctgcnanccgtcaagtangcgcgccgaactcgctccgccgacccggggngnagacctcntccgaagtgcctactcacgngcggttcgngggccttactatcctccgtcggccggngaattctcgctganaantanacgngaaga

SEQ ID NO: 95062 - DNA, 641 bp, Triticum aestivum
  unsure (1)..(641): unsure at all n locations
  Clone ID: PAT_TA_95062
ctcgtgccgaattcggcacgaggaagtactctgcttttggctcaagaactcaagaacagagatcggagaatcgatggctatgttcgcgacgtcgacggcggcagtgttgggatcggctcgcccagggcgggcggccgagcctcgatggtgcgtggtggcgcgggcgtcctcgacgatggcggcgccggcagcggtggccattgggaggacgcactacgaggtgctcggggtgggcgtgggagccagcaggggggagatcaaggcggcgtaccggcgtctggccagggaggtgcatccggacgctgctggtggtgggggcgacgaggggtcatcccggctgcacgccgcctacgccacgctcgttgacccgaacgagcgcgctcgctacgaccgggacttgcttggcgcgccgcggggatnatacgnnggggncggcccccggttgggcctccttcccggggangacttggaanacgacaattctgtaagactacnactggaaanaggctgcctcggccccaaccgcgcgcccggtnactangatcaagcacgcctgaaaaagctccgatgtctacataagattgccgctaattggtatcaacangaacnttanacagaggtttaaatcttcnccgganaaa

SEQ ID NO: 95063 - DNA, 436 bp, Triticum aestivum
  unsure (1)..(436): unsure at all n locations
  Clone ID: PAT_TA_95063
ggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctagtaccatgtaacgctacctgatcgagggtccttgtatgtatgtaagcacctgccaacaatgagcagagcaagtgcatcccaatgcaagttaaaccgaccctaaataaanctcccgtgggttaacctataaaaaaaaaaaa

SEQ ID NO: 95064 - DNA, 632 bp, Triticum aestivum
  unsure (1)..(632): unsure at all n locations
  Clone ID: PAT_TA_95064
acagacagttagcaatgacgttcggaggaatctttggcttgcccggctacatcctgttcggggacaaggagcaggagcgaaagctgcggaagcgaaagaaaaagctgcagcgagagcgtaagctgaggctccgacaggagcgaaaactgcggcagcgagagcaggagctgcagtggttgctgctacggcaacaacccagcaagctgcggggcacgcaggggttctctagtgagtcactggcagtcgctcgttcgagcaactcagttgcagtccctcgtgggtacgagcgacagggggcgcatgggttctctagtgactcactgggcgctcgctcactcgagcaactcactgggcaatcctcgtggtcatgggtacgggcaacttggggggcaagggcaaggggttctctagtgactcactggcagtcgctcgctttggcaatcatcggcatcctcgtggtacggccacaggatcacttagtttccctaanggnagcctcatggtattaggaggaggactcaaggctccgacatgattaaatgacatnatnctcnaanaaacacaggacaaatatagtaagaagggggaannggnaccccgttatcncnacccaaaaaaagggaagntccccn

SEQ ID NO: 95065 - DNA, 544 bp, Triticum aestivum
  unsure (1)..(544): unsure at all n locations
  Clone ID: PAT_TA_95065
gcaagtccgacgccgctggctccgccatggccgtcgtcgcgttgtgggagtgggagtgcgggctgctgtgcgccgtcccgaaggacaggtggtcctccacgtgccagttgctcgccctcgggctcagctccgtcatggccgacggcgccggcgagcacctgccgccgtggtggtactcgacggaggagaactgcctgtcgccgcccttcgccccgccgcgccgcgctggctgctcgccgctgtccatctcgacgatcttcacattctcctcgctcgaacggtccatctcctgcatgttccaaaccaaatcgagancgaggcgaaagactcgggctccaagggtcctcccctcgatncaaatngaacgccgccgcgcgttaggngaangaagtgcggggggttttctcaaaaaaaaatncactcgganctacaagcnggcccgccgtanatacacgtcaataccgttanacttattanacttttgtaagtaancccanatngtatgaattaaatacaaattggacaaatnctcaaaaaaaaaaaa

SEQ ID NO: 95066 - DNA, 570 bp, Triticum aestivum
  unsure (1)..(570): unsure at all n locations
  Clone ID: PAT_TA_95066
gcaaacatggacctgagatccggttcccgtttcggctttcgatcgacccaccatcgtgtggcgcaccaggcatgcagctgtcatgctccgggcatgacaccatcctggatcaccatgttcttgggtcttgcagagtgacagcgatctattacaggcaccgtgtcatcaacgtcatcccgcttgtggaatcatcgatggaatgcccacttcagaagctcatctcaacaaatttagaaactgatgtgtacaaacaacctcaatcatcagaagttacgaccctgggtacgttgttcaactgatttcataccaagcggatccatacagaatagctggcccagcttcttgtatcaagtaacaacgctacccaattctggtatttggcatcaatttctgcatccattactgatcttccatggaactgtgtggcattagtaaatcanccaataccttaactatgatgacaagggcctaacagagaaccgncacctcaaagaaaanaaaggatcctcaaatttggggnnaactcanttggaccatncattcgatnctgcaaaattnanataagncacc

SEQ ID NO: 95067 - DNA, 577 bp, Triticum aestivum
  unsure (1)..(577): unsure at all n locations
  Clone ID: PAT_TA_95067
tccatagacatcagtgtgttcacatgctcatcaggagcttcccctggaaagaaagcaacacaaaccaagttagtaaatggaaacatagtccaaaaagggaaactaggaaaaaaaggttatatacacttgagcctaaagctcgaagaccgaatagtatatgtaggttaaaagatgccataaataaatatgtgcaaacaatgagattgaacagtgtgaaatcccatttctgtttgatattgaaaaaaaaaggaagctaagagtccgaaggaagatacttagtgttgaattttgacaatggatctttcaggttaacgtttcgtttagagctttttttgtcatacaatagctacttagtggatggcctttcccaaacaagctagacttccaaaatgtggttgttaagtgttaacacatatgttcaattttgtctaatacatgttgctggctaatggattcaaactagagtctacagcatggtacagaagattcaattaaggtcacangctgaaggaatnacacaantcaataaactatcnnaccggaacaaggaccatctgggtcaaaggacanttgacaa

SEQ ID NO: 95068 - DNA, 266 bp, Triticum aestivum
  Clone ID: PAT_TA_95068
gtgagtgttttaaatgcgtgcgcagagatcggggcgctcgctctcgggaggagggtgcatgtgtttgcgtccaaggttgggttagtagggaacagacatgttggtaatgcgctgattgatctgtatgccaagtgcggcggagttgaggatgcaaggaaggtgtttgaggagatgggggtgggaaggaccgtggtctcatggacgtcactgatcgtgggtttggcagggaatgggtttgggaaggatgcgcttgagctgttcggcgt

SEQ ID NO: 95069 - DNA, 515 bp, Triticum aestivum
  unsure (1)..(515): unsure at all n locations
  Clone ID: PAT_TA_95069
ttttttttttcgcatcaatttaaattgctacttgctgcagctagtttcacgaaggaaagaagatggaaaaataatacaaagtttctatcctataaccataagaaaactcggttgtaaatgaaagatagcgactacagaagctgatccaagctttcatcctcacatgtgaatgatctatgctaaaccattttgaggtgatagattcggagcccgctgctgactgaaggttgatgatattactgggcattcatcctcctgaagcacatatccttcctttcaacacttctcaaaaaaggcaaaatccaatacgaccacatgaacacgaatagaaggtgaagagaatttacatccnaatgttagctgggtccaaggcaggactgtnccccccataagtaaggtggcggaccaaattttgggaaggaatttncgtnnccacccctnaacttgataccaancggcataacaaacatttccngggacaatgaacaaggnntcccggtttccaatcnaanacc

SEQ ID NO: 95070 - DNA, 483 bp, Triticum aestivum
  unsure (1)..(483): unsure at all n locations
  Clone ID: PAT_TA_95070
gtctcgagttttttttttttttttttttttttttatatagctgatagcgagagcttcacttgagttgaaaaatatattaacatacattttttcacaaattatgcttttcgacaaattacatagctatagcaacaagggctcacacattgtaggaaacatattggaagcattaattgctacactcatggatacacacacactccaagataattgggtcgatctgcagcagctgcaactgcaagttagtactacgcccttgtcgcctcacgcttactaggtgagcaanccgatgccggccgacaccaaggactccgcgacgacaagtttggccgcctcccgacgggtgcacccgttcaaatacacgtagctgctggcgttccccgnaatcccggcgccctccccggtcaaaaaagtacacctcgtcccggcttccccgtccgggaanactcctcctggnctccgcnaaccctncgcggcggctcn

SEQ ID NO: 95071 - DNA, 508 bp, Triticum aestivum
  unsure (1)..(508): unsure at all n locations
  Clone ID: PAT_TA_95071
cgtccacctgctgtgcacgctccttgaccttctctgggacctcaacagtccatgagtagtaccttctctcaaacgactcgctgagccccaccatcttgaaaagactgccgagctggtgaccggtcgaatccatctctccggtgcgaaactgcaacatgttgtgctgtcccatggtgcctgaccatctccttgagttccgtgtaattatcgcctttccaggccaagaccggcggagagatccaagtctctgacgaagccagtgccaccttccactgcacaagagctgcatgccgaagccaattacatcgtgtagcacacaagaaggnaaacacccagcttgattcaagtgcacctacaagggattttgtctccaagaacaangnaacaaccaacaaggtgtattgacgacacatcggctggctgtcacatccttgcgctnactgggacaacacaaganagcngtatggcaaaaagngacacggaaggatcaatancaaacaagagtggt

SEQ ID NO: 95072 - DNA, 458 bp, Triticum aestivum
  unsure (1)..(458): unsure at all n locations
  Clone ID: PAT_TA_95072
gtttttttttttttttttttttttttttttttttttttgaccaaaacataaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacangaaattggttcagcagtccctccctgtagtaggcgaacaccacccggcacancaagcaagctccccgcaaacaaagacgaaggccttganctgctaagaaatactttggtggaaaccaacatcctcctggaaanacnaagncaccccttnaacttggaaaaagtctgaagtacntcaagtgananaaaacgctcttgtaa

SEQ ID NO: 95073 - DNA, 473 bp, Triticum aestivum
  unsure (1)..(473): unsure at all n locations
  Clone ID: PAT_TA_95073
atcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttggacaagctgaaggccgagcgtgagaggggtatcaccattggatattgccctgtggaattccgagaccaccaaantactaactgcaccgtcattgatctcctggtcaaccgttacttcaatcaaagaacatgattacnggtactccccaagctgactgtgctgtgccancattgancccacactgnggttttttaggcnggnacccccaaggatggcaancccgttaacatccccccttgcttcaaccctgggggtgaaccaaatnatttgccgccgttacaaaatggacccacatcccaatttccaaaggccn

SEQ ID NO: 95074 - DNA, 483 bp, Triticum aestivum
  unsure (1)..(483): unsure at all n locations
  Clone ID: PAT_TA_95074
tatggtcagatagcgattttctttttccattccaaagtcagtagtatcccaatcaggccaggccttccttatataatcaagtaatcttctccagaactaggatatcaattcccttgtgggagtaatcaagcatctgcaaaactgtcatggcgaagcctggtgtgtatcattgttctatttccctgcaagctctgactgttttctctgtgctttcagttcttgtggtagatgtccagggaggagacaggtgccaaggtttctcttgtgggcatctccgtgactccggtatcctttccgactcnaggtacccatctgggtgtggtgttnaagaatacaactggttgtggnantncaaggctgcaatttnatcaatacgggaanatacnagtgactggaatcgacaatcaattaaccttctgggtcgtggacccaactttaagccaanagaaatgcccctcctcggnggaacaatttcttattaaa

SEQ ID NO: 95075 - DNA, 488 bp, Triticum aestivum
  unsure (1)..(488): unsure at all n locations
  Clone ID: PAT_TA_95075
gcctcctcctctccgctccttctccttccttcgagtttcagccatgggtaaggagaagactcacatcaacatcgtggtcattggccatgtcgactctggcaagtcgaccaccactggccatctgatctacaagcttggaggtattgacaagcgtgtgatcgagaggttcgagaaggaagccgctgagatgaacaagaggtctttcaagtacgcctgggtgcttgacaagctgaaggccgagcgtgagaggggtatcaccattgatattgccctgtggaattcgagaccaccaaagtactaactgcaccgtcattgatgccctggtcaccgtgacttcaacaaagaacatgattacnggtactcccaaagctgactgtgctgtgctcatcaatngacccaacactggtggtttttaagntgggaactccaaggatggcaaacctttanangcctccttgcttcancctggatgaacaaatatntgcttc

SEQ ID NO: 95076 - DNA, 467 bp, Triticum aestivum
  unsure (1)..(467): unsure at all n locations
  Clone ID: PAT_TA_95076
cgagtttttttttttttttttgggagaaaactggtaattcttgtatgagtctgtaacagttggcttcttatgttccaaaatgtaattatttggttgttattagcaaattattttacgatgattcacggtatggtagcaaggtgcactatcttactgtattacaaactcctgcatatggttttggcacatgcaaggatgcaattgcaatcttccttccatggtaatgctgacctgtcatttaaatcttccgtgttattaacattttcctaagcctacttgattttccaagtggttgaaacaattacacatcacttggtgccaagcgtttcccaaccancacatcnagacaactgctncancaagccccaacttnacaccccnacaatngcccncaagntgncctgggagtattccaagcctgggngcaacgggactgcnaatggnagcaacagtttattttgggctgg

SEQ ID NO: 95077 - DNA, 471 bp, Triticum aestivum
  unsure (1)..(471): unsure at all n locations
  Clone ID: PAT_TA_95077
ggcattgaattagtgttgacgctacttgctatacctctgataactacctatcgttgaagcagcaaagtaaagttaatcaatcgacatcgccttaatgcgtttttccgacatttcagtgccagctactgtcttcctgattctcaatcaagcctatgctcaaacttcaacagattgcaacccgttgcagaaaacttgtccgccaaacccaggtcttggaaccagtgtcttcactgattttaccaagggcaaaagcgattactggcagccacttcaagggactactanganatatgatggccccaatggngcacaatcactatccaagaatccagtgatgcgcctacaatgtcactcacnanattancatgtttgggncatattgacatgatagcanaagtantccangnactgggattgcaanatttngtaccctancaaaatcncnanaaattgacgggaaggcgggtgcan

SEQ ID NO: 95078 - DNA, 325 bp, Triticum aestivum
  unsure (1)..(325): unsure at all n locations
  Clone ID: PAT_TA_95078
gccaactgcccccaaacagtcggctccggtgacggcagcctggcgaacctggacacgacgactcccaacgcgttcgacaacgcctactacaccaacctcatgtcacagagggggctcctgcactcggaccaggtgctgttcaacaacgacaccactgacaacactgtccggaacttcgcttccgaacccagcggcgttcagcaacgccttcacgacggcaataatcaanaatgggcacaatcgcccngaanaacgggaaccanggcaattttaggctaaatngcccanagggtaaanccanaatttacanacaatttttnggcca

SEQ ID NO: 95079 - DNA, 160 bp, Triticum aestivum
  unsure (1)..(160): unsure at all n locations
  Clone ID: PAT_TA_95079
acgccgagaattggccgtgatgctctctccacagatctatggcgaccttgacgtanttgtactgatccantaccacatggccggagctgagtanctgatgatngangctgatttgcttttgctttncnatgatatnttgagggagaaggattttgcacca

SEQ ID NO: 95080 - DNA, 378 bp, Triticum aestivum
  unsure (1)..(378): unsure at all n locations
  Clone ID: PAT_TA_95080
ctcgcccgcagcatcgccatcctcgctctcatatgctctgcattggcatgctccgtggcggcacaagttgctcagggcggaagccgtgagccaggtcgtcctccgtcgccacagttcccgtcgccaaggcggcccgggcaggcaccgctcactccaccgccgccgtcaacgctgaggaagacgagggcgtttacaccgcaccggaagacagtacaggttgctggtggctactctgaattgaagatgatgtcgacgtgttattcttccgtgtatcaatgtgtgcccctnatgttatccaataagcctggactatttttttactcctaantnctttggactaccttacaacttnaatnaataataaagtttcctcccggg

SEQ ID NO: 95081 - DNA, 194 bp, Triticum aestivum
  unsure (1)..(194): unsure at all n locations
  Clone ID: PAT_TA_95081
accaccgagcttggagcgccaccgccatggccatggccacgcaagcctcggnggcgacgcgccacctcatcaccgcggcctggtcgccctccgccaagccccgccccgccaccctcgccatgccatcctccgcccncgggtccngccncgctctgcgccgcggncnccggtcancctgcccccgncgcgccgcc

SEQ ID NO: 95082 - DNA, 564 bp, Triticum aestivum
  unsure (1)..(564): unsure at all n locations
  Clone ID: PAT_TA_95082
cgccattctcgtcgtcggctccggcgcaccgcctgatatcacgccagctcgatcgccgctttcttctacgtgccgcgaccgtctatggtcacgccgctgccccgcttccgcgcccgcgcgttccgcggcgcggcgcgtggcgctccggccgagataccgctcgctatcaggcggacgtggcagcagccgatgttggtccgccgccgccgagtccggagcctgccgttaccgacccacttcctgtgccccgatatcgctcgacatgatgcgggacccgtnacgggcccacgggattaactacaaccggaaacctngaagggttgcttgaaccccgcangcaagtgcccctnaacggcngcgcttcgctggagagtcctactacatcacagaggggatcaagaattggcgtccnacngaacgggtaaaacnctgccaaccctttccattcncttcanctccgancctncgcttcgctccccaaggcgnatgccaagtccgaacnnngaagcagggncgaagaacaccaacccgtctcttcgcaagcgccgggttctantatgattt

SEQ ID NO: 95083 - DNA, 573 bp, Triticum aestivum
  unsure (1)..(573): unsure at all n locations
  Clone ID: PAT_TA_95083
tttttttttttttttttagtaaaaaaaactagtatgttcattggcctttaatttgcagtatgtaactaattcatttacatatttgcattttgctaatcgaacgcacaagagatctttaaaaaacgactcttgccctgtatagagctcccgcgtccacacacccaatatgggccaattctgaccggccagcccaagacaatcggcggatcttctctccagccgtccagcgagcgccgctccatgacctttttgccgatnngaccggccatgnccccggagggaacnncttatccgccctttcctaaacaanannggcggtcccaaattctccttccggantgcccgcccggcccngcgnccgccnatannaaccccccgganggagtgatttnccggggctancaaacgcccntcnagatttggaactngntagcncantnaaccngcaaccttttgccgcanttcgaggtcnagggattnccgggaaacccgtacgctnttnactgtggccgggcnaccgaaccntanntccctngcactccgggcgcacttcgcccccacagagcagccaac

SEQ ID NO: 95084 - DNA, 638 bp, Triticum aestivum
  unsure (1)..(638): unsure at all n locations
  Clone ID: PAT_TA_95084
ccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtgggacacatcgtcatcaaggcccgtccctgcaaggttgtttgaggctccacctccaaagactggggaagcatggtcacgcaaagttgtcacttttgttgccattggacatctttaaatgggaaaagaacttngaggatatcntccttcatccccacaactgtgaactcccccatgtttgaccgcccaagattatcaactggattggacataactggatgatggtatgttnacctttctcnactggagagtnggnacactnaggatgacctggacttcccaactgatgagttccgcttgngcanatttaaacgggtttngcngaaggnaagaccgatcctgnccgtgatncccgcangggtgaagaacatntgcncttttaaggaccgggggnggaattacacttcntggtgccnactgcanatgggncaaagctcggggttgngaaaatcatagganaaattcgtggtgaaaat

SEQ ID NO: 95085 - DNA, 457 bp, Triticum aestivum
  unsure (1)..(457): unsure at all n locations
  Clone ID: PAT_TA_95085
gatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctgggcgaactgaaacatcttaagtagccaagaggaaaagaaagcaaaagcgatcccgttataacggcgagccgaaatggggagcagcctaaacccgtngaaaacggtttntgggaaaaacatacaagctttgtgctgcttagcgaaccgttgattcccancctaaatgctnaanccaattncccgaanatcactanttacctctgacccnatnacaanggnacgttgaaccntttngatcacnaagcaactttnaaggtanaccctgggttcccattcgattttacnnttaggaaagggaaaaaacccccat

SEQ ID NO: 95086 - DNA, 477 bp, Triticum aestivum
  unsure (1)..(477): unsure at all n locations
  Clone ID: PAT_TA_95086
aaaagatacgcttacgcacaagtgaaaagaatgacgagatcttttgctaaaaagctaggtcaaggtgggtttggtgctgtttacagaggcgacctctctgatggtcgtcagatagcagtcaagatgctaaaggacttcaagactgatggcgaaggatttcatcaatgagttagctagcattaagtagaactctcatgtcaacgttgttactcctcttaaggatttgcttgggaaggaaccaaaagggcactaatttatgactatatgcctaatggtcacttngaaaggtatgctttttaaaagatggtcccnaaggtgggaaatactttaaggtttgggaanaatttatttngaaatancaatnggaattgcncccangacttgnatacctgcacaaanggatgcaanacccncattgngcattttggatacaaaccccaaaaatctntgggccaanntcngtcaaaatttncattt

SEQ ID NO: 95087 - DNA, 326 bp, Triticum aestivum
  unsure (1)..(326): unsure at all n locations
  Clone ID: PAT_TA_95087
caccaccaccggagggagcgagctccaagccatggccgccaagtgctacccgacggtcagcgacgagtacctggcggcggtcgccaaggccaagcgcaagctccgcggcttcatcgccgagaagaactgcgcgcccctcatgctccgcctcgcgtggcactcggccgggacttcgacttggcaacaaaaccggnggcccttncgnaacatgaagtgcccngcnggnctcgcgcaacggggccaacgccggcttcaaaatcccgntaaaggtggcnccaaccantcaagggaattcccaacttccccnaagccaatttttaanaatc

SEQ ID NO: 95088 - DNA, 621 bp, Triticum aestivum
  unsure (1)..(621): unsure at all n locations
  Clone ID: PAT_TA_95088
cgcgtcgctccctccccaggggcgacacgggcggcgaccaagcagccaaggcctccggccgccccaccccatccactccctcgccgtcgccggcgcctcccgggggcaaagctcgcgtgagccaaggcggcggcggggctagttttctccgcgacgggcggcgcctcacgagcggggatctctggacggcgcggcngagggcggcgggtggcgcagnggtgggcggaggacggcggttggcggcgcgtctggggctccggtgggcagcggctttgccggcctgcgctggtggcggacgtgcggcgccggctgctgctcncttttggggaacgattcgcccggatttggcttccctgcggcggctgcgccttgctngccggcgatggancgctggggcngcagcccangactggtggttcgtcntgcactcctcacggangttgtccngnggnacctgcgaggcgtggttcggggcctncgccggatctgtgtgagcgggcgtcncctgtggangctgtccggaaaggccgctgtccgtntctgggtttcnggaagtnctgggtaaggcacgntntcncctcttcnggcngcgggctnatgtccttcnagaagtgnctntgt

SEQ ID NO: 95089 - DNA, 531 bp, Triticum aestivum
  unsure (1)..(531): unsure at all n locations
  Clone ID: PAT_TA_95089
gaacagagcggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccaagaccctcatcatgggcgttgccccctccaagggcaccccgtccgttccgaggccgccgccgagaacggagggttgcaagtgcggcccaactgcacctgcaaccccttgcaacttcaagtgattccaatgaaggctcnatcaaatcaagttnaanggagatggnatggatgggcctgatgaagnacnaatantaattatgcataanccaacctnnttcnttttnaattccccccaaaataaccganttaacnttcnatccncccnnttaanggatacggnccccttgggtttncntttctgtnaggcccctgcctnaatccctttcaaacttnaaatcccccaggggttannaaaatttgggtncaaaaaaaaa

SEQ ID NO: 95090 - DNA, 204 bp, Triticum aestivum
  unsure (1)..(204): unsure at all n locations
  Clone ID: PAT_TA_95090
tgcggtcccccnangctgcaggctcgtnccganttcggcacgancggaaggncacanctcagnaactgaccctgtaataccttacctagctaggtgtggtttgtttgtttgagccaggatgttggcggtgttnagcggngaggtggtggaggtgccggtggagctggtggcgnccggagagccggacnccgtcgccnaagacgc

SEQ ID NO: 95091 - DNA, 594 bp, Triticum aestivum
  unsure (1)..(594): unsure at all n locations
  Clone ID: PAT_TA_95091
ctagtctcgagttttttttttttttcctattttagagttttgcagaaaaggaataccaagcagagtccaaacagaatgaaaccttcgcgatgatctttcttggactgaaagcaaaccagaagacttgtagagtaaggcggagatgcaacgaggaagccatgaggcaggagggcgcgccccccaccctccgtgggtcctcccgtggtcccctgacctattccttcacctatatatacccttataccctggaaaacattccaggagagtacgaaacacttttccaccgctgcaaccttatgtacccgtnagagcatcctaaggccttttcttggngcccctgccccgagggnantccatttaatggagggttttaaanaaaaccaataccnnccccgaanaatttgagtactttccaaaaacttcngggttaaaattntaacnaaaggtctccccttccttgnntcccaaaaaaattnccccggtttttggggaaaatcnngngaaattttgncgggtttcccaanccngaattgggtttgntaaatttccngggaaattggtccccaatncaangaaatttnacttgntncccca

SEQ ID NO: 95092 - DNA, 245 bp, Triticum aestivum
  unsure (1)..(245): unsure at all n locations
  Clone ID: PAT_TA_95092
ggcatagctctctctctctctcgctccatctctctccaccacacaacggtggtggcttggtggaggcggaccggcgacagaaagggaggccgcaaattgggaaggggaaggcggcggcaacgccctcccctccgctccatccancgggaggggcggtggaggtggtccgacggcttgggttttgcancgggnaccctcccctangccaantntggnaggaaggaaggtggcggcgccgcaatccg

SEQ ID NO: 95093 - DNA, 311 bp, Triticum aestivum
  unsure (1)..(311): unsure at all n locations
  Clone ID: PAT_TA_95093
cgcctcgccaccgattaacgattaaaattaaacaacgccggagggaccgganaggggaaaaatctggccttgccctcggaaaaagnattttccgaaagctccgggcgccgcaaaaggctgnttcgnttcgtctccttctcgcccngcctcttcgcgttcgtngtcacnancanggccaagnntttccctgctccggctccganaaaacnntttcctcntctcggggcaatttcccctcccccnttggggctccgccgccggnttaaaacccctcaaccaccaanaaggacaggacancgtanttcaagagg

SEQ ID NO: 95094 - DNA, 535 bp, Triticum aestivum
  unsure (1)..(535): unsure at all n locations
  Clone ID: PAT_TA_95094
ggcatattgagatacaaggtgaacctctagatgtccacaaagcagtggaactgattgcaagtcatttaagaaaatttcttgttgaccgcagtgtgctccctttgttcgaaatgcagatgaaagtgcacaatgcgcacagagagcaacctatgccacctcctcagacgtggggtcctcctccaccgtggggtcatccatcaaacgttcctcctgggtggcccaggttatggtgggtaatccacagttcatgcctcctccggcctcaaagaccactattatcctcctccctgatgtactccctgtcgaaaanaaccacactatggattccttcatatggccgtnatgcacctcctacgggtctcctccctgcctcaagggaaccacaccaacaaatggttcttcccaaatacacacagatgaattcctcttcccnanctatccntnattggggaactggncaatnncactaatcncangcatagggggaacataatnttaggagggtcctggaaaatacnggggnantcaggatgct

SEQ ID NO: 95095 - DNA, 487 bp, Triticum aestivum
  unsure (1)..(487): unsure at all n locations
  Clone ID: PAT_TA_95095
ggcatacacacacacaccactccatttctgagctcttctagtttgagtgagagagcagcagaagggagtagtgcaagatgccgatccgcaacatcgccgtggggagccaccaggaggtgtaccacccgggtgcactcaaggcggcgttggccgagttcatctccaccctcatcttccgtcttcgccggccaaggctcccggcatggccttcancaagctgaccgggcggcggacgacgacccccgccgggctgatnnccggcggcggtggccacccttcgccctgttcctggcggttccttcgngccaaatctccnggggcaagtnaacccggcctnacttcgggccttcnnccggggaaacacctttccgcggctcctcaacggtttccnactcctggtccanctgggtcttccccctcggttttccaaacgggggtccccaacggacttnngnctacggntccccttttggaagcccnggctgaa

SEQ ID NO: 95096 - DNA, 578 bp, Triticum aestivum
  unsure (1)..(578): unsure at all n locations
  Clone ID: PAT_TA_95096
ggcatactgtccccccatcccccaactggagagtagtagatcgattcgatccaccctccgattcctttaccgaaccgtgggggaaatccgcgccggggatgtcgtcgtcgncgngccgaaggngaaagttgncccgggcggcggcggcggtggcggaggagcggacattgcnagcctgctgggataaagccaaggagctggaccaagctgcgcannggagcaagacgangtggtcaccgaagatnnaacaanatgcacaagaaattctctccctcctccaagagatggttngataaacaagttngatgctactttgattcngttcntgctttaatatacacattccaaaagaacttttttgagatgaatncatgcacctctgcttnggtttgacnatngtggttgntttcatcccgggattncaactgcanaacgaaaaaatacattntgtgacanataaaagagataatccgatacaatacanacatccctcctgnacctatangaccacttaccaactacaactgaaagaaaaanncacnaggcaacataccataaaaatanggttntgtaaggga

SEQ ID NO: 95097 - DNA, 528 bp, Triticum aestivum
  unsure (1)..(528): unsure at all n locations
  Clone ID: PAT_TA_95097
tcgctttcctctcctctcccatcccaaacccccccacctcgagctctagggtttcgcggatcgaggggcgccgcggctagggtttgggtggggggtgcctgcgcgatggccgctccggcggcgggtccgcggtggtttgggggtgggggttggattcggcgacgagcgcggcggtgagggatggcttcgcggagctggagcggcagcagcagctgcttgcgacctgcacgcgcctgtaccagcagctcacggacacttcggtcgctggacgcctctcgccncgcgctccnagacctccgcaccaacgccgctcctcgactncgcactcccgcangtccaagcctcccgccgccgggagctccatcnacggtccctctcgctcgcctctcccgggtcgatccctcnncnaaggcacgcnggacacggtcgctncgccgagccgctggacccccagggtcaancctctcgccaacatgatccgcggtctcacttcctgncccagncagagtgaccctcccccatcccaac

SEQ ID NO: 95098 - DNA, 504 bp, Triticum aestivum
  unsure (1)..(504): unsure at all n locations
  Clone ID: PAT_TA_95098
gttttctaacaaaaaacgaaccgggacaaagttgtcatgttttaacaactaaagttgccatgaaaaacattgtggtgacatatttaaaatccaacgttcgtgtgtgcagttgcacccgagagccaaaatgccgtttccggaaaggagtaaatatcttgatatacttcaccatgtggcagcactgagccttgggcccgtgtgttgccggtgggtaacgttgccgctaaaaatgtctttgccacccggccctttctcgctccgattatagttgcaacccgcaagaccgagcgagaggttngacactgggaatcatcccatcgacctccaactgctgtaaattgatcacccctcctccngttgaatatcaccgtttgtacacntatgtttatgaccggtcccaagattcntaccggtccttcacctcccngnaatgcctaaccagatgtaggantcnatttattacgggtacggggtgctccctctctntctctctcccaatttaac

SEQ ID NO: 95099 - DNA, 580 bp, Triticum aestivum
  unsure (1)..(580): unsure at all n locations
  Clone ID: PAT_TA_95099
tatgtctacctcaatggccatgaacgcatccttaaaagaatgaaagaaatatcatatatgtatagaactagaataacataatgaaaaccttgaaataaacatgggtcacactctcaatgaaattcactaacttttagtcattcggtagacatcgaaataaatttctttcagtcaatttgtttaaaatgtttagatagtagacattgattccccggtaaaaaaatacacactggattcaaaataatgtttttaaaatatttcaaacacgtaaagatttggggtgaacttccaangattttttttgccatttgggctgaattggaaaccggaaataactgaacttccgggaaaataaaaccaaatccngtttggatatcctagaatttttanganagttgccctggaataaaaagatacatttaantatttccagaaagacgaagaaccacnttcaccngggaaaaaaatgntcacacgtcaaggggaatgaagtcaaaactaccattttggacccnatgngaagcacaataattttaggccgncaaataantttaaaggcagtggtgncttcctanacatg

SEQ ID NO: 95100 - DNA, 612 bp, Triticum aestivum
  unsure (1)..(612): unsure at all n locations
  Clone ID: PAT_TA_95100
ggcataatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtcctctacctcggcccgctctccggcgagccgccgactacctcaccggcgattcccgggcgactacggggtgggacacgcggggtctcccgccgaccccggaacttcgccaagaaccgggactggagtgatcatcccnggtngggcgatgctgggccctccggtgctnctncccgggantcctccccccggaacgcgtcaattcggcgagcnttttngtcaaaggnggntcccaattttcaacgagggngggtcaatactcgggaaccnanctgnttangcgaaanactcccaacgggcgtcaagtgtgcaatgggccctccagggacgnncccggggcnntcggaagcctnacngtnaccggggnctnaccgcnggtccnanaccaaggttccgannaaggaagnntaaa

SEQ ID NO: 95101 - DNA, 422 bp, Triticum aestivum
  unsure (1)..(422): unsure at all n locations
  Clone ID: PAT_TA_95101
ggcatagcgagcagctgctccgacaagcgctctctctctctctcaactccggcgaggctcacgcgcgctccgaagcttcggatagcggcagtagtcagtgcattgatggcgaccgacgtggcagcgactgagcccgaggtggcggcggaggaggctgcggccgccgcgcctgagaccacggccaccgccggggattccaagccggcgaaggagccaaggccaagaaggccgccgcgccgaggaagnacgctccaccgccacccacccngccgtacgcccgagatgtttcnggaggcgattncnaagcttaaggagagnaccgggtccaaccantacgccatttggaatttcctncaaggacaacaaaagggcaactgcatcaanttncgcaagantgtcctncaaattnaaacccttncccc

SEQ ID NO: 95102 - DNA, 642 bp, Triticum aestivum
  unsure (1)..(642): unsure at all n locations
  Clone ID: PAT_TA_95102
ggtgtttgacgaaatggcctcctccgccatggagctctccctcctcaacccggcggcaatgcgcggcctctccgccgccaagccccgcgtcgtgtcttccaggcgcatcgtgcggttccgcgtggcgtcgtcagccgcggcgccgcccgcggcgaagcccgggacgcccaagaagcgcgggaagacggagatccaggagacgctgctgacgccgcggttctacaccacggacttccgacgagatggagcggctgttcaaacgccgagatcaacaagcagctcaaaccaaggaggattcgacgcgctgctgcaggattcnaagacngactataaccaacccactntgtccggcaacccggatttnaagccgccgcccgacaaatggagggctctcaagcaattttcnncgattcctccacgtcctgnacgcggatttccngttcncctccnaaaagactcggcgcaggtcaagaaacaaccatgggggtaatntccccnaagncaaggataggccngaactggntctnaaaagggtncnattcaatggnacggnncggtctgacaaggtagaataactnttaaccaatnacttaaggactactgcgaaaattgtacgggggnaacattagggnccaggaccgg

SEQ ID NO: 95103 - DNA, 468 bp, Triticum aestivum
  unsure (1)..(468): unsure at all n locations
  Clone ID: PAT_TA_95103
ggcatagctcgctcatcgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggacccgtngtacggcgcccgaccgcgtcctctacctccggcccgtctcccggcgagccgccgactactcaccggcaattcccgggcaataacgggtgngaaaacggcgggntctccggncgaaccccgganacttngccnaagaacccggacttgaggtattcaanccccgggttgggcaatcctggccccttnggtgcntcttcccgggntcctnnccccggaaggntcattttcgggaagccttttgnttaaaggnggtcncattttttaaacaagg

SEQ ID NO: 95104 - DNA, 573 bp, Triticum aestivum
  unsure (1)..(573): unsure at all n locations
  Clone ID: PAT_TA_95104
gagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtccanngcacctgcngtgggcctgcaanaagtaccgattcggtcnagccaaacatgatatttcccgcccaaacatganatannagctcaaacganatgagcaaggtcatcgtcctagctgtgtgntggcaacaatattttaccagtancctgtcttctcnngntttcccncccnaagaaattggggtgcctgtgttaaaaatcggatnccccggnanaataagatngnctgggggatnaacaaaannnaaaaaaaagggggccggnccattcccaa

SEQ ID NO: 95105 - DNA, 378 bp, Triticum aestivum
  unsure (1)..(378): unsure at all n locations
  Clone ID: PAT_TA_95105
tgggtgggttttcttctccaacgaaactctatcccctctcttcttctctctgcactgctcctcccctcaggcctaagccaggcaccaatctgaaggtaaggcaccatggtgatttgctggccagccgctccgcgtgtccacacctctcccaatctgtgttggctgccatcctctgcacctacgcctccccgccgaccaacaaccctgagtaggcgagctcccccacggccgctgagggccacgcggcgacgcctcatgcccggtggntntccgcngaacggctantgcggtttnncctcccaaagncctaagtttaaaacggngnggggaancaanggcccngcggcaangcccgggaatttcgcttcctttccaatt

SEQ ID NO: 95106 - DNA, 208 bp, Triticum aestivum
  unsure (1)..(208): unsure at all n locations
  Clone ID: PAT_TA_95106
ggcatanttgacaagagtagnacatcaannaacatcatcatcatctatcacacacactatcagggcaggtgatcgantagctagtgaancaagcaagcagaagagtagtagatcgagtgatcggaggatggggtcgcngtacnaaagtgggaggngacggtgtcgtcngcncgggacctcaagaacntcnanctgggcgcaagccggc

SEQ ID NO: 95107 - DNA, 540 bp, Triticum aestivum
  unsure (1)..(540): unsure at all n locations
  Clone ID: PAT_TA_95107
gactcagagaggaggcgtgttggttagctcattggcagcagcacacacaaaccacatctcctatatatagctcatttttagcttttggaatttgagagaggttttgagagaaatggctagccaaggtgtagcctccatgttcgctctcgcattgctcctcggtgcctttgcctccattcctcaaaaggcggaggcgatcggggtgtgctacggcatgagcgcgaacaacctgccgccggcgagctcggtggtggggatgtaccgctccaacggcatcacgtcgatgcggctgtacgcgccggaccaagcggcgctgcatcggtgggcgggcacggggattaagcgtctcgtcggcgcgcccaacgactgctctccaactcgccgccaccccgccggccgcgcgtcctgggtgcggacaacatcaagcctaccttcgtgtcgttccggnactcccctcgggaacaagncccnggcgggcactcanctgncccgggcatggananttcgccggncctggttccggggggtgggcncanaagg

SEQ ID NO: 95108 - DNA, 380 bp, Triticum aestivum
  unsure (1)..(380): unsure at all n locations
  Clone ID: PAT_TA_95108
ggcatactccctctcacgacaagcaaacccaacccaaaccaaacacgagccggacgagacggagcgctccctccctctctgtcgcccgcgacgccgcgaagccgcgggcgccaccgccgccgccgccgccgccgccggagatggacggctccggcagctgggacgccatagactggaaccaaatcaaggagccgaggccgccgcggagttcgtcccggggcatggaggacttcctcctcgaggatgatgaggtttacgcccagngtcatggtgttgttctactaaacacagatgaagctggcattctttcantgacaaatttccgacttctccttgtgagccaagccacaaaaaggcgttatanagttggtacatcccac

SEQ ID NO: 95109 - DNA, 328 bp, Triticum aestivum
  unsure (1)..(328): unsure at all n locations
  Clone ID: PAT_TA_95109
ggcataccaggaattcgttccanatccagccagccagccatctcaagcttctctcttctcttgttattaagagcaagcatacagtagtctaggcgaagcgagactgcnagagcanagcattgttcttcttctctagctattagtggtggggaataatggctcccgccaccancgcagcaatggccctcgcgccgcctccttcccatcaccatcaccatcaccatgtcaagcagctgcagctccctccgtctgtctccgtctccgtgcccctccgctccggtttccttggncgcgcactgcctgntgctgcncaccanagccgctgctc

SEQ ID NO: 95110 - DNA, 605 bp, Triticum aestivum
  unsure (1)..(605): unsure at all n locations
  Clone ID: PAT_TA_95110
ggcatactggagccgacgtccttcaccgttaaggcggagggcgtggccaagaacgcgccacccgagttccagaagaccaagctcatgacccgcctgacctacaccctcgacgagatcgagggcccgctcgaggtcagctccgacggaaccatcaagttcgaggagaaggacggaatcgactacgccgccgtcaccgtgcagctgccgggaggcgagcgcgtgccgttcctcttcaccatcaagaatctggtcgccaccggcaagccggagagttcggcgggccttcctccgtgcccagctaccgtggttctcctcctcgacccaaagggcccngtggtctaccgctacgacaacctgtggcntccccgccggagcaaangaacgagaagactcnctaaggaaactcaagaccctcgtcntcgacgggaacatcactttacgtcacaagacaaccaaagaccgggaaggattgctctccaaaagtcacctncgncaaaactcgggcaagggccaagntttaaatcaagggtgtggacccaaccatnaggatgaaanntttgctgccggtnaaatcatcatgnaaggaagagntnaaaaaaaaaaaa

SEQ ID NO: 95111 - DNA, 206 bp, Triticum aestivum
  unsure (1)..(206): unsure at all n locations
  Clone ID: PAT_TA_95111
ggcatatangangagaagaagaaccgcacgacaccccaccccacctcccgatcgccaanaaccacaatccccaatccacccaataactctaattcctcccccgattcgccctcnancaagaaccactcggntcgatnaaagccgccacctttccaccanntcnccaatcntttttttttcntcctcntttcntgcaacgtgatgcg

SEQ ID NO: 95112 - DNA, 600 bp, Triticum aestivum
  unsure (1)..(600): unsure at all n locations
  Clone ID: PAT_TA_95112
ggcatactggactctcctctttataacccgtctcccttctcatctttttctccacagtcgcctcctcccctgccaaaccagtctcccccaaatctcctttgcgtcctctcgattcctcagcgaccatgtcggcctactgcggcaagtacaaggacgagctcatcaagaatgctgcctacattggcactcctggcaagggtatccttgctgcagatgagtccactgggcaccattgggcaacgctttggccnagcatcaatgtcgagaacgtttaggagaaccgccgctctctctgncgagctgctccttcacnacccctggtgccctccancactaatggtgtgatcctcttcnnaggaaccctgtnccaanaagacaaggacggaacccttcgtcnattccccaaagagggtggtnccccccgggcannaagttnaaanggaaccttttaggtnccggaccancaagaacacaccnagggcacganattttggaaccttcnccatttaaaaggcgtgccctnccnatgggtgttccaaaaatggccaangacacnnattcatntctaagcanggntgcccaatcanaatggaaaaaagg

SEQ ID NO: 95113 - DNA, 458 bp, Triticum aestivum
  unsure (1)..(458): unsure at all n locations
  Clone ID: PAT_TA_95113
cagagcatctcctcactctctagcttgctccagtttcgcgtagctgcgtgacagttcaattgaactctctggattcgttggttacttcgtctgagctgctgcagttgaaggaaggaggaaggagcaatggcgctcacgacgttctccatttcgagaggaggcttcgtcggcgcgctgccgcaggaggggcatttcgctccggcggcggcggactcatctccacaagctccagagcaggcacacaaggctangcggaggcntcctcgacatctcggctcgcttcaacgggagagggaaggcggncggattacactcgcaagggcnacganccgctgctggacacgtcaatacccatccacatgaaaacttccctaaaagantccaanantcnccgacactcngtccgantaacttcnaanttccaaaacggggaantgggtcaacctcgggttttcact

SEQ ID NO: 95114 - DNA, 623 bp, Triticum aestivum
  unsure (1)..(623): unsure at all n locations
  Clone ID: PAT_TA_95114
cgccggccgattcgcctcctcccgcaaagcgccgtccgtcttcgccgcccgtgccatgtcgcggccagccggcaatccctcgtacgccgccgagctcggcgcggccaagaaggccgtcgccctcgccgcccgtctatgccagacggtgcagcaggaaatcgtgcaatcagacatccaatcccaaaggcgggataagatcctggtgaccgtagctgatatggttnccaagtgttggtaattttggtgtttaaatatggaantacttctggtccttttcccaagggtggctgaaggagatccaagagacttnagaaaggattgngctgaaaattcttgacgcatacgatttttntaacaatccccccccnagatgtcanacaatttttattaccnaagactacctccnctgcattnataccggattccaggtggccatctggccaatgggttccaatncattngaggacnaagttccttaaagagcattccatnnacggatctttataaggaaatttctggggtttggattcnanctcctttnacaataatacncgnggacccanagnntaacgggccctttaataaacgttgggcnaataatntaagggnccaaaaaaatnntt

SEQ ID NO: 95115 - DNA, 615 bp, Triticum aestivum
  unsure (1)..(615): unsure at all n locations
  Clone ID: PAT_TA_95115
ggcatagccgtcgccgcctccgccgccgcgggctcgcatcgccgcccgtccccagtagcacggtttttgttctgctcttcactggtgtggttgctactctttgctcaacaatatggtttccttcgagatgaatgacctcaagagtatggacctggccccgttcattttcaaattgcattgtaggagttacttctcatggagcaccgcttatatttgctaagtttatgaatttgaattgatttattttgtgtggccatctctgcttccttcctggcttcacatatatgaaattccaatgacccaccaaactggatagaagtgctatgatgttggctaatcatcatgcatgtggnaaatttgtgccgggcngggttaatgggtacaattttaacataaatgctggttggcgtnanaagagaacatttagtnataacnagcttngttagaacaatgggnacctgacaataccaacattcnatacttaaatgantncacatagtnactcnagacaacaaggcaattncaaacttcantcaacganncaaatcaagattggngacnacctganntaaaaaaaggaancgactntatcacatatnaagttgnatncggttn

SEQ ID NO: 95116 - DNA, 344 bp, Triticum aestivum
  unsure (1)..(344): unsure at all n locations
  Clone ID: PAT_TA_95116
ggcatactcctttgctgtgaactgtggtagcaatagattcatatcaggctcagataatttaaggtatgaaactgatgatgtcaatcttcaagcagcatcatataatgttacaggagcaccaacgtggggtgttagcaacgttggaaagttcatggacgcaccaaatgggaattacataatctacagctcccgccagtttcagaacaccctagattcagaactgttccaaacttcaaggatgtcaccatcatccttaagataccatggtattgggacttgagaatggnaactatcagncanncttcaatttngcatagtttnggaaccgaagatacacatccttg

SEQ ID NO: 95117 - DNA, 604 bp, Triticum aestivum
  unsure (1)..(604): unsure at all n locations
  Clone ID: PAT_TA_95117
ttcagtgttattctcctcatgttatgttttgctacgttggggagcgctcagtatgtcaagtataaggatccgaagcagcccgtctctgttcgtgtcaaggatctgctcggccggatgactctcgctgagaagattggccagatgacccaaatcgagagggagaatgccacggcggagcagattgccaagtacttcataggtagtgtactgatgggtggaggcagtgtgcctgctcctcnaggcatcactcaagcttgggttccaaatggtgaatgaaatgcaaaagggtgccctttcngaccccgactaagtattcccgatgattctacggattgatgccctngcatggggcacaataacttctacaagctacancttcccccataatgtccnggctccgcgctacaaagacccccgaccttattaaagaggataggananaactctccttngatttanactacngatccctantcttgnccttccttgcgttttcaaacccanatnggacccnctacaaactatacnaaacccaagttccatccttgacaaatcaccnggttcaaggantccacaatganttgaaacatantgggaataaaan

SEQ ID NO: 95118 - DNA, 522 bp, Triticum aestivum
  unsure (1)..(522): unsure at all n locations
  Clone ID: PAT_TA_95118
cgctcaagcccccagacgccgcagcgccgccactccacccgcagcggcaaccatggcggtcggcaagaacaagcgcatctcaagggaaggaaagggtagcaagaagaaggccgtcgatccgttcaccaagaagcagtggtatgacatcaaggcgccgctgctgttcaccagccgcaacgtcggcaagaccctcgtgtccaggacacagggtaccaatattgcctcaagagggtctgaagcacagggtgtttgaagtatctctagctgatcttcaaaacgacgaggaccaggcctacangaagatnagactccntnctgaggatgtncaagggatgaatgtcctcaccaacttctggggcatggacttcacaactgacaactcagncccttttgaggaagnggnagacactcantgagntcatgtggattnaaagacaactgnaactacatnttccatgtncgnattggttnacaaganncccgacaagtgaacgactnctntgcnaacatcattngaaattc

SEQ ID NO: 95119 - DNA, 309 bp, Triticum aestivum
  unsure (1)..(309): unsure at all n locations
  Clone ID: PAT_TA_95119
ggcatactcctcttctcctcttcttccatctgcaagctcgagctcgttctagaaggttctagacacatcagttgccatgggcaacggcctctccccgtgcatgcacctgccggcgacggcggcggcgggggtgaagctggtgtactggggcgggcagacgaggatgctggacgacgatggcggggtgtgcgccgtggcgggggacgtcacggcggagctccccggtgaccacgtcgtctgcncggccgactccttcnacgtcggctcccgattccnggtggtgtccgcccggcgaagactgatgcgggt

SEQ ID NO: 95120 - DNA, 542 bp, Triticum aestivum
  unsure (1)..(542): unsure at all n locations
  Clone ID: PAT_TA_95120
ggcatagtcaagtactactactcaactgagcttttctttggagtgtgtgtgcgaagctagtgaattcactcagctagctcggagaggcagagaggaacagactaatcattaatcaatggcgggcctggttggatttggctgggggagttcgcaaattgggcccgggggggcggcaccggcggccgacgccggggtcggccagcgagctcagagcgaaaggggaagagctgcaagagtaaggnttggtgatggtgttgtgcangagatnacgaacgaaggacganggacagcaacatcctcctctccgactcccgaggcaccgttgtgcatgctcatggacccgctncnccctgccctgacgccgctaactggccgctgggctttccccngtaaaaggatnaatggaacgtttaccgtgttannatagaanaccccngtataaacacttgcttgcnattgnatcaattgtacaaatggttgaacctcaaattnggnncatcatggttaaanatcacncnagggggtntnanaaaaaaaaaaaa

SEQ ID NO: 95121 - DNA, 391 bp, Triticum aestivum
  unsure (1)..(391): unsure at all n locations
  Clone ID: PAT_TA_95121
tactcttgctatttttagttantttantcangtttagnttttaantctttttgcttttaggttcgaaaaattataaacttactgttagtgccattagcttttcaaatttgnagtagttaaaatttgagttcnttgaantttgtgtgaatcacaaggtttgagattaactttactanaaaattatttttttccaatttttgttttgtnttttgcattatttattttcattcattccttgctttantttttaaantcnnttttttcntttangtcanaaaaaattgtcaagtttccgtcacgtgccattacntttacaanaattagnaacttttgncanggccatnanttttccggagttggaatancnnaaacttgnatccntngaaattgg

SEQ ID NO: 95122 - DNA, 233 bp, Triticum aestivum
  unsure (1)..(233): unsure at all n locations
  Clone ID: PAT_TA_95122
tcacaacccaacacccaaaagcaaaagaaaagcagcaaccaaagatgtgcggcggagcgatccttgcggagctcataccgagcgcgccggcggcgangcgcgtcacggcgggccacgtctggccgggcgacgccaacaaggccaagaagaagggcgcgcgcgccgacgacttcgaggccgcgttccgcgacttcgacaacgactccgatgacgaggaaatggttgagggcnag

SEQ ID NO: 95123 - DNA, 412 bp, Triticum aestivum
  unsure (1)..(412): unsure at all n locations
  Clone ID: PAT_TA_95123
ctcgcgctcttgccgacggccaccgcgccgcctcgccggtcgccgctcccacccttccacggcgaccggagccaaagacggtgaccggcgggcgcgacgacctaggggaatgtgtacctcacctaccccacatcgtccccgcacccgcattccctaaacccccaaaccctagcccgctcctccgttgtcggatacgccaacctgctatatgcgagagaagggcatccacaactgtttgatgatctccaccggagccgccgtttaccggagtaaccgtgcttaccctcagctgggaagggtgactcggattcggtgggaaggctgatggtcccaaccaactggtccattnctgcggcgcgggcccccgcaatccctgctgtnacctgtgntcccnggtaaggggtttcctttg

SEQ ID NO: 95124 - DNA, 471 bp, Triticum aestivum
  unsure (1)..(471): unsure at all n locations
  Clone ID: PAT_TA_95124
ggcatacngctantggacatactctactactactanccagtannctacactaactaactacgtgctatggcccccaccgtgatggcctcntcggccacctccgtggctccattccaanggctcaagtccaccgccggcctcnccgtcanncgccgctccacaanctcgggcttcgggaacttcagcaatggnnaaaggatcaantgaatncaagtgtggccaattgaaggcatcaagaanttcnagaccctatcatacctgncaccactcaccgtggaagatcttttgaagcanatncgagtacctgcttcgattcaagtgggtgccctgtctcgaatncaacaaagtnggtttcgtcaacngtganaaccacaggctcccggatacaatatggaagtatnggcnatgtggatctnccaatttcnggtgtaccgtcanccaagggctcaaggacttnaggngccaagaggc

SEQ ID NO: 95125 - DNA, 212 bp, Triticum aestivum
  unsure (1)..(212): unsure at all n locations
  Clone ID: PAT_TA_95125
ggcatacaaccatatccacatagcttgagttaattagttcgtcgatatatctagcctagctatctcaattgatcaacatggggttttctcatgcgattgcgatcttgttcatcttcctcgtggactcaacaacatcaccttcacaatgctagggatggtgccaaacgatgataccaaccatgttaggnacnaggagtacannccctcaatgt

SEQ ID NO: 95126 - DNA, 449 bp, Triticum aestivum
  unsure (1)..(449): unsure at all n locations
  Clone ID: PAT_TA_95126
nggcatactccgacttcggcctgtccaagcttctcggcgaagacggtcgtggncagatcaccacccaagtcaanggcacaatggggtacctggacccggagtactacatgacgcagcanctgacggaccggagcgacgtgtacagcttcngcgtgctgctgctgngaggtgatcacggcgaggaagccgctggagcncngccgctacgtcntccgggaggtcaaggacgcggtggaccccgcanggacatgtacngctccacggagctcctcgaccccgcgctgngggccncctcggggctcgccggctcgagccgtaactcgacctggnccctcagcctgcntcaaggatccngcgcccgaccgccccncantgggcaangccntcccgagattaacggatngccaangtgnccgncnctgggggtgcggcccctcnnattcnggggg

SEQ ID NO: 95127 - DNA, 553 bp, Triticum aestivum
  unsure (1)..(553): unsure at all n locations
  Clone ID: PAT_TA_95127
ggcatactttcttcctcctcctcgtcttcaggactcaattcgtcttctgatagcttagcttgattggggtgggtgacaatgggaggtggcaaggacaagcatgacgagagcgacaaggggctcttctctaacatgatgcacggcgttgccggcggccatgggtatcctcctcaccagggataccctcctcaagggctacccgccgccgccgggagcgtacccgcctcctccgggggcttatccccctcctcctggggcttaccctccaccacctgggggcatacctccacagcatgggtacctcagcctggtggtacctccactggtggtacccccaaatggggtacctcctgcggtacccggttatctggcacaaggcgcatggataccgtggaggaacanngacaatctggtgaggcgttcgtcnnaccaatggaaaaattctcncnangcatgggaaatggtatgagcatgagttggggtaacggatgntngggnacaaggggattaacatgaacaggccaggaattacctgaacatggncgaatttgtn

SEQ ID NO: 95128 - DNA, 485 bp, Triticum aestivum
  unsure (1)..(485): unsure at all n locations
  Clone ID: PAT_TA_95128
ggcatacctaaacagagaaaagttcgcacttctccccctctcgcacgcgcctcgccgccgccgcatcgcatcccctcgtcgtcgcagccgctacctcctccgcttagtcgcctcccccccaccccggcacccccacctctcctctccgcctcgctgttgcctcttccatgaatgtccctagtgaagagcacggcgaagggcatctcctcaagacctcacacatgccggcgagccgccatctgctcctcgtcgttgctggatggggaggaagaactcngtgacntcctcggngcccacccgtctccnaacgccgatgaggtcnagcangagatggccgttgggccgctcggcgtcggcaagatnggcnacnggcgtctcgttccctgcnggggcaaggagccatacangacaangtaactaatcttccaangatttgcggggtgaaaacnangatttgcttttngcccaatnaatgggnaaatgct

SEQ ID NO: 95129 - DNA, 217 bp, Triticum aestivum
  unsure (1)..(217): unsure at all n locations
  Clone ID: PAT_TA_95129
ggcaccaccacacttgctcgcctccctctgtctctcctctcccctcncctcccctccctcctatagcaatcaaaccaccagctccactcccccctcctctccaccgtcntcnccctcccnctcntgctantccctanttcatgtcctgctgcttcccatgtcnccngcntcacganctcgactacataagcctctcngccgtcgccggnggncgcgc

SEQ ID NO: 95130 - DNA, 329 bp, Triticum aestivum
  unsure (1)..(329): unsure at all n locations
  Clone ID: PAT_TA_95130
ggcatacccattcgtctcaaacacacattctttgattcttccttcaatttccccttttcaactctgtcatcaacttaattgttagaagcgacctaaagattttgcggccgatcgagcatggcgtccccttcggctctgatcncaatgctcctcgtcatggtcgtcggctgcgccgccgtggcctcggcgatggagctgagtttcantgtcgggagatgcgcanggttgggnacaccggcgtccaactacacngcttgggcgaanggcaaaancntcgagntaaacnacacgcttgtattcanatacgccaaggaaganganacggtgac

SEQ ID NO: 95131 - DNA, 432 bp, Triticum aestivum
  unsure (1)..(432): unsure at all n locations
  Clone ID: PAT_TA_95131
gtggtcgcggctgctgccggagctgctcacggagatcatgcggcgcgtggacgccggcgccgagcggtggccgccgcggcgggacgtggtggcctgcgcctgcgtctgccgccggtggagggacgccgcggtgtccgtcgtgcggccgccgctggagtgcgggcggatcacgttcccttcctcgctgaagcagcctggaccaagggatgctccgatgcactgcttcatcaggaggaacaaaaagaatcgaccttctacctttaactcaacttaacacaggcctaaacggataaagaaattttctgctggtgcnccnaaggtnnaaaaaacggggganattcagaatatncaattcccaaaaattgggaaaatcaatttccaagnaacaattccctannttgggaancgnaattgnantcccgggggnaaatt

SEQ ID NO: 95132 - DNA, 605 bp, Triticum aestivum
  unsure (1)..(605): unsure at all n locations
  Clone ID: PAT_TA_95132
ggcatacaaccctaattttttttccccanccgcgaaaccntacccgccacgcgaaacnaaatcccnccgcgcgggatccttttccgccggattccacccgcgaatcggggttccccttacgattcgcgggcggattagcgcnaggngcgcctccccctacctctgtgtgatccgngggtnacgttaagccggacccggggnatcanncatgtccaggtgctcccctanccgncncccngggtaagnncgaaaaccaatnngtagccgttgccgcggacgnagcncaagcnaccactaaggtttgttgaaccatcggatttacacaagcacttgaccggttaattgcncctgnctgttggtttagattcgttcgttggtctncagtgtacttggggattncacttccggggaaactnactttgcaatggataacttgaattnntaagccngctncacaaattgncccaacctttatngctanccttggaaaagnnttactactcggttgccaattngttgccttnaaccgaagaaccaantccgggaaaatctnttggaagntcaataaattcaaaatttgngccaanaaggtnaaaatnacangg

SEQ ID NO: 95133 - DNA, 215 bp, Triticum aestivum
  unsure (1)..(215): unsure at all n locations
  Clone ID: PAT_TA_95133
ggcatacccctcctcttctcgccggtgccagaggcngagcaggtgcgccgcgtcgtcgtcgganatgacggtcacgtcgtcagtgaangtcgctggtggggagctctcggtccatgggcggacngtgctgtccggggtgccggangcngtgcgtgcgtcgtctnccgcggcngcggnngcccntcgatggggtcntcctcnncgaganacttcgc

SEQ ID NO: 95134 - DNA, 536 bp, Triticum aestivum
  unsure (1)..(536): unsure at all n locations
  Clone ID: PAT_TA_95134
cttgaggataggtggcgctagcttcttcatgatatgcgagcaaaaggccttgagtctaccatacgccaccgcttcttgtggcgtcataccagaagccgtcggcaccgacaccatcatgccattgtttagcccagcggcctcctgcacccccaggccaatgttcggctccgtggccacaatcacgttgcccgcctcccttgggcacgggcatctcattcctcaccacaactgtactcgcagtgccctgggataggcatctcctcaagtgcaagttgtatgggcgacgttgcatggttcacatccgcctgggaccacaatccgcatcaacatcattgggtgcattatcccaacgctgtggaccctcgccaancctttgtgacccccccgattcaatcaatacactaatccatgcaccaaagtgtnccatnaaaatnaaggatcacngggaaattcacaacacaannctaaaacataatatcatncaancaccatatacaccaagggctcctangggggccggaccattccccnaaagg

SEQ ID NO: 95135 - DNA, 438 bp, Triticum aestivum
  unsure (1)..(438): unsure at all n locations
  Clone ID: PAT_TA_95135
cggaccgagaggcatggcgatggcgctccacgggcacgggaggaggggcaggctcncggcggcgctgtggctcgtcgtggtggccacggcgagcgtggcgtcngcgcggttcgtggtgganaagaacagcatcaaggtgctgtcgccgcactcgctacggggccgccacgangccgccatcgccaactanggcgtccccgactacngcggcacnctgacncngccggntnctgtaccccggnggacgccggngcaagccaaacgggtgcaagccgtttcgngggcgaangcgttcaantcncngtcccggcncgggccnttnatgctccnngctgggaccgtcggcnggttgctaatttcccnctaaataanttggaagcccanaaaggnnggcccngcagngnttcttntggccantaacctgcaaggaccccttgt

SEQ ID NO: 95136 - DNA, 448 bp, Triticum aestivum
  unsure (1)..(448): unsure at all n locations
  Clone ID: PAT_TA_95136
ggcatactgtctcctcgaatcctaagccccggcggctgctgctccctccctagcggcggctgctgctcttcctccccggcgtggtggcggtgcctcccctccccgtcctgggtggcatctgcaacgccccccctccccggctgccccctcccctccccgacgtggagccgaaggcggctcctgctgcctctccccggtgtgggagcgtggcggcaacggcggcggttgcttccctcccggcgtggtgggaagcagctgccccccctccccngacattgtgttgacggtggtcctatctnccctttccnggcatngtgacggcggtgtnnncgtgcttcctccccccggngtngtggtaacaactgcccgctgctcctccttccngntgccctnaattcccccgattntganctaagnggtcctgnngctcttccccggtnttggaacc

SEQ ID NO: 95137 - DNA, 336 bp, Triticum aestivum
  unsure (1)..(336): unsure at all n locations
  Clone ID: PAT_TA_95137
ggcatatttctctctcttcttcccctcctccaactactagcactatgctcctcctcctcaattcttcccttccctttgctaccctatcctacccttcgatctgattcattcgccgccgccgaatcccggccgccggcggtagctgctccgacttttcttccttctctcgactccactggggtccnggataatagataanancttccttgtttctttgcngtgnacaanttaaaccaaancttcaacttccccctccaatcccttttcnggttcccgggggtttggggnggggtccaaacaggaattngntccccaaaaaaatttaaantaaccctg

SEQ ID NO: 95138 - DNA, 373 bp, Triticum aestivum
  unsure (1)..(373): unsure at all n locations
  Clone ID: PAT_TA_95138
ggcatacaganggggagatggaaatggaggcggangattggggggagagctcgtcgncgccacggccacacccanangcagacatggtgaataaagagaangacccctnggangatgaagaggaanctgaaggagcgaatcctggagctgnntaacgangaggtccccctccccgacnacgcctccgccttcntccaccacctgtcgcgcctccccanaangtatctcttcgacntccngcgtttgacangggtggannacgttntcctccactgggaggatcantaatcaactngacccacccatataatcccnccgtncttcgatgccngncntccaaaagtccatcctcctctccgcttcntatttcgat

SEQ ID NO: 95139 - DNA, 581 bp, Triticum aestivum
  unsure (1)..(581): unsure at all n locations
  Clone ID: PAT_TA_95139
gcagcagtagctgagcttgaagcagcagagcgaggtagacatggccgccgccaccatggccctctcgtccccggcgctggccggcaaggccgccgcgaaggtgttcggcgaggggcgcatcaccatgcgcaagtcggcggcgaagcccaagcccgccgcgtcggggacccgtggtacggcgccgaccgcgtgctctacctccggccgtctcccggcgaccgccgactacctgaccggcgattcccccggcgactacggttggacaccgcgggtctccgccgaccccggnacttcgccnaaaaccggaantgaggttttcnanccaaagtnggcaatctcggcccctnggctncttttccccggntcctccnccccgnaaggggttaattncggaagggtttgttnaaagggggtccaatttttaaacnaaggggctcaatactnggaacccgacctgtttaccncaacactcccatctgggggcaagtgtctnatgcnctnccagggaccancccgggggcctcnnaagtttaccttacccggggaattacnccggcnccnaaacgnggctccgacnagga

SEQ ID NO: 95140 - DNA, 523 bp, Triticum aestivum
  unsure (1)..(523): unsure at all n locations
  Clone ID: PAT_TA_95140
tcgactgacatgtcttgttgattgattgcagaaatctcatgagcttggatccagatttgctgaattagagaaaaggcaaacccaactcaatctcgacctggagttggccaaggagaacttgcagaaggcaaaggatgaagcagctatcgtgggaggtaaccacttgtcaattgctccccttgctacttttcctttcaacctttaaaccgagtgatccactccnaacagattgccgttagtgaaaaccgtcaacttcaagctccgtcctgaagacgtattcctttaagaccaaatgagcaggtctnnngccaaagntcttancttncnaccgggcaaaaacacnccggagaaaccacttnncacaaaatttgttcatccgtantttnaanaagaacnccaactnaaacncttttataagntnaaaaatcctcaccnnangggaaagttcctnaaaagnaagtcccttcttccanaananaacctttaggaccattaatccacanaantcagattcccttaaaac

SEQ ID NO: 95141 - DNA, 296 bp, Triticum aestivum
  unsure (1)..(296): unsure at all n locations
  Clone ID: PAT_TA_95141
tagagcagaagggtaacccttatctttccatttatcagcttatcatcatccaatagattataataatagagggaggagaagtagcagctactagccagtggagctgattcgagcaggggatgatttggagtttctcatcatggtgaagaggaaggtttggccatgtagtaggagagatcccataaagcaaagananggaagnaagaagaagaanaaaaagaacnaggaaaaatggaagaaaaatcttccaagaacatgggatcacaacgagggaaatcaaaaatnaatcccttccg

SEQ ID NO: 95142 - DNA, 597 bp, Triticum aestivum
  unsure (1)..(597): unsure at all n locations
  Clone ID: PAT_TA_95142
gtctcgagtttttttttttttttctcgttccagcatccccatgatcaaatcacattttctcggaggagaaaatcccaatcttgagctatcaagtcccttgtcatacttttccatgaacccgaaagatgtcctaatagccatcctattatggatggcgtttaactaaccccaaagttcatgaagcaagcatgaaggaactcgatactctcatggtctaaggaattatgcaaacactaactttctttgtgttataaaactactaaatcgtgacaaatgtatctcatagcataacatcaatatgggtcaattcaatacaaggttcttccggaaattgtgtcctcaaaatgctgcattttttanccccatgatcnggaaatgtgaccacnannatttttgagctatncctannagcatgacaaggatatatttancattatatcccacacangccnagatttcccncngatccttaggnttacactcaaggacatggnntttaacacnnacacancatnataaaattggggnaatacacatcacatncccnagggannccaaaggtanagtagtggtggaattccgnagacttgattccan

SEQ ID NO: 95143 - DNA, 466 bp, Triticum aestivum
  unsure (1)..(466): unsure at all n locations
  Clone ID: PAT_TA_95143
gccggtttatcagcaggttgggagagaaggcgatccctctgtatcagatgttgaagaagacagacaattttgtcnggantgatnctgcnaangcggcntttgaggatttaaagaagcagttggctgaaccgccggttcttgcggcccngggttganaaggacccacngttgtnaaaggtggctgctaatacccgggctatcancatacccatttgnggtanttgcaagggaggctggaaaggaatacccggttcaaagngcgngttttattatatcnagcgatgtgcncaatngctccaagngcaaaatncccccaattggnnaaanacgggtnttagggggtttcaaagngganatcaaaaacttaaaanattttttnaggggccnccccacnanaagggttnatncccccctttgggggganatccccnaaanggggagcaccgggnggttcnaaanggggttc

SEQ ID NO: 95144 - DNA, 626 bp, Triticum aestivum
  unsure (1)..(626): unsure at all n locations
  Clone ID: PAT_TA_95144
ggcatagttcgatccccaatcgcgatgtgctagggtttggaggcccgtgctcagtcctcgccgccgccgggcgccatcctccccccctgcacctgctaagcccctttttttttcttataagcagcaagcgctcgccggaaattccaagcagagagacgcacggatcagatcgccgacatgtctaggcgtttcttgtttcaagaaattttcagtgctgtccggatcgatgcctaatcgtcctacctccgctcaaggaggagacgtttctgctatccacgatgctctccgtccgttttaagcacggtgcttcccaaattacaatggcttcctgtctctcaagcaaatgcctgaatccnatcaaaancctcangcaaccaccaaattaaaccacccaacaatggtgtggtccctttgcaagccggacttcctcnccntaatcaaaacctacaactgcttctcngggtgaaacaataccctgataagtncacagcattaaggtttgccttgccaacaaacctaaatcacaagttaatnaaggaaggactaatanaaggaacataaggatacattatacnggacnatnattaaanagatctctttgcgnaaaancatagtaaccacagaaa

SEQ ID NO: 95145 - DNA, 539 bp, Triticum aestivum
  unsure (1)..(539): unsure at all n locations
  Clone ID: PAT_TA_95145
ggcatacattccctcaagtcccaagatcgaacacctcgtgtccatggcggcggcgaagcggcgagtgcgcgacgcggaggcggacctgaacctcccgccgggcttccgcttccaccccaccgacgaggagctggtggcgcactacctctgcccgcgcgccgcgggccgcgccgccccggtccccatcatcgccgagctcgacctctaccgccacgacccatgggacctcccccaccgcgccctcttcggccgccgcgantggtacttcttcaccccgccgcgaccgcaatacccaacggtcccgccccaaccgcgccgccgccttcgggtactgggaagncaccggcgccgacaanccctnnctgcacaacggnaagacggcgggatttaagaagnntcntgttctacaacgnaancccccngccgngtncaaacgattntttatcacgatacgctcgccaanaaggcggccccgccccncngcgcgggncctcaagtggatatggngcttnccggtgtcaaaagaanagaatggaaaa

SEQ ID NO: 95146 - DNA, 589 bp, Triticum aestivum
  unsure (1)..(589): unsure at all n locations
  Clone ID: PAT_TA_95146
ggcatacacacccaaaaaccttattttgcttgattgcctcttgtactgcagtgttgcttcctacactgccattgcatataaattttgcactgcaagattaattcagtctgagagaacgagagagaacatcatgggtggcaagctgttgcctgctgcggcgttcgccgggtcggcgccgccgctgtcgcaggtggcaacgtcggcggcgcacggcgaggactccgccgtacttccgccgggtggaaggcctacgacgaggacccctaccacgccgtcgataaccccgacggctcatacagatgggctcgcccgagaaccagtctccttcnactcctccaagcctactccgtgaccacccggaggcgccggcnggacaccggcggccccggccgtacttcaaggacaccntgtccaagattacaaggctccaaacttcangaagcatgggacttcatgggaagaacccgcggaagnaagttgaccccacanatctctnacgcggnncacgcgccaananctcacttaacctgccaacccgggancctgtaacctacctananccggttgcaggattaggggagnnggtaaa

SEQ ID NO: 95147 - DNA, 261 bp, Triticum aestivum
  unsure (1)..(261): unsure at all n locations
  Clone ID: PAT_TA_95147
ggcatagttgaattgagctcgaattgtactcgattcaccacacagaggaatcaaatcgaagcagccatggctctcgtggagggaaacaacggcttgtcggggggagcggtcagcttcagcgaggancaggaggcgcttgtgcncaattcttgggcnatcatgaanaaggattccncaaaaattggnctcggcttcttcttgaaattttcaaggtccccccntcggnaacccatatgtccncgtcccggggnaanctccaaa

SEQ ID NO: 95148 - DNA, 576 bp, Triticum aestivum
  unsure (1)..(576): unsure at all n locations
  Clone ID: PAT_TA_95148
gtgcaaccccacgcctctgacccggcgactacttcggctgctctgcagccatcactttttgctgcgtatcagactccggatgactcaccgagtgccgctagggaagctcttcgccaggtgagccttgtcatggagctggtgaaggtggtccacgaggctagccaagtggcttacaacgccagtactgcccttcaggccaatgtttaggtcggcaaggctccgactgaactttcgaatgttgccttatatctgatcacccactgggggtgtttctttgcttaaagcttgggaaacttcaatgtcactcgacttgtgttgaaccttaacggactttcctgaaccaatggaggcangccgatgcaccacgggtgtatcccccnagacaatgtcgacggctggnatccactgagtctaaaaagtaccccttccttccnccctttttnnancccgccnncaaacctgcnatntgatnaaacattggggaccaatncaccacagttatccccnaganattggngaaatttatcggannaccnaaaactttccgnnaactntattngtcaacggaaaatctnc

SEQ ID NO: 95149 - DNA, 369 bp, Triticum aestivum
  unsure (1)..(369): unsure at all n locations
  Clone ID: PAT_TA_95149
ggcatagcttgctggccggaaccctagccacggcggcacggcacggcggcagggcggcacggcgcggcggcgccgtcgcacccccctttgccggcgcgcgcactcacccgagagtgagtgcgccgccgtcgagcggctgtgcagcggcgcccggcaagccggcggcgcggcgccgccccctcttttctctcccgcgtcggcgtnaaggacnaccggtggtggnatgaccccgcgcgcntcggcngcggccggccggcggcggtaaggtgantctttccttttcnaccctnggggntctgtncngtccttccttttgccctttncccggggataattccccccttcttttaattnggatttctaaccccg

SEQ ID NO: 95150 - DNA, 315 bp, Triticum aestivum
  unsure (1)..(315): unsure at all n locations
  Clone ID: PAT_TA_95150
aggcatatgtgtccctgtctcccctctccttcctcctctccttttttcccctctcntttnccctctcacaaagagaaaanaancgcccanaaatctccccaangtgngggtttnacccataaaagggggggaaatncaaaaggggggcgccnaaacccnaanncccaaattttgntgnttnaaaaaaataaanggggccggggaaaaacccccccccaaaggggaanaaaanggggaaaaanggcccggaanaggaccccaaaaaaaccccaaaangggnnccccccgnttttnttccnttttttaagggggngg

SEQ ID NO: 95151 - DNA, 324 bp, Triticum aestivum
  unsure (1)..(324): unsure at all n locations
  Clone ID: PAT_TA_95151
ggcataaccatatctgtcacattaccaacaacatacagatctcgcatcgcgatacatacaatcttaccatatctgtcacattaccaacaacatacagatctcgcatcgccgtgaccgtcatttttgttttgttctttttaatttatcctccctctgtagtatccccgcactaatctgtgtttactangcttcttgggtaggattctgttgtacccccctccgtgttgggctattcagtgtntatatgattagctcttgtaaagttgcttgtgtaatgtgatancatcagctcctaagtccccgtccattgttgctttgaataaa

SEQ ID NO: 95152 - DNA, 393 bp, Triticum aestivum
  unsure (1)..(393): unsure at all n locations
  Clone ID: PAT_TA_95152
tgcctctgcccggcgaggggcggcgcgatgaagcgcacgatggacgcgcggtgggcgcacatcgtgtacgcgttgttggtgccggaggcgttcttccgcgaccccgacggccgcgacggcgtcgcctctcnctctctccgccgccctctcgctatctccgcggncacgctgctttctctgcccggcgaggggcggcgctatgaagcacacgacgaacgcgcggtgggcgcacatcgtgtgcgcgctgctggtgccagacgtgttcttccgcgaccccgacgaccacgacggcgtcgactgcttnagctatctcgctctcttcgctgccctctgggtctctccgcnagcgtcaccgccacgtcatcttcaccgttgtcancactcccntnaatc

SEQ ID NO: 95153 - DNA, 228 bp, Triticum aestivum
  unsure (1)..(228): unsure at all n locations
  Clone ID: PAT_TA_95153
ggcataagaagaactagtctcgagtttttttttttttttttttttttttttttttgaagagaacatacttcatgccgtgctcattaatatgcacacagggttatcaaaaatacaaagaatcatacttcaatgccaacatactgaaaaatgagaaatacagcctaagtgacacaaacttgaacatacnatttccttcttttgggtttccnaaccctgancaaanatggg

SEQ ID NO: 95154 - DNA, 402 bp, Triticum aestivum
  unsure (1)..(402): unsure at all n locations
  Clone ID: PAT_TA_95154
ggcatagtcgaacacttggccggcatgaagcccaggcctaccggattcggggccgcggcggcggcggcggcggaagttttggtggggggcggatgcggtggatgggcgtggaggccgaggccgangccggcgacggtggcctccaccgcggcgatgtcngtgagggggcctggtactacccaggcggccgcggcggcaagcgccgtgcactcnggacgccaccgccggcggggtgcacgggctgcactccctccgctgcngctgcattcaaccgccgacctngaagcgccgatncnagaagtgatnctacnctgccgcttcatgacttcctccgccaacgccggtccgctcaatcggtccctcccctgcttcctcaaagtcattttaaccccccccctcnag

SEQ ID NO: 95155 - DNA, 606 bp, Triticum aestivum
  unsure (1)..(606): unsure at all n locations
  Clone ID: PAT_TA_95155
gtggtttggttttgatttcaggtgcagctctggccggggcacgcgcgcgcctccccggcggggggccgccgcagtcggtggactacggcggcggccaggcatccgacagcagcggaactgctgatgatcttcctccaccatatccaagcaataggggtattagaggcagtgggacgtgtcagtggtaatggaagagctattgttccctgctgggtcatacactagacccatactgatatggcaacacaaatcccatccatcttggaacaagaacatattgctccgtcttccgtgcattttaaaccccatcctgacgccattacattgggagaaagaagtcnccataacagaacttccggaaagactnagggtatctgatgttgaccacaggaactactaacnggnccaacattgatgatattaccctntcaaaaggaatggnattacaagagggctcnacatttacccatatgccaacctatcatatntacgcctaccctacactcngcctttanagaaaaaaccancntccncctgctgacgccctgttatcatcnacatggttaaaggcacanactcacactaaaaggactccagacaagnaaa

SEQ ID NO: 95156 - DNA, 289 bp, Triticum aestivum
  unsure (1)..(289): unsure at all n locations
  Clone ID: PAT_TA_95156
ggcatagttcaagtcacagaggcacttctccgagaggtttttcagagtactggtttagttgaaggatgcaagcttatacgaaaaganaaagtcatcntanggctttgttgaactaactatggaccgcagattaagctgcattatcattttngacaacttaatggaaaccaaatttttgggcagcttaccaaanttaattgggcaaatccaattggnnaaaagggaggncncaccagncnattncaaaattttggtggngagntcttaccccaanaggttacngattccg

SEQ ID NO: 95157 - DNA, 332 bp, Triticum aestivum
  unsure (1)..(332): unsure at all n locations
  Clone ID: PAT_TA_95157
cccgccgccggtgaacgccctctgcaangactatcaccggnccctctgcttcggcgctccccggccgcccccggccctctgcctantcgccagggacgtggtgctcctcgcctgctccagccagccccccgcgccggctctggcggtctgctccgacctctctcggtggtgctcgcctgctcggccggactctgccacccangacttcccgtgaacaaatagcaagctagctgggacacatttaatttcctaagaaagtcctgcctgcccccttttgttctgctgatcagtgtatgatgaaattgaattgtaattggcctgaaaaaaaacaa

SEQ ID NO: 95158 - DNA, 169 bp, Triticum aestivum
  unsure (1)..(169): unsure at all n locations
  Clone ID: PAT_TA_95158
ggcatacgccaacgccatagccgccgaggttgangtgagccaccgagaagggagagagaagcgcgccgagatgtncggcganggangaaganaangcgcngaagtnaagattgggggaataattnntnaaaggcaacttcctgatnaactgcnangtggcnataancct

SEQ ID NO: 95159 - DNA, 475 bp, Triticum aestivum
  unsure (1)..(475): unsure at all n locations
  Clone ID: PAT_TA_95159
aatgttcgaagccggcacttgcaccttttattcctgtataattaaagataatgtataaatagaaccaagaccatttgttggttgcgagcacggagggaccaggcaccactagtggtggcggtgcgtcagttagtatagcaggtggagtcacaagggtaggggcagtccgtcttctggaacccgctgcggccgtagaaccagtccccaaccgcgtccgctattcttctgtctccgagcgccggggaagcgggcgcgaaccagatgtcctgcacctcggactggcagtgcgcgaagcacgagttgacgaacagccctctgggtnccngtggacgactcccccccaagacctccaangaaatcgtccctgaacccctgcaaggtctcnagctgctccgcggacactgggttattcctcccggaannttcgcaacccannattgggaccccccggcacaanatgtncntacggccataa

SEQ ID NO: 95160 - DNA, 515 bp, Triticum aestivum
  unsure (1)..(515): unsure at all n locations
  Clone ID: PAT_TA_95160
cataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacgggctgcatgtcaactggaccacacttcaaccctgctggcaatttcaatggggacaagaaaagnaatcccccannctggggattcttggggaatggtganaactggggccgattgngtttncaanacaangttaacngacngcaaatccccttaanggggcaaatcaattttggcgtncgttttcctncacggngaccccgatatttttgaanggnggcanaccttccaaacactgaacctgngcctttncttgcgga

SEQ ID NO: 95161 - DNA, 600 bp, Triticum aestivum
  unsure (1)..(600): unsure at all n locations
  Clone ID: PAT_TA_95161
ggcataaaaaaaacgtggcctttttctcctcttcttcctccgcctcggccggcgactcctcgccgccgtcgtaaccgcgtcctccctctctctctctctctcccgaacccggaaacttctggaagcttctagaagcccagcccagcgcggcgcggcgcacgatgtgcgggatcttcgcgtactcaactacaatgtgtcccgggagcgccgctacatcctcgaagtcctcttcaatggctccgccgcctcgaattaccgcggntacnatcctcccggatcgccgttgacgccgacttccctccctgcgttcttcttcttcttccnaagggcggtgcccgcctatgcccggggcttccccgctggtgttcccgccaaggaagggaaatntagacctcntacattcnncantcccangtttatgaaaagatntnaacctgacccgcctttaagtncatgctggattgccanacaaagtggcaccatggtgtnctgcccaaggaaacancccaatttcggggccggnatattttggcnncaaaagggncanaaaatacagtnngaanaaataancgaaggttacttgntngaacgaanaaattn

SEQ ID NO: 95162 - DNA, 299 bp, Triticum aestivum
  unsure (1)..(299): unsure at all n locations
  Clone ID: PAT_TA_95162
ggcatagtcgagctgagagtgatcgatctttgttagctagagtgttgagcaatggcgtccaagctgggtatggttgtgctactgatctcgggcctctttgctgcccgttgcgcggccgtggtgaccaccggcgaacccgtcgtcgccggcctctcctgcgggttctatgacacgtcgtgcccgtcggtgganggcatcgtgangtggcacgtcaccgangccctcgcccgcgacatcggcatcgccgccggctcgtccgnatcttcntcannaatgcttccgcaggggtgcgaaccntc

SEQ ID NO: 95163 - DNA, 432 bp, Triticum aestivum
  unsure (1)..(432): unsure at all n locations
  Clone ID: PAT_TA_95163
ggcatacttggctcttcactctccccctgttcctgcaggggtcaggcactgcctgctacaagagtggtgtaggtgattcggctagctcagcgcgaagatgggggagatcaccaatgtcacggagtaccaggccatcgcgaagcagaagcttccgaagatgatctacgactactatgcatctggggccgaggacgagtgggactctccaggagaacanggaggcttcgccagntcctgtttcgcccacgcatactgatcgacgtatccaagattgacatggcaanaaaatcntggggtcnaaatttcaatgccaattannattgcccctcgggcaatgcanaaatggtcacccnaatgggaaattnncaactgcgcctgctgcatnaacaacggnacaaaagngacnttccacanggnttttcaanctttaga

SEQ ID NO: 95164 - DNA, 556 bp, Triticum aestivum
  unsure (1)..(556): unsure at all n locations
  Clone ID: PAT_TA_95164
ctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtgggacattggagccaatccctctgctgagggtggtggtgatgatgagggtgttgaatgaccaaggccgtnnaaggtgggttgacattgttgacaccttccgtcttcaaggagcaacctgcttttgacaagaacatttacctcccanatgaaccgctacatcaagaactctctgccaacttnnaaggggatgacctaaagctttcaaanaagatgttgatcccccanaaatacttccttacaactcaagacttcattcttngttggcaaacatcatatatggggctggggtccccnacananggaggactcgttnaattccnggnctttgcaaanggctaaanagcaattgcaac

SEQ ID NO: 95165 - DNA, 473 bp, Triticum aestivum
  unsure (1)..(473): unsure at all n locations
  Clone ID: PAT_TA_95165
cggttacctctctctctctctctctctctcctcttctcgtcgccctaatccccaatccaaaacgaatccccaatctcgtccgcgccgccgctcgccgtggcctcccccgtgcgccgcccgccgcttcgcatcccggtgagaagaaaagagaggaggggaaatggagatacagtcatcagggaggccaaatcgatgtgctcaatggagaaggttttgtcaagtgaacatcctctcctcggactacttcaaaggagctctaacaggctgaaagacttaccaacgaagtcattggatgagatctacaatcangttgaccacgntatagccatgggatgaccgggcaactgccgcnggcctcccaacgccttcngcctcctncnanaattccttaacaatnaactcaacggttaaacanatgcacggctgctngaacacctgactcnccttaaatcaaactgttgggtttcttaacc

SEQ ID NO: 95166 - DNA, 600 bp, Triticum aestivum
  unsure (1)..(600): unsure at all n locations
  Clone ID: PAT_TA_95166
tcgccgccgcaatccgctcgccggaggcggactcgccggcgtcggacgctgcctgcgccgagggcgctgctgcatttgtttgcctgtggctcgggggaagagcgagcggccgtgtgggcttgctctgctcgagggccgcgttcgcgtggtttctctcctcgtgtgggttgctagattaagcaggtggcctttttgctatcacaatttatcaatatccgggttacaatggaatgagtgtgcgagtttggttgccgggaaacattgtttgacgaacaaatgggtactaatgatcctggnacgccgtccaaaggcaacaaaggatcaagaaccggacatctccaaccactacatctggcactacagtccaatttaaccctgaangcctggttttaaagnctatccggaattcaccgaagggtcttccacccctggttgctgaattcccaagtcannccctaaagtngggagtcanccaagggcacttacngaacacacctaaagannccccaagantttatnaacctcaaccnggntgaccattaacacacccaagntggnaatgaagtnaatgcggacgacaagnctcaaattangaaaatg

SEQ ID NO: 95167 - DNA, 599 bp, Triticum aestivum
  unsure (1)..(599): unsure at all n locations
  Clone ID: PAT_TA_95167
ggcatacgacggtggaggtggaggacgctcgcctgcctccacccgccatggccttctgctccccgggcaccacggcgacggccatgggcatggagttcatgcgcaggaacgacggcagcatcgtcggcatcgaccacaccggccgcgccgtcctctacgaccccgccgcgcgcgccgtccgcacgctgcccgccctccgcggcgcccaagctcatgcccgtctcggccgccgtcggcgacgacctgtacgtcatggagacgacgcccctccccggacggcgcccggtgcntccnangcgctccgtacgcctccnangatatcccgccgatccgactcccgacaagttggaagttaggggacaactacttcttggaaccctgccgccgccgccgcngcggctccccgttccttgangcctacccgccggttnnaagncctccngcggatattncggtacccgtgggccgggacggaaggnggaccccatctngtaccacaanacaacggactatccttnnaacggcanncccctganaaggcgnaacggaatgcctcgnggnaacnacattcccaaaaggtnggtngattcnaatgttaa

SEQ ID NO: 95168 - DNA, 177 bp, Triticum aestivum
  unsure (1)..(177): unsure at all n locations
  Clone ID: PAT_TA_95168
ggcatacccaaccgccgccgcatcnccctcgttagaacgatggncgcgtcggngctgcaccagaccaccagcttcctcggcancgcccctcgccgggatgaagctcgtccgccncgtcctggnaatccggtnggcncatcaccattcggcccaacgtnaaagaacgnggcccaaaaa

SEQ ID NO: 95169 - DNA, 592 bp, Triticum aestivum
  unsure (1)..(592): unsure at all n locations
  Clone ID: PAT_TA_95169
ggcatacggttctcgcctctctctctctctctcctcttcaattctctctctacctccgctgcggagctcgccgcgtagcaatggaggcgggcgtggggctggcgctgcagtcgcgggcggcggggttcggcggctccgaccgccgccggagcgcgctctacggcggcgaaggggcgggcgcggatcgggagcttgagggtcgctgagccggcggtggcgaaaggccgctgtgtgggctcgcgggtccaagccggtcgccccgctccgtgccaagaaatcgtcccggaggtcatgaaacattgcataactccggttnatgaaccctccttgcctaaagagaaaacaagaagaattctcctcctatttgnaatggacgtgtatttacccaattggnatgatgggttctggaaaaatacgtgggaaaanattccgaatttgggtattcgtccttgataatgataatgnccaaaaactttggatgcttnatcgtnaattcaagtaatatgacctcttaagganataaatattcttangatttctcaanaacataatgtgcaacgagngtctntnccacattactgaataataaagg

SEQ ID NO: 95170 - DNA, 420 bp, Triticum aestivum
  unsure (1)..(420): unsure at all n locations
  Clone ID: PAT_TA_95170
atcaattatattactgcattattatcgattagcagctagctaggaggagctagctagtggagtaattaacattgtacaaggtagaaattaattaagatgggtgcagtgagcagaagcggccgcgcagtggccgtcctgcagcttgtctccaccgtcgtcctcctcctctcgccaccaccagcagctgcatctcgccgtgacatgtctgtggacttccacgctgcgtcgtgcccgcagctggagaccatcgtgcgctccgccgtgcatgcggcgctccagcgggagatcgccctccgccgccggtctcctccgcatcttcgtccacnnactgcttcccacaacgggtgcgacncgtcggtatatctgantgccaancaaccncaacacggagcagttccccaggaccaacgagacctcagc

SEQ ID NO: 95171 - DNA, 372 bp, Triticum aestivum
  unsure (1)..(372): unsure at all n locations
  Clone ID: PAT_TA_95171
ggcataccaaatctctcgatctcccantcgagcgagatgaagctctccatccagtcattcgcccgcaagctctccctcccgtcgccgaagcggacgtggagcagcggcggcggaagcantaanagggatggtggcatgtccaagaacgggagcggcgtgaagcgggccatctcccgcancnaggcgtcgtcgttcgcgtcggcgtcgtcggagtcngagtcgtcctcggacgacgcgctgatggcgaggtcnacaccgangtcggtgctccccgcggagatctcgcggcgggagctggaggccgtgctccggcggctctggcacggggagcccgacgacgacgagctgngacgccgtcttgccatcaccgcc

SEQ ID NO: 95172 - DNA, 227 bp, Triticum aestivum
  Clone ID: PAT_TA_95172
ggcatagagagaactagtctcgagttttttttttttttttttttgacgaattaactgtttctcttaggaccaatgaaggctcacaagtgtcaaacacagctaaaatcaagaatgaattttacatgatggcataaacaacacacggccggtggatgcagaaacgtagcaatgtactcaggcagcccctgctctccagttaattatatttgaagttttaatactagtac

SEQ ID NO: 95173 - DNA, 594 bp, Triticum aestivum
  unsure (1)..(594): unsure at all n locations
  Clone ID: PAT_TA_95173
ggcatacacaaaggcactctctcttcttctctttctactagctgagtgccaagcttatggaaagagtggtagagtaatcagaaggagatcagataagggcatagagagagtcagagagaggtggatctatagatagctactgctctgctgctgctattaagtcagtctgtgctacgatcgaggagatgatgggagcagcggtgaccatggtggatcggcgcatggcgttcgcggcggaggccgacgttgatagcaaggccgcctttggattcctcggangcgaatgcttcctccggcgaaggcgacctggtcaacccggcccgccgccgccgcaacagcaacaagtgcacgaaggcggattncccncngaggacgagacgacggcgacgacgacgacgacgacgacgacactnggacnaatcnaggactggacnccccatttncncacgcntcngganaagcgtcaaaganttaacaccncggnngaaaaacccgccgggnanccnggcggggaggaagaanaaggcatnccagacaagccngcgaaaaattcccggccaagacggntccaatnatccaaatatgngttcaccc

SEQ ID NO: 95174 - DNA, 545 bp, Triticum aestivum
  unsure (1)..(545): unsure at all n locations
  Clone ID: PAT_TA_95174
ggcatagccgtgtttacaaggtccagagtggtgattgtgttctggtccacgctgctgccggtggggttggatcactcctttgtcaatgggcaaatgcccttggtgccactgtcatcgggactgtttcaaatgaggagaaggctgcacaggcagctgaagatggatgccaccatgtcatcatttacacaaaggaagatgttgtcacaagagtcaaggagttcacagctgggaaaggtgtcaatgtggtatatgattctgttggcaaggatacatacaagggtccgtggaatgcttggcgtngcgttggtatctggtgtcctttggggcatcntcaagtaagcctgattccatccgctgaccatntggcaagcaatcnctttgggtaacaagccacccnatcatacactgctaccgccacaattgctggatcccgccngtnagtgttngcaatgttagagcggtttncncatcgtntnaacanacatnccatttctcaacgctncntcatcgttccangcangaaacacggttaaccnccanccaaa

SEQ ID NO: 95175 - DNA, 588 bp, Triticum aestivum
  unsure (1)..(588): unsure at all n locations
  Clone ID: PAT_TA_95175
ggcatactcaggcaggcaatcagcggcgaggcaccagcccaccggccggcaatggcgtccacctcctgcttcctccaccagtccacggcccgcgtcgccgcgcgcgtcgcctccccgtccccggcgacacggacccacctcctcgtctgccgcgcccagaagcaggacgacgccgacgtctcccgccgcgcggcgctcgcgctgctggccggagcgacggcggcggtgggggtgaaggtggcgcccgccgccgcggcctacggcgaggcggcgaacgtgttccgggaanccaaagacgaacacggattcatccgcctaacagcggcgangggttcaagctgctgatccctcccaaatnggaccccnacaaaggangcganttccccggacagcctcccgcttacgaagacaactttgacccaacanaactctcctnnatancaacccaacaaccaanagacanaacgatttggtcccccnagattctcccnattcaatnntgctgggaaacagctatccggaanaaatcccaggggttnatcgacccggggnaaggganatctgaaaccggccgtntggangaaatan

SEQ ID NO: 95176 - DNA, 489 bp, Triticum aestivum
  unsure (1)..(489): unsure at all n locations
  Clone ID: PAT_TA_95176
gccatagacatcagttcaagccgccggcgtgtgtggcccagaagaacatcgctgcgctgtacggcgaggcgaagccatggcgcccctttcggtgtcggccatcctcgcgccgtcgccgccgccagcccaggcggccgcaagggcctcgccgcgccgcgcgccagcgagcgccgcgcctgtcgccgccgccatttcgacggcattgcttgctttgactcctgccgcgcacgccgcggcgttctccaaggaggacgtcgccggtcccgtngaccaaagtggtggacacngtggaccagtcatccggcgtcngcggcaaagtggccgagcatccgccngcgtgctcaaaagcgcctgggccaagccgcgaaccggcctgcctgcgctgaaagacgccgcganaagcctgaactcgctcncccgttgctccgggctccaanaaccacggagcgtccaagggcnggtcaccgcccctttncgcngcnaactttc

SEQ ID NO: 95177 - DNA, 467 bp, Triticum aestivum
  unsure (1)..(467): unsure at all n locations
  Clone ID: PAT_TA_95177
ggcatagataatctgccagattatccaggccatgctccttccatcatcagtcgtgccactcttccgtgttgcctcatcaagattgataatgggtgcccacagagtgtctttgcatctggagatattaacatttcttgcatttctcctcatgctgttttcgaatatcatctttatggcagaaatgctgtttgggtgacagtggttggctgaacactctgaaagggaatactgggaaccctgtggtgtttccatctacggttctcatcacggtgggctttgtgtctctgttgcattttcactcctacatggctgttacaccaactgaaacaaggaagcatgaactgaattgcaacaagaaggcctgtgccttctcaaaaaantcctggaatactactcnaagacagagaaaaacttnttgcngnaatgttacctaagaggaatnagaatnnaagttgccctccccctaa

SEQ ID NO: 95178 - DNA, 570 bp, Triticum aestivum
  unsure (1)..(570): unsure at all n locations
  Clone ID: PAT_TA_95178
ggcatagtaagctaagctactgagctaactcagcttagctaagcttagctagagctcaagtgattaagcaagaacacttagttactcatagataattaattaattaagatttgtgagattaccatggcttcgaggagtagctggcattgctgcttgctggccttcttcctcctctcgtccgccgccggcgccgcctacgggcagcagctgtcgacgacgttctacgcggcgagctgcccgacgctgcaggtggtggtgcgcgccaccgtgctcggcgcgctcctccgcccgagcggcggatggncgcgtccctcgtcaggtcctcctcccacgacgcttcngtccaagntgcgaccctccacctcctcngacgactncccggcgacgacttcgtcngcgagaaacgcttcccaactcaatccgtccngcggtacactcatcacaaattaancaantcantcctctccccgntctctctgcccganctccctcgccgcccgcgaagacgcctgtcggngncaactggcgnccctgggcggggancacacgnactancngggaananactcg

SEQ ID NO: 95179 - DNA, 379 bp, Triticum aestivum
  unsure (1)..(379): unsure at all n locations
  Clone ID: PAT_TA_95179
ctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctccgtggcgacggcggccgtnggccgttggccgcggcgccgctaccggcgctggcggagcaagatggagaaagcggcgctgttcgacttcnaacctgacntccccgctgatngcgaccgattcctgctgctgatggtgggccctggacaantctactttaagcccgctgggncaattccaatggacaacgcaaccc

SEQ ID NO: 95180 - DNA, 430 bp, Triticum aestivum
  unsure (1)..(430): unsure at all n locations
  Clone ID: PAT_TA_95180
ggcatagaggaggggagggaggcattaatggagccctctaccaagcagctcctccccatgcctcagcaagaccccaactcgccgtcgtcttccacctcgtcgtcgtcgtcgtcctccacctcgccgtctcacccgcaccaccgtgcaccacttccaccgtcncctaggcccgtcccccgcaccatcganaccacccccttccccancaccttcgtgcaggccgacaccncctccttcaatcaggtcgtgcagatgctcaccggcgccnagcaaccctccaanaacnccnccacagcatcgacagcgntcgcggggaacatcaacgccctcatggattggtggntgtatgnggcaaactggcgtnccgttccaaataancngntttcaaactttacgagcggnngagcaactcaanaactcaagatgtttc

SEQ ID NO: 95181 - DNA, 526 bp, Triticum aestivum
  unsure (1)..(526): unsure at all n locations
  Clone ID: PAT_TA_95181
ggcatatgattccgccatcagatctaggcgagagccatgaacggcggcgacgcggcggcggcggcggcgacgccgagccaccggcggctgccggacttcctccagagcgtgaacctcaagtacgtgaagctggggtaccactacctcatcacccacctcctcacgctcttgctgctgccgctcatggccgtcatcgtcctccgaggccggccgcaccgaccccgacgatctccgccagctctggctccacctccaagtacaacctccgtctccgtcctcgtcctctccgccgtcctcgtcctcnggcgcaccgtctactcctcaccgcccacncccgtctactcgtcgactcgccctgctacagcgccccgacaantcaagnccncttcnacgattctccacatccnaancggtgcggtctccnganactccncnattcaannaaatctcnacgnctggctcaaggagaactatcccccaggaatnactaacccgccggacaacaangnatccncccnaggggtct

SEQ ID NO: 95182 - DNA, 473 bp, Triticum aestivum
  unsure (1)..(473): unsure at all n locations
  Clone ID: PAT_TA_95182
ggcataagcctcctccactgctcccaacctgccttccgtcgccgccgcctaccctcgactactgatctacctttctccgtcggcggccgcgggtgcccagcgcaaccgcaccctctcctctccagcagcggcgacccctcgcctcataccctttcctgggcaaggccgggaggggatcaatctanggtttccgccgccgcctgttcctcggacgtcgctgcatgacgatggaagatggaanctgtccttcaccagtcacccccannggaagccgaanctggagccgaagattacnaatcttgngacactgaancagaagcttnaggatccgtcaactgtgatcntatccaaggtatcatntcaaaaaaatcntaaatataagcatattnnnaggaaaattccaaggagaattaattagtacttcgtttggtattgccgaaactnntcagcnatncnaaggaangtcaaccatc

SEQ ID NO: 95183 - DNA, 588 bp, Triticum aestivum
  unsure (1)..(588): unsure at all n locations
  Clone ID: PAT_TA_95183
gacaaagatcctggcaactccagctgataagctatctctcctctacgctccaagatcttgtaaggccccacaaaacgtggtgctaacttacctttgattccaaacctcttaattccacagagtggtgaaactctaagatatgcacggtctcctacctcatatgtcacctccttacgttttgcatctgcataactcttctctctggactgtgctatcttcagcctgtcacgaatcaacttgaccttctcctcagcatccttgatcaagtctggtccaaagaactgacgttctccaactcatcccacatcaacggtgtcctgcacttcctaccatacaatacctcaaatggtgcatcttcagactagcctgagaacggttattataaganaatttggcatangntaattatcncccaactggaccataatccaaagcacantctcaacatatccccaaaactcattacctctcgtcnccatcgtcntggagggaactgtacgaanccaccnggnccaaggtccannaacgaanccaaattggtngaacggtncccaaaaaaaaantcttganccanncaaaaaatttaaa

SEQ ID NO: 95184 - DNA, 458 bp, Triticum aestivum
  unsure (1)..(458): unsure at all n locations
  Clone ID: PAT_TA_95184
ggcatacgatcaccgcggccaccgccgccgccgccgccacgccccacccgtggcaggccgacgcctcgccgcgtcgccacgccgcgtgccccgctctccgcgggaggaggcgcctccccgtcgtcaggtgccagtcgtccagcgtcgacgacaagcccaagtccaagcggggcctgctcgacaacgccagcaacctgctcaacaacctgctcaaccggcgggagctcgggcgcgatgcccgncccgaanggcgccgtnancgactctncgccggcatccttctnctcgctctacgactggtccctccnacatggtctgtnttcaaatccgctttttggnccccaagnatttttttgttnccnccattcaattttgcaaacatnccttggganaaatgtttcggtatataaggattcttgcgaattttaaaccataagggaaagncctaactgctactt

SEQ ID NO: 95185 - DNA, 496 bp, Triticum aestivum
  unsure (1)..(496): unsure at all n locations
  Clone ID: PAT_TA_95185
atggctagcttggaagcccaagcagcggagcgggtgatcgaagcgtgcgtgaggacggaatccgtcaggaagtgcgtcttcacctcgtccttgctggcctgcgtgtggtggcagaaccatcctaatgaaagacggggcccgaccatcctgggacgagaactgctggagcgacgagagcttctgccgcaacaacaactatggtttgcacttggggaagacagcggcagagaaggcggctggagggcggcccnggggaagagacctcaantcctcaccgtctgccccngctggcacngggccgggtttcnccgccgcaactcctacgcatccatngctacctcaaagtnctggtgtccagctccccngatgctccctgncgacgnnaaacttgnacggtgccnagccactcccgggttttacaaggcnatgggcacacacggccgnggaanaacctcacacantnttcgggnaccagatnccccactngacggaccgg

SEQ ID NO: 95186 - DNA, 397 bp, Triticum aestivum
  unsure (1)..(397): unsure at all n locations
  Clone ID: PAT_TA_95186
ggcatactcctctcttctctccttggctcagcttgacatcgtcggagcagcagaaaagtttgctcgatcgagctagctaactaggtcgtcggatcagtgataaatcgttcgccgatggatccgtggattagcacccagccttcgctgagcctggacctccgcgtcgggctgccggcgacggcggccgtcgccatggttaagcccaaggtgctcntcnaggaaggacttctttcaccaggcagcctctcaaagaaagacccaanaggttncggcctggaggcgggagctnaancggatgggcncggaaaaacngggaaancnaccagaacctggcggnngntgcggccaattnncaagggcnngaaacccnttaanganatngcaccgcacagagntg

SEQ ID NO: 95187 - DNA, 432 bp, Triticum aestivum
  unsure (1)..(432): unsure at all n locations
  Clone ID: PAT_TA_95187
ggactccctgccggactccgaacctcccgcgcctctgccaatcgaatccgattgggcaccgatcatggagttcaccgctgcggacatctttcagcactcgccctttggcgacatcctaaatttgctaaagcatctctcgctatccggagagccctggccggactacggccaggatggttgggatgcngacgacnaagaaattcaaagcccacccaccgcccactttgtagccactatcggacgatntaaccgacatgctagactatgactcccgaaagacatccgacggtatggacgactatgccgggagacgatnaagaaccagcgcctacangacactggaagacacttcctcatanganatatacatggtggacacccanaaagatggggacggtgnagaacagcagagcanattccttaangaacagc

SEQ ID NO: 95188 - DNA, 309 bp, Triticum aestivum
  unsure (1)..(309): unsure at all n locations
  Clone ID: PAT_TA_95188
gagaagacnacatctcgatcacaggccatggccatgggtgaggaggccgcggccacggtcaccgcggcggcgacgttgtctgcgccccacctgctcatcatatgcaacccgtcgcanggcaacatcaaccccatgctgcgcctgggcaagcgcctcgcggccaaaggtctcttggtgaccttctcatcgaccgccgatgttggagccaagatcacggcttcctcccggggtggaagatggcggcgacggcgtgccgctcggcctttgggcgcatccggttcgattcctaagacacatcnacganagggt

SEQ ID NO: 95189 - DNA, 446 bp, Triticum aestivum
  unsure (1)..(446): unsure at all n locations
  Clone ID: PAT_TA_95189
ggcatagttcgatctttgctttcatcaatccaccttgtttgatctctgctctgagttctgaagaaactgtggtcgatcggcgatcggatcgatcgggatcgatgtcgagcctggtagacatttggacggtggaacgggagaggatccgggtcagcggcgcgcaggcgttcaggacgacggtggcttcgaagcgaggctgcacggctccgttctgacgacggccaagaacaagcctgacggcgcggccgtnggaaacngctgcccaagaaccagcangccgctgcccgtttgggtggnccccnggcgagcgtgattccaagaagaccttnctggtcnacctgatccatgcttccggccatnnagtagcctaacttggcgnttacagnatccccccatcctaaatactacnaaccttnaactatgaacctnaccgggtgattcccacg

SEQ ID NO: 95190 - DNA, 423 bp, Triticum aestivum
  unsure (1)..(423): unsure at all n locations
  Clone ID: PAT_TA_95190
ggcatactctgaattgtgggcctgaggcgatggcggcgctcgccccgtccaagatgctcggcacccggctcaacttcgccggctcctcccgctacgccaccgcggcaccgaccaccggagcgcacaanatcgtctccctcttcagcaagaagcccgccccgaagcccaagcccgccgccgtcacctcctcgagccccgacatcggcgatganctcgccaagtggtacggccctgacaggaggatcttcttgccggagggtctcctggaccgctcaaaagtncggactacctcaacggagagtcccgnaanactacggntacgancntttnggctcagcangaaggcanaagactntcaantacangcctatgaactgntcaggcagnnggcnatgctccncgcngctggtaatatcccctagg

SEQ ID NO: 95191 - DNA, 632 bp, Triticum aestivum
  unsure (1)..(632): unsure at all n locations
  Clone ID: PAT_TA_95191
ctgggagccgcacggccgcaacccaccaccactcccgaagcttctctcatggcggccatggccgcggcggcgaagctcacggcggccgcctcctctctcctcctccggcgctcacccttgctgcggcctcacggtctccgactctcccgccgcttcgctccccaaagatttgtgcgccacattgcttcatcgacaaatgaagaagctgctgctaaagcagcagcagcaacagctgatactggaggaccgaccatttttgacaagatcattgcaaaggaaatccttcgaatgttgtctatgangatgagaaagtgctggcatttagagatattaatccacaacccctgtgcatttccaatcatcccaaaagataagagatgggttnactnggactagacaagntgaaccaagcattctaaatnctgggctacctccnatacgccgcaaaatatggtnagaaggaagtntactnaaggtacgtttctcaanaacaangactaaggagtancatcancacctgaattcagtanaggggagganataaatgctctggnatacaatggatctngtcnaaggcnaatcctgtgnaaaatgangtnatnaaccntnggaagggttttncacgnaatntt

SEQ ID NO: 95192 - DNA, 594 bp, Triticum aestivum
  unsure (1)..(594): unsure at all n locations
  Clone ID: PAT_TA_95192
ggcatacgtctcctcgcccgccgccctcgactcccgtctcctcgcctgccgctggcgccgatctccatcctgctagcagaggtggcgccggcgtcctcctcctgctcccgccgcattcgctcaccggtgagcatcctaatccatcccatccggcctcggcctcggcctcgaatttcgtctcctcacccgccgcttgcgccgatccccatcctgcgagcagaggtggcgcccggcgtcctccttctacttccaccgcatcgtcgctcgccgccactgccatttgnaggccacacagcgttggcccaccagtcggtctanatcggtacaaatggctagaagtctgtnnataaancgctccccatttggcccctnccattccgtccgatttggcacgtctctccgtctcnntgcttccgctgctctccggcngccgcgtcgantacggaaaacctaaacccggganaaaccgggaccangggagacacnaaggatagggcaaaancctnggccnctngggcgccgtntcgggcnggtantggtcctccatgngctgcgcccataatcaaacactnttcaacncctaaaaagcanggg

SEQ ID NO: 95193 - DNA, 155 bp, Triticum aestivum
  unsure (1)..(155): unsure at all n locations
  Clone ID: PAT_TA_95193
ccngccntcacatncggcnanattntgtggcttagataaagaatcaagtttacntctgatctggaagttgcttttgctactcncngaagatccaactgtttanaaggcantgtcacagactattnaactattggcangccanacttcngtcatca

SEQ ID NO: 95194 - DNA, 310 bp, Triticum aestivum
  unsure (1)..(310): unsure at all n locations
  Clone ID: PAT_TA_95194
ggcatactcgcttgggatgagagccccctcctctccatggcctcctccctcctcctgcctcgcgccaccttcgccgccaccaccaancacatcgccgtcctccacccgcccgtcgcatccgcctgcaggccccacccgcccaggctgatcaggtgcggcgccgccgccgtcncggacgacgagctcctccgctcgctctacctcgtgcaggccgaanccgcgtctccggtggtgtccgcggacacngggcaatgatggttgggncgctctccttgacgagatcaggggctccctccaggcngaggacctt

SEQ ID NO: 95195 - DNA, 266 bp, Triticum aestivum
  unsure (1)..(266): unsure at all n locations
  Clone ID: PAT_TA_95195
actcctccattttagcgatctcgacttaggttgtctcgaagcctggcttcanattgctgttgcaccagggattgaggaactcaccctgatgtttccttgcgtaagatacaaattcccatgctcgctcttatttgaaagaggtggnaactcngttcgatatcttcacctcatgggctgcaccttcngtcctacaattggtcttggntgcttgacaaaattgacgcanntgcatctgtctttcgtgtgagattantgganatgagtta

SEQ ID NO: 95196 - DNA, 376 bp, Triticum aestivum
  unsure (1)..(376): unsure at all n locations
  Clone ID: PAT_TA_95196
ggcataaaaaaatattataggaaataaaaaataatttcctggttagaataaacacatttttaaaaaaaccaagaaaagattttcctcttctgttacattccttcttccttctccggccaccggagccgtagccgaattgtgcctcttctcgcgnaaanggggaagaangggagagagggggtgttgnagttttgctccntccgggcgaagtgggtctcctccccgcgccggctgaggagatctctcggggacatcgggggttgggggcggcgtncnatgatggggtctccgctnaanccggatnaaagattcccacgnagntttctggngganaccangttcntcctgccacaatattggccgcaacaacggctcc

SEQ ID NO: 95197 - DNA, 518 bp, Triticum aestivum
  unsure (1)..(518): unsure at all n locations
  Clone ID: PAT_TA_95197
ggcatagcctgcgttccccaccccgactgacccagcctccagtagccatgggcaaccgcacgtcgcgccaccaccgcgccgctcccgagcagccgccgccccagcccaagccgaagcctcagccgcagcagcagcagcagcagtggccgangccgcagcagccgaccccgccgccggcggcggcgccgggacgcggcgatngggagggtgctgggggcnggccgatggaggacntcngcgcnacctaaaccttcggggcgcgagctcgggcggggcattcggggtcacctacctcgtcacccacaaggcacggggaacgcttcncctgcaatccatcgccacgccggaactcgcccaccgcgacgacatcgaagacttcgccgggaggtgcattntgcacaacttacgggcancgcaaatctcaactccggggggcctanaggaccccatcngtaactcatnatggactctccaaggcgnantcttcatgcataatnncaagggnatanccaacgccc

SEQ ID NO: 95198 - DNA, 253 bp, Triticum aestivum
  unsure (1)..(253): unsure at all n locations
  Clone ID: PAT_TA_95198
ggcatacgttcgagggggtgagggtgatccacatcaacggctacgtggaggacttcgacgcgccggtgacggtggggcaggtcaccggcaagccggggcggtngganngggtangggcaagggaggtacatgctgtgctcntcggngcacctgctgcatcangnagcggtggccattcanggcggannanccactgttagccnngtactgnttacatcntccnctcgcagtccatcttcaatctactctccnc

SEQ ID NO: 95199 - DNA, 405 bp, Triticum aestivum
  unsure (1)..(405): unsure at all n locations
  Clone ID: PAT_TA_95199
ggcatagctagaggcaacaagaagctgcaggagagggtgcccatccggcgcaccgcgtggaggctcgccgacctcgccatcctcttcctcctcctcgccctcctcctccaccgcgtcctccacgacagcggcgcgccatggcggcgcgccgcgctcgcctgcgaggcgtggttcaccttcatgtggctgctcaacgtgaacnccaagtggagccccgtccgtttcgacacgttccccngagaacctcnccgaaaggatcgacnagctcncggcggtgngacatgttcgtnacgacngcgggaccggtnctnggagccgccgntggtgacngttnaaaccggtgctgtcgcgctcgccctctactaccnggcgccngcganaagctggcntctaagtttcccanac

SEQ ID NO: 95200 - DNA, 317 bp, Triticum aestivum
  unsure (1)..(317): unsure at all n locations
  Clone ID: PAT_TA_95200
ggcatacgccctccgcgtgagcggcagcaagtgttcactgcgttcttcttctcgatttatctttcttggtttcttgatctgtagcttattagcggccatgtgcggcggagcaatcatctccgggttcatcccgccgtcggccgctgcggcggcggcggctgcggcggccaagaagcagcagggcaggagggtcacggccgacgtgctgtggccggggatgtgcggnnaggggaaaggcggcggtcangcgggaggangactttnangccgacttccgcgattcgagcgtggcatacacacgcagggcctantngggc

SEQ ID NO: 95201 - DNA, 602 bp, Triticum aestivum
  unsure (1)..(602): unsure at all n locations
  Clone ID: PAT_TA_95201
ccagcagcagtcacgcacgtctctctctctcgccccgcgtcctccacatggcggcgtccaccacctgccctgctcgctccatggcgtccgtctcccgagccctccgcccgcggccgcacgccgctatcgcctccgccgccgtccgcacggctgctcgtctcgggggcggattggggatcgtttgttcgatgccaagctatggtaggaaggagaaggaagaatggggattgaccattgcgtcccgcaccgggcgaccactgctgctccnggctctgagaactgtcaactattgtncaaggctgaagctaacatatccagtaatctgccangagagcattcctnagtgaaccaaaccagtacgnagaaaatattgagctgcttacatcctttccctgtnngggncatatangtacattatggnactacancaacccaggtaccnggttggaacganntttaacggtggcctangntccnaatgcatcaatgggacaaatgactccgnagattnnggaatcanaggaccaaggatgtgggntggattcttnccatattgtaactagcnggattgcatncatacttnatancgcccctgaatggct

SEQ ID NO: 95202 - DNA, 271 bp, Triticum aestivum
  Clone ID: PAT_TA_95202
ggcataccaaagcaaagcaaaggagagagatcccggagaagaagtttgcgtgcaaggcgatcgatccatgagcctgaggcacatgagccgagtgggcgcgcgcgcggcgcaggccgtgcgggagggcgcggggaggtcggtgaaggacaaggcgcagtcggcgacgacgtcgacgtcgtcggcggcggcgaaggagcagcggcggcggcagcagggcacccgccgccggttccgttggagaaaggcaggtgacgcggcggcggggcgaggg

SEQ ID NO: 95203 - DNA, 565 bp, Triticum aestivum
  unsure (1)..(565): unsure at all n locations
  Clone ID: PAT_TA_95203
ggcatagtgaggatggcattgaggaggctgccgataccgttgattccgtgaaggattcagcaaagcctgaaggcatggatgcaaaggangaggcggtggagcaggagggtggggccgcagcggataaggcaaaggatattcctgtgactagtaacggtaagacggatgctggcggaaatgangtggctgaaatgaangttnaaaaattggagaatggngatnggcatttgaangcggncggcgatancaatggtgataacaanggtgctgatggtgagaaacagcttatgttancgtcagctgggggaagacgtggaggacccggtgcntcnaancttgcaagcaacccctcaanttttattacagctgnngtngtgatgactctcggactgangangacaaggtgcttncaanaangacttnagcgtttnnaaggataacttntggattnaancccccaatnccangngaaaggttnaattctcaaattnggtaaagnacnggttggtgcanatangtaacctgnaatttcggcactggaatcttcaacnccnaantcaaacgt

SEQ ID NO: 95204 - DNA, 180 bp, Triticum aestivum
  unsure (1)..(180): unsure at all n locations
  Clone ID: PAT_TA_95204
tagaccgcgggtgcccgtgatgctgctgcggagcgcgtcctcgccgctgcncaacgcggngcgtgtgccggnggncgcngcggtggaacatgtactgggccacgggcacctcgcggtggcntcaccggcggngcatcacgggccgangcagcanggngcnctgtgncncncattgtcnga

SEQ ID NO: 95205 - DNA, 261 bp, Triticum aestivum
  Clone ID: PAT_TA_95205
gaagcagcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctccgtcaagctctaccgtttcctgggtgaggaggaccaagagcaattcaacgccgtcatcctcaagaggtcttcatgagcaagaccaaccgccgccgtctccatgcgccgctccg

SEQ ID NO: 95206 - DNA, 658 bp, Triticum aestivum
  unsure (1)..(658): unsure at all n locations
  Clone ID: PAT_TA_95206
cgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaagttgttgaggtctccactccaagactggggaagcatggcacncaaatncactttgttgcaattgananctttaatggaaagancttttaggaanncttcctttaatccnnaaantgttaattccccaatgtttaaccgccaanatttcnacngattgnnaaaactgaataatggaantcaacctttcccactgaaaaggggnaacactaagatgactgaacttccaacgaagaanttctgcttggcaaataaaacggtttcttatgnaagactgatctnctgtaantccncangggttaaaaaaanntccctttaagnaaccgtggggaaataacaacttcctgttgctactgcaaaattggaccaagcntcggggnttganaaaataatagnacaaaatngttgggaaaanttttcaaatttggnttttacaaanccaggggcaaaattttncacacacccataaaacn

SEQ ID NO: 95207 - DNA, 646 bp, Triticum aestivum
  unsure (1)..(646): unsure at all n locations
  Clone ID: PAT_TA_95207
gttccttacaaactttcgatagttccccgcgagaccgagaaaaccacgcacctccttgacagtggccggtgttggccattttgccaccgcggcgatgttccgattgtcggtgtggactccgtccccactgatctcatgccccaaatatagcagactcatccgggcgaaagtgcacttgctcagcttgatcttcagttgatgctggtccgaggagttggaaaacctgtctcaagctgctcacaatgttgcttcaagtgtgggcgctatgcactaagatgtcatcaaataaagacaanaccccttgccgtcaactgggggccaatactatttcatcctcnttgggaattgccatccccctggtgaggcatacccaaaanttgaaccaaatgtggcgtggtggtcttgaaacggcttggctaacctccggttnanaaaaccggagattccgccgganntcaaacggggaaactnggacagtantatccangaccacgataacggaaangaacggtttgaatgtacccatgantgcggaatcaaaanaaccatgaaagntttcgnaaanttcatggactncactaaagntaatcaacgcccagggncgacaatcccaaaggccatacccnnngctcttaagcgangaacc

SEQ ID NO: 95208 - DNA, 540 bp, Triticum aestivum
  unsure (1)..(540): unsure at all n locations
  Clone ID: PAT_TA_95208
agggctttagtgcggtccatttcttcacctaacatatcatcacgcttatctagcatgttttgaaccttttccaaggcatgttgttgtttggtgggaatgcaaacaagtttggtatagctaggttcaatatcatcatcagattcatcatcatcagattcacagtcactaaattcagatgaggaacgttcggttacctccgacacctttgccatgagacatgatgcagaagatgatgatctggctccgaaagtaatcgttttggagaatccctttgaatcctcaaaccaaggatcatgacgggttccnatgacttcatanacgtccggaattcngtcccaagataactttgcattgcaaagatgcataatgagccgaattggcnccgggatanacaaggacaaattataccttcnccaagcatcaatccaatgtatttgcaatacatctgattcnccgantncataattaatnngccaacncantgacgncnaaatcncttccctgcaanaagngncctgataaggctccattgggaaacat

SEQ ID NO: 95209 - DNA, 356 bp, Triticum aestivum
  unsure (1)..(356): unsure at all n locations
  Clone ID: PAT_TA_95209
gcgcaccatgtgtaggtacgccattagtgtccatatcactaatggcggaccacaccgatggtacgccactactaacaattttttttacaaaactagaggcgccaccaggggacagtgcgtcattactagttttaactagtaatggcgcaccacacactctatgcgccactattaacaaatttttttttacttttttttttaaaactagtaatggcacaccatggatatntggncgccattactagttttaactagtaatggcgcactgtcccctgggtgcgccactaataacatttnncacatcacaattcaccaaatgcaccccctccccccgttgaccgcttttcatttcaaaa

SEQ ID NO: 95210 - DNA, 193 bp, Triticum aestivum
  Clone ID: PAT_TA_95210
ctctcatatggcaacaggtctgtcactaagcaggagagatcacccctgcttgctggttccaacgagacagatgccctgccagtacctgatcatgcttctgatgcaaagaagtaagctctgtttctttacttgtgttcgggcattttgcttccactgcaaaacggtttaattgtccttgctgttttcaggcctc

SEQ ID NO: 95211 - DNA, 659 bp, Triticum aestivum
  unsure (1)..(659): unsure at all n locations
  Clone ID: PAT_TA_95211
gctgcctccaaggtgtgccactccctcggcgggggcaccggttccaagatcagggagcagtacccgggccggatgatgctcaccttctccgtgttcccatctccaaaggtctctgacacggtggtcgagccctacaacgtcactctctcggttcactggctgtgtggagaacgccgacgagtgcatggtgctggacaacaaggcgctctacgacatttgcttccgcaccctcaagctgaccacacctagctgggaggtaactacattcttcccgttgctgaaaaagtgaggtgaatctatgacagtgagggtttgatgataggagacaagtattctgatgtgtcctaagataagatgctataaggattacataanttcctttaccaacacagtaccgacggtggcaagcatgctttcnacctgcattctccaactaaaatctaacngcagganagtnnaactccttacttaactaacttaatcacggacatatcgtgaacacaacaactncaacacaaactgtagactcccttnaaatcaacttgaaacaaaaaaagaaaaaangggggccgtacaattncctaaggagcatanccgtaaggctctttaactctacngaaacctggtnncacttaccctnanaanccctttcagtggan

SEQ ID NO: 95212 - DNA, 341 bp, Triticum aestivum
  unsure (1)..(341): unsure at all n locations
  Clone ID: PAT_TA_95212
ggaccgtctctacgcaattttgtggaatccccacgcggactgtcacggtcanncgcgcgatngacacantgctcaccatcaagacttcacagcntagtnnacgnatcaccatccccagcagctaatactcgcattggatgcaatnnaggttgnaggctcttctccttcaaggggcntggaccncattccattggtgccaccctcacaccgttcattccagtatccatcnatcgtccagacacggntgtcaatgcaaggggtcaccagatttggccacngagacgtccgccacaaggtgggacncttcagnctganatactcttccgacaccataacggtct

SEQ ID NO: 95213 - DNA, 501 bp, Triticum aestivum
  unsure (1)..(501): unsure at all n locations
  Clone ID: PAT_TA_95213
taacgtacggtgggcgcggtgcagcgttgggctgcaaaccgtcaaaggattctttcgctttattattgctctatcatcatctcttattaaaccctaccatactatagcacagggaaagcatcttaccatctgatctgaggccgggttgcatgatgcgcatggccgcgaaagagtgtgattcgctgggctgggtgatcaacccgcggctcccacagaatgggttccgtccccacaagaacggaagcgacgtccgaatgatccggtgggaaccaaaacttgggttgtccggaagaagcacccgctgcttccttgtccgacgcaacaccaacatctttggtgtgcatgcagatgcaccaacaacggacatcacatgcctttcctctctctgntctcctgggtttaaaaaagcatttggttctctcccatccccaagctataatacccnggtgcgcngctnaagccaagcctncgccgttgcaactcnatggcaacccactcctc

SEQ ID NO: 95214 - DNA, 590 bp, Triticum aestivum
  unsure (1)..(590): unsure at all n locations
  Clone ID: PAT_TA_95214
acaatcggaaacacaagtattattgaaaccgtgggcgttctacttactagtaccatttacgtgccgccacgcgtccccttttttattagctaggaggcgacgtgcagggtagctatttgagtacgagaggcgtgcgatcaaacccctgtgcgtgtaatcccgggaaggagagccctttgacctccatctgccgtccacctctctcccaaggtctccgctaatggcgcccgggctctgtttaatggcgtgggtatgtctcaccccgactgagatttaagagaagaaaaaagaaaatcctgaaacacggttttgatgttaaattccgaccgncctaatatacatcnacnngcgacttnatacaagactggatgaatatataaggnggattaaatttttttacnaaaaaaggttgccccttccgatttcattactgaaaacaacacattcacaagagntcaacacaatccaanctaacannaaggctaaaactaccanattgaaacccaacaccaanangcaacaaaggcaaaanccgcgctagaacaacatnaaaacgacaanatccaacccaaanggtnttctcangaacc

SEQ ID NO: 95215 - DNA, 632 bp, Triticum aestivum
  unsure (1)..(632): unsure at all n locations
  Clone ID: PAT_TA_95215
cccagccatcgggagaaaatatcgcctgggggccggaccggacgtactgcagctgcggctgcggctagctaatctagcctancctagctagcaccaagttgctgctcgatcatgtctagttgggctgcccccgcctgcctgcctgcccggttgctggtgcaagataccgaggaggcggacgggaaggggacggtgaggtgacatagacatacacccccccggcccccgccgtcngcgacctgcctcctgtccagcctataagtacgcggccatgcgctagctgcgacagacaagagagagagaganacacccacacccacacccacacaanaagggaagcgactgagcatccaagtaagtccttgttgngttgcaatggccggctgcngaggcaaggatggctgtacgcctgctcggctctccancgactgtccnacncaanactgcgcacgcctacaggaactcncaatgaatggacccngacaaatcngtccngcggntgnagtccggtaactcnaanaaaatagnatttccatcnttcagttgctcctaaaatgtgtggttncnctgtggggctaattnctatagggnggaanaatggaaatctgcgganacaaccccaacagancgnn

SEQ ID NO: 95216 - DNA, 595 bp, Triticum aestivum
  unsure (1)..(595): unsure at all n locations
  Clone ID: PAT_TA_95216
gttggggtagccaactgtgacagagctcggattttagccggatttgcttcatttcctctactggagaggatgaagcctaggagctttccggcgggaacgccgaagacgcatttttccggattgagcttgatgtcgtatgttcagagattggtcaacatgagcctcaagtcatctattaaagagtcgaggtgtctggttttaatgaccacgtcatctacgtatgcctccacancttgccgatctgcttttcccagacatgtctggcgttttttgagcccaaagggatttgtgttaaagaagaagggcctaaggtgttaaaaatgctgttgcngtttattaaaccccgcatcttaaccgggggtaaccggagtatcatccaggaacatatatttgtgtccggcgnactccatattnatcatcaaaaatggaaggatctttgggaactgtnaagcttnaanccaanaaagccangattcttttgggacacacagttcttcaaccggtttattaaagaaccgtcatactggaancccccaggtncctagttaaaacccaaatncttcggtaaccttaaataggacccgnaccgngatnn

SEQ ID NO: 95217 - DNA, 479 bp, Triticum aestivum
  unsure (1)..(479): unsure at all n locations
  Clone ID: PAT_TA_95217
ctgtaattttgcagacaaagtgagggatgccctgaagaagaaagacattgacttggctgagttgcagaaagcggctttagagaagaccaagctcgcagatgaaaagttggcttcagttaccaagcttgaagaagaaaacaccaatctgaaggctgctcttgatgctgccaacaaaggaggtcagtccactgaaaaatgacaaggttgccctaaatgacaagcacantttttgngggaaaangaangaacacaatngggnagggttaancgggggngggncccccnaaaaacctttcgcnaaagcttaaaggnnacccttttgnaanaaanagattnaaattgantcccccggtgttcnccaaaatgggnggtnntcctaaaantttncccaaaattttnaaaaggaactgccccngaaaaaccttttccaaaacccccnggtaaaaaatnttnccatgagtcccccganaaacccggtt

SEQ ID NO: 95218 - DNA, 533 bp, Triticum aestivum
  unsure (1)..(533): unsure at all n locations
  Clone ID: PAT_TA_95218
cctgtagtatcatattgatantatctcaactgatataagattanttanagnaganaagtaccagagcctgtagcatnatnttgatttccagtacagttccttttgttttatacangttgntgactacactttgnagtggngacttgaactcttctatagttgcttgntggtatgttgactgagacggagtgtgtatnaaactctaccagactganagacagcagtatcaattcgacccgatacaantacgcatattcaatgtatttctnaatactgaaantagaagcaaatcnatcattttcannantactcagncattnatnacgggtctacatactccatgcttgggaaaatacgggtngnaacattcangtactttccaccaagaatgatcgngaattcctgcntnatcntaccannactacctacaatnccnacaagtnttcatnanccacaangagggcagaccnatagacttatctccaannctgtggtgatccggncntcctttntaagatttgaatcccagtcat

SEQ ID NO: 95219 - DNA, 635 bp, Triticum aestivum
  unsure (1)..(635): unsure at all n locations
  Clone ID: PAT_TA_95219
gagagaactactctcgcgttttttttttttttttttcaactacataggttagtgtttagtttccaaggaaggcaagtgtttatttattcaacatttaataacaacatgtattacatgatgtgatgcctgagtgtgattttgtaggcaagacatcaacggaaaggtgttgggatgtcacctttactgcctaaatgcttctaaagtttccatcggcgtcaacgggggttggagagatcctgaccagctgaactgacaaccccgctttatccctgcaacccaaggatccaagcatgccactgantccaacggccggnaattatcctggtagngcacnncccaacccttgttgtccaaaagggccacgtaaaaagtttttgaanntgggtatttggattanatgattnntncatccaggaattganaacccccaccttttaacccaaagaatggaacncattantnctaagcctaccgttcnanggtaaatttccaaatgagnaatatanncacaaanggctncagttagaacacaatttaattaananaacaggttccctcaggtagtctacccgtancactacagtatcaaaacaaatcctcagnaagggntaattantncaacagccctagattcn

SEQ ID NO: 95220 - DNA, 600 bp, Triticum aestivum
  unsure (1)..(600): unsure at all n locations
  Clone ID: PAT_TA_95220
gttctcctccccactcgcaccaccgccgccggagcgcggttgacttccgcccacggtagcagagccgcccacgcggtcaccaccagcggcgccgccgccgcacgacaaccgttancaatgggcatggcgagggccctgctgccgcagcgcgcgccgctgctccggcggctcctcatggccggcgcgctggccgctcctgcacctgttcctcctcgtcctccaagcgcagctcctcnnnccgccaananacgggtttcncangggacnngggggnccgccgctggaaagacgccttctccntcgangcttccttcaccgtctgccccganagcgcgaccctggnaaccgtccngtcgcnttnnaacggtanccccgangctcctnatnncactttntctccnttacaaactattaaaaaagcctgccgngcatnnatatactaacanttgatcctcacaactaccnttctggagtgtctnaaaatanggaaatctcaacngnggaaatntaatatgannatgttacgggaaaatnaantgggccaanngngggattaatccnttncangggtntaaaanggggcaaaaaaaagggntntta

SEQ ID NO: 95221 - DNA, 398 bp, Triticum aestivum
  unsure (1)..(398): unsure at all n locations
  Clone ID: PAT_TA_95221
cttggatcgataaattggaagaaatctttaataatctaagcatgacttttactaccactaaagttactgaggaaactcctgtaaagagtaggagatgcaggaacaagggtgcaacttctagtgagatcttaagatgattaatgttcaccccgattttgttgaagtgataagagatcctttttgcaagaatgaaactttaaatttattcctaaggagtattgttactgaaaactttatgctaaaccttggaaggatccnaagtgtttggattgaagagttggacaaagatgacaaaacttaagatncttgctttaagcctaactaaggcgttaaactaatacgcttggcccggaggaacccaatgnataaattancctttcttttgctccccggttttt

SEQ ID NO: 95222 - DNA, 391 bp, Triticum aestivum
  unsure (1)..(391): unsure at all n locations
  Clone ID: PAT_TA_95222
attcatcataagatgtagtttcacattatatatttttgctacntgtaaatataaatatttttctttataaacttgatcaaagtttgcaaagtttgacttctcaaaaaatctataggcgctatattanggaacggnaggaggtatcgagtcataataagctaaccaacgctccaagagtatccttggcacacagatgtattttgtgcatgaacatgatacgttttcctccctcaagaataaactaatatatcctcaacatatctctcccatgcacaaagnngttanaatcttttgccncgccntgggggcaaanatttttanaccgagcggttcnatttctnaaacattgnggcnagcatcntactttngcaaggcaacttnaaaattcccc

SEQ ID NO: 95223 - DNA, 592 bp, Triticum aestivum
  unsure (1)..(592): unsure at all n locations
  Clone ID: PAT_TA_95223
gccgcctcctgcacgcttctcctccgctccccgccccgcctcgagcagctcaggaacgcgcgcagccatggcgacggagaccgagaccttcgccttccaggccgagatcaaccagctcctctcgctcatcatcaacaccttctactccaacaaggagatcttcctccgcgagtcatctccaatcctccgatgccttggacaagatcaggttcnaagagctcacggacaagagcaagtcgatgcgcagcccgantcttcatccacatcatccccgacaaggcgaccaacagctcacattgttcgacagcgnattggcatgaccaagtcgacttcgtcaacaactccgggacatcgcaagtcgggacaagattcatggagctccccgccgggcgactntcatgattggatttgggtcgntctatccgctactctcccnaagttgtctcacacaaananaganacacatatntggatccaagcggggtctnacgtaacntganagtcgggagaatcgnaggtacaaatgcctcactaggcacaatgatacttagaggcnanaaggtnatanacaccgnttnnataccacccttgc

SEQ ID NO: 95224 - DNA, 274 bp, Triticum aestivum
  unsure (1)..(274): unsure at all n locations
  Clone ID: PAT_TA_95224
tcgagttttttttttttttttttttttttttttttttttttttttttttttttttttgcnaattattatntgcngtgcctttaaaatataataacanatttaanaancattggtttcancagtttaagattactcanacaancactgactgaataacatcattaccaaancaggaagggtggaggaaatacgacctccaaaanacannacaaatanagtaacgtatttntaccnctcaactaccttnangtaacccaaagggagcnatacacca

SEQ ID NO: 95225 - DNA, 197 bp, Triticum aestivum
  unsure (1)..(197): unsure at all n locations
  Clone ID: PAT_TA_95225
cttggccanacaccanncgaancccaaggtggggccnatcatanccaanntgatggccangatgaacgggaaccggtgatcgccccatgggccctcgtnaccgacggtttttgcnatcagcacgacaaaananctctggttaaatgttggaantgtctttttgggcatcaagagacatncgtgtgttgtcngttggc

SEQ ID NO: 95226 - DNA, 643 bp, Triticum aestivum
  unsure (1)..(643): unsure at all n locations
  Clone ID: PAT_TA_95226
tgcttatctaacatataaagcctcctagagtaccatgtctatgaactcatctccatgctactatccttctataaactgggggtatccatgtgtttctaataaggcattttccattctttctttttcaattctgtatcagtagttccgaggaagcactcaacctagacgtcgcccctaaatcgctgctgccaccgcttgtaaatttgtgccccgccgagggaattttatcctttcaagcgggcaaaaagcaagcagcgcgggcaagaacgagaccgcgcanactgcgtcttcccaacaacctttcctgttgaanaaggggcttttgtgngggaacccaaactgcatcccaagaaagggaattccaaagatattaaggaaaccttnccnttaaaactggctttgttttaaaggncnactttaacggngnacacttacaagatctatttgaatgaaggttttacaantattagcatgcttgatccggtgggtcccctctggaagtcacggttanagcanaggaactgancgtgtcaaaccaggcggcatgtcacaattcaaggttganaatccatgnaagaaanattttcaanatcatgactgaatttagccccgngatcngtnaatttgaancgttnttaaccag

SEQ ID NO: 95227 - DNA, 522 bp, Triticum aestivum
  unsure (1)..(522): unsure at all n locations
  Clone ID: PAT_TA_95227
cttgacctcgactgtcgccaaacactaccgggggctantagctggcctcccaaactaaatcctcaatattttgctcttacattagagctgaggtttcatgatcatgcttagcatgacaacccaaagaaaggaaccgatagcgggactattttctttgggaaggcatttcttatgttaaacagtaatataacatatctctctgcgtttaaaaaaccatatgngccagattgccttgtttgtncntaaatctttgcnctccntaaaggttttataaagttaggataaacacccctcnngtactgggccgaggangtgggaaacccgatggtccaacaccaaatttttgttcaatgcggattccaagcattaatgacataaaagtacttgggtacattnancattncacataanttgggatttttttnaanataccatnccttaattcggcacccgggcccaaatttagggnccggggaaaagggntccnggnaaanatttaaaatnttaagngggaaggttccc

SEQ ID NO: 95228 - DNA, 592 bp, Triticum aestivum
  unsure (1)..(592): unsure at all n locations
  Clone ID: PAT_TA_95228
gaaatatgattattttatcctactatatgacaagcagtgaggtacctgacaacttagctattcgtgatggactctcttgaacgccatcattatttatctctgcacgtttgagctgtgcatttgtcgatgggcctgggagttgagctaagtatggcangtggcctgggtccaaagtaatagaagtagcacaaaaacattttttaagtgtaaggatttccttgctcaaagcctgcctactaagaatagccaagtgcttngaaaggaaaagtgaatgaaaaacatccggaattggaaanttccctaagggactacttttccatgaattttggtgcaaaggaatggngcaaaggaaactgtaggatttggtcctttaatgtctcccttnnaaagaaaaacataggattcnatttctacttccaaccttttaaatcctatcaaccaagcacaagactaagaataatacataatanattataccntcatttcctggnggttgacttaaccacaagctttttaaaacgggatctccatgtgggancaaaacanatggaagaacaggtttaatccattgnctgcttcaacaatcngtatt

SEQ ID NO: 95229 - DNA, 617 bp, Triticum aestivum
  unsure (1)..(617): unsure at all n locations
  Clone ID: PAT_TA_95229
tttttttttttttaatatattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtgggcccgtggtgagtgagctgtttangccttgccggactcctccgcagccggtggctttnaaggcaatgaaagctggacgcactgcacctgggcgcatgttgtcccaatcccgatggatgcggacctacgcgtcaagggtaccccttccttgactcctccaactcntttgattacctgtgtggcgtccggngcaccccgaacatangcagttccanattgtccaaataacggccgtcctantancccggganaccattgngcccccgntnaanaaccccacttggtggacncagggaaggaccaattggaccgttaggntccaccgctttaggaggcnccttntaacggggaaggaaaaaaggcncnattttgtgcccccangggcaaactgaggcccggttntccacgttgtng

SEQ ID NO: 95230 - DNA, 499 bp, Triticum aestivum
  unsure (1)..(499): unsure at all n locations
  Clone ID: PAT_TA_95230
gtgggtagtagtacgagcgagtgacanaagttcttgcaccgactcagatccaacttctgcgcaagatgctggacaagctgtgggacgacgtggtggccgggcctcgcccggagacgggcctcgacaagctccgcanggcggccgccacccaacctctcgccatcaacacagctgcaggggaggcgattaagcagtcgccgtcgatgccgacgaccccnaccacgccggtgacgccgtcgtcgtcgacgcccccgcncggcggcagctgtggcggagcgttttccaccccnggagcaatctgggccaccaaaagctcgggnccaanctcttcgaccgtcgnagncaactcccnaccgtccnagacnggtttanaagcgacgagaccaggacatngaacaacgcttaanaagagcctccgccnagaanaaaaaggnntcaacaacttttggaccccccnagnttgcggccctttggtaccaatccngcaancntaantccc

SEQ ID NO: 95231 - DNA, 264 bp, Triticum aestivum
  unsure (1)..(264): unsure at all n locations
  Clone ID: PAT_TA_95231
acatatgacacaaanagttttaacatcctctcttatctgccaatgaatgggtcgtattagtaaaaaaagtgaaaaaaatgctaccatatttcgcaatttgttttcacctgaagatttttttgcatgggatctagcaaatcagttatctgttcattgtagatctgcacatattaatcaacatggatcagattttccatcgccgacaaaaataactacaaatatgttgtaggtactaaagcatanaaattgcctccaagggggggn

SEQ ID NO: 95232 - DNA, 551 bp, Triticum aestivum
  unsure (1)..(551): unsure at all n locations
  Clone ID: PAT_TA_95232
cactctccagcaccagcaggccggcggcaagcagcgcaagcacaacaaccaaatggccaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgacccctgccgccgccgtccgcggggctggcgcgtccctactcgccgcggtngggcgcggtgaccgcgtccgcngggccggcgctggcgctgggtcnacgagcggatgtcnacgganggaccgggctnngcctggggctnagcaacaactgctgggtggttctcctgggcgtcctntggctcaattggtcctctanacgtctacactccggctcnactaggacaaggatccgggggctctngctctanctacnatattccncctcgtctaattnatccgctcnnaaatcncatatnggngtatgtattcaaaaatggtattnttctaancaaaaaaaaangggggcccgtncaatntcc

SEQ ID NO: 95233 - DNA, 174 bp, Triticum aestivum
  unsure (1)..(174): unsure at all n locations
  Clone ID: PAT_TA_95233
gcatgcaggtntttngagaccgtactcttcnagtcanctacttntcccnactttgtatcatgcnctnctctcttnccngcatcacnacaacgcactaggcgcgtgacaggctgtncatntccnctaccncgttcngtcggtcattattccatttgcgtgtatgggtcntcccgt

SEQ ID NO: 95234 - DNA, 630 bp, Triticum aestivum
  unsure (1)..(630): unsure at all n locations
  Clone ID: PAT_TA_95234
caaccttcaaaggcatcataccaggtgtcgaggccagttgtacaggctcagttacactggaagtggtcttcggatcccctgataatttccaaagcgaggagttaatcttcgacatagtcccattccccantggctatcacgctctgctcggacaaaccgcgttcgcaaaattcaacgcggtgccgcattatgcataccttaagctcaagatgccaggcctccgtgggagtcatcacggtcaaatgggaaacatggaaacccctcccgaacggaggaacatacagcggtctcccnggaaaaattcagagcaacttttaaagnaatttccaagtccggcgtttaacgaccggacacggcaaaccgcctggagcaaatcaaccaagacaactggaagtttccganacncgtaacaatgcggctcaacccaaccctcgcacattnttaganaancctccgcgtananaattacccccaagagaacaananaggggganaaggggacaacacaaaaaccaaatgnggtcacaacaaggggcccaatgttcgccnttacnttaattccctttttaaaaancgtcggggaaactccaannattcaaancagnnggaagggtntaaaacagggcccct

SEQ ID NO: 95235 - DNA, 458 bp, Triticum aestivum
  unsure (1)..(458): unsure at all n locations
  Clone ID: PAT_TA_95235
cccacccagtccatcccccgtcgccctcacgctcttcgtgctcgccgcctcccttcgcgtgctgcctcatggcttccatcgccggatctgccgtgtccttcgccaagcccgtcaaggcaatcaacacgaactcgctctctttctctggtccaaggaggggcaatgcatttcttcgcctgcagccagtgccgatgagatttgctgtttgctgctcaagcaaagcaggatacagtggagaaggtttgtgaaatgttaaagaagcagttgctgttcctgaaagcactgaatttgcggtacaacaantctctgaccttnggagctgattaactgggacacgtccagattgttaanggcctccaagaggagttcaaattantngtggaggagacaattcgcaagnaattcnanagttnagatctgcacntcatcanancttttctgnaatcaacttnaggaag

SEQ ID NO: 95236 - DNA, 393 bp, Triticum aestivum
  unsure (1)..(393): unsure at all n locations
  Clone ID: PAT_TA_95236
acccagtccatcccccgtcgccctcacgctcttcgtgctcgccgcctcccttcncgtgctgcctcatggnttccatcgccggatctgccgtgtccttcgccaagcccgtcaaggcaatcaacacgaactcgctctctttctctggtccaaggaggggcaatgcatttcttcgcctgcagccagtgccgatgagatttgctgtttgctgctcagcanagcaggatacagtggagaaggtttgtgaaattgttaacaagcaccttgctgttcctgaaggcactgaagtttgcgcgtacaccaagttctctgaccttggggctgagtcactggacacngtcgagatttgatgggcctccaagaggattcaantaantgtnggangaaacgantgcc

SEQ ID NO: 95237 - DNA, 639 bp, Triticum aestivum
  unsure (1)..(639): unsure at all n locations
  Clone ID: PAT_TA_95237
gtgtaaaaatatcacttttgttctattctttctttctttgctggagatgaagcaatagcaataaatctttcatgttgtaagtttcgcgccctaccctaaggcttaatgtcgaaagaattttcgcttggcgcattcaaattttgctttggcaatggcacgcggaccgccgggacgagcaggaggtcgaagcgccggcgcgtggtgagccccagcagctcggccatgtccagctccccgggctccgccccgtccggcagctcccagtcgaagtggtagagaaggctgngcnagcgcnagtccatgttgggcaancccgaacgccatcccggggnaattccgccgcccggcgccgaacggtattactcgaatccgtgccntgaatccacgccnancggcctcnaactcnccggggagaatcctccgacgancccaancgccgggccctgccgatncccacgcttgacaanacatgccccgccggactcnancgagaccggacnggccggancccgggaaaacactcccgnggtgancggcaccttatacaagcannacaggncaagtnccntactgcccgtcaantccggcccccngctggacacccgtccnatcgatgcatganctncagcctgccanaat

SEQ ID NO: 95238 - DNA, 411 bp, Triticum aestivum
  unsure (1)..(411): unsure at all n locations
  Clone ID: PAT_TA_95238
cctcagtcctctccagccgtcttcgccttcctcccgcccgccgcggacgcctctgctctggagctcgtgaccggaggataatgagcgtgaatcctggaggctgctacaccgtattcatcgccaacaagagcttctacttctggatcttccaaatcttcaaccgatacggcctcctctccacctgactccattccgcctcctggattctagatctctagtcctgcctcnagtatttgtgatcggcagttgacgctacatatatacatacatacacacagttattagctagtcacancgcaagcttaagtagcatcatctgctcctcctggggttggggttgngctggggttacgtcggtntaatggccaaagatatttgaattgggtgcaattttcaaaanaatgcaagcaa

SEQ ID NO: 95239 - DNA, 500 bp, Triticum aestivum
  unsure (1)..(500): unsure at all n locations
  Clone ID: PAT_TA_95239
ccaaccttttacctcaagggtaatgtcaacaataataatttatgaaaacctacatccaagtggatatatatatccggattgctccaacacaaagtgcttgccaaaggaaaaagtgtaaaaaggaaaggtgatgatcaccatgactcttgtataagggtagaagataaaagtaaaagataggcccttcgcagagggaagcatagtgatacgtctgcaacgtatctataattaatgaagcattcatgctattatatanccggttttggatgattaanggctttataaacacttttaaatatttttgggacaaacctataatccggagccanccanatgcattttcctgcctattcangtttcccaanaaaattattncaaaggagtcaaacggatgaacctncaganatanttttggaacaagtttccaaggacaagagtttaccnaggactnccnatncaagtgggggggnnngccccccntttttggcccccaggggggc

SEQ ID NO: 95240 - DNA, 515 bp, Triticum aestivum
  unsure (1)..(515): unsure at all n locations
  Clone ID: PAT_TA_95240
gccctaataaccctgagctttctcctacttgtagccctccctaccaaactcttaagtccaggagattgggctcattggaggttttgaagtgcatgttctaaaccctttttctttttgtccaaaactggtgttttgcaaaacttgcactatcaactttctgtctttgccaaactaatggtaccaccatctccaagcatctaaagagacactgatctggagattttgggaaccnaaagagttnccaaagtgcacttggctttctgtccaacacctggngtgcacagcacttttgggaagctctccnggttggaattgnngacttggcncctgactatcaacttgtccaatagttncctgcttccctaacgtcatcctgtgcaagccaantcaacctaaaantctaaaacgcgctggattccntcaacaagngccttctncccgggnncccaaaangaacttttgnaccgngcgantaancaananccgaatgcgggcncaancnaccnacctggccc

SEQ ID NO: 95241 - DNA, 183 bp, Triticum aestivum
  unsure (1)..(183): unsure at all n locations
  Clone ID: PAT_TA_95241
ttctgattcaagttctgccanagcantgatgctcagatanatggactgtttactatttctgcaacttcctgcaacataggcaatgacgangccangcantcacgcnaccaaacacactcgcagtgcatangacttgattccatactcacaggattccntattcacaantaatattgtgacgac

SEQ ID NO: 95242 - DNA, 211 bp, Triticum aestivum
  Clone ID: PAT_TA_95242
ttttttttttttttttaaaggtgaaaaatgcttcaatttttgtttgcatcaatcgggagagcaaaacacaggaggatttgtcacacgagtgtatgtacccaaagtgcaccgggcatcaacgcggagactgaattcctatgtacgccgtgtcagtgaaactgacatttctaagtgctactaagctctaccccagacccagagtggccagata

SEQ ID NO: 95243 - DNA, 598 bp, Triticum aestivum
  unsure (1)..(598): unsure at all n locations
  Clone ID: PAT_TA_95243
gaattctcatcaccacagctcaaaaaagttctcctgagcgggctaccgttcagcgctcaggcaccccaggtaccttagccaagaatacgagagccatgcttctcaagccttaccacttggtcgctccgctcgtcctgctcctcgtgagccgccgttcgctgctgtctcgtggccgccggcagcagcggtggcagccatgatggtcggcagttccgctctcaacggctttgcgggcgcgaaccttgacgctcggcggcgccgagcacggtcatgccgaacggctgtcaagctgacaacggtgccaccaaaaagngatagggcatgcttccaccgtccctgctgttgttccgtccccggtcnaacgnaccggcctnttccgnccttctcgacacttggtcttaacatctngggcaacggcaacaagccgactttacgttngggngctggctttttaacncttnacccgggaagngtctcaatgtttttcangcaaccttgggctcaanaacnggaacaagnngcaacactcncgtggatttacaacttanaagcgaattcgcaatcacaacaattgtcgatcgacggganaaccgggtcc

SEQ ID NO: 95244 - DNA, 290 bp, Triticum aestivum
  unsure (1)..(290): unsure at all n locations
  Clone ID: PAT_TA_95244
tctactgntacatggacaactgtttggcctgatggncttaccagtcttgatcnttacaaaggacnatgctatcacatcgancctgttgctggggaanacagncantggntctgttatgtaacttatccattatanctattngnagagggttccgttacaatcatgtttacttccattgtnngtaacgnatttggtttcaaacgnctacgtgctctacgtttggnggatctacgacttcnccctacttattnnaaaactttccanngcccncctcatggnatccaagttga

SEQ ID NO: 95245 - DNA, 630 bp, Triticum aestivum
  unsure (1)..(630): unsure at all n locations
  Clone ID: PAT_TA_95245
ttctgatataaaaccactagcagctctcggtcattgagtacacgagaacgcttccgaggcctttgagcaaatgtactggtagtggcttcggtatttgctcaatgaggcatacgcacattgccagccagaggataaggaggaatagcagcatttgggaacatgaactccttctatgggctgtgtgaagctttgatgatcagggttgtgaaagatatatcagtccttggcangtagatggctcaactgatagatnaacctcaaggcagaaagacaagatggttcatgctgaangntgatagttacanttgaangaattttggttaagngcattacccaaggggcanaaanttnaaggcaacaattaatcccanatgcacaattntgtnatnaaaaaacctgggattttancctganccaatngcaatattgatacaaanctcaagggctcaatttngttcaaaanaantccttgattggcanaaatancncaatcatgnaacatccggggaattnccaggggggcgtacaattccccaaangntnttacccgccaaggcgtcgtttaactctacnggaaacctggtaccactaaccctganaancccttccacgggaaaacaaggcgncgtc

SEQ ID NO: 95246 - DNA, 377 bp, Triticum aestivum
  unsure (1)..(377): unsure at all n locations
  Clone ID: PAT_TA_95246
gtagcctccaagtcagttgcggttgggatctataatgcagggagaattgctgagaaggattttgagatggtttttagcctttggaatttgggggggccaaattggtgaagagaagaagctgtttattatgatgagcttgataaagaatggacacttgtgggcagaaatggtagggcggtgggtccacactccggtgatcgcccggagctacgccagggtggctagagagggtaaattcctttttcaaagcggttattgggccctattcatgaagggtaataatccaagatttaacacattnaacccgtcattttttgaaacccaaaggcacaattagccccctgtggttcaanatagnatgttnctaagcncntagt

SEQ ID NO: 95247 - DNA, 408 bp, Triticum aestivum
  unsure (1)..(408): unsure at all n locations
  Clone ID: PAT_TA_95247
tgcgattcgacaactcttagtaatcttcatcgcttatgagttttgtactcgatcatgtcattcccaactaattgactacatcatcatcgtcaggctgactgcttgaccattctacctatgcccttcatccctgggacacaatcccgacagtgctctaagcttacatcgaactttccgcatcatattgtttgtcttgagagacaactctgtattatgagatggcatcttatctatgggttatagtaacttttgcttcancatctcctgggtgtgatgtcctcncccgattcgattacatcctccttgaaacctcctccgatnaattgtnntaangattancggncaanatttaacntcctcccanatntcatttgantccctgaangagaaatttcanggtttgncccc

SEQ ID NO: 95248 - DNA, 442 bp, Triticum aestivum
  unsure (1)..(442): unsure at all n locations
  Clone ID: PAT_TA_95248
caccgttgtcccccgaagcccaccgacgtcggcgtatgatcaccggaatatcgagttcaagggcgggctcagccggagccactcctatggtgtcctccccatggacaggatcaagaacctggccgtgcacttcccggacgagttcgtcgccgacctcaaggcccgtgtggggcacgcgctgcagcacgttccagtgcctactttcgcacgcgtggaagaagatcacggcggcgcgggatttggcgccggatgattcacgcaggtgagggtcgccgtcaactgccgcggccgcgcaaacctcccgtgcccatggcttctttcnggaaatggnctcctggcttcccgaggatgcaagttncggactcctgtcaaagcaactaccaacggtnggcgctccatccgggagccntncctcctcnagaacaataaattaatcctttaa

SEQ ID NO: 95249 - DNA, 560 bp, Triticum aestivum
  unsure (1)..(560): unsure at all n locations
  Clone ID: PAT_TA_95249
ttctctttgatttttttctccccgaaagcaaatatatagagttggagttgaggtcggaggagctccagggggcccacgaggttgggggcgtgccctaggggggcaggcgcgccccccaccctcgtggacaggtggtggggcccatggtcttcctcttttgcaaaggattttaattaattaatttcccgaataagatgttctgtgaaatttccgggtcattcccgagaacttttgtttcctgcacattaaataacaccatagcaattctggctgaaaaacaccgtcaatcccgggttaagntcccatcnaaatcnatgcaagctaagagtccaaaaacaaagggaaaaatgttttgggaaagtaatacntttggagaacnttcacaaggtggaacggctggngttcngttnctttcatcctncccacatttgtggccgtcaagtctancaantncacacaatnggngtaagggtccaaggctcancatcnatttgggtaanactngcttttggggaaccctttttgggcttnaaggctttccttggntgcaagnataanca

SEQ ID NO: 95250 - DNA, 625 bp, Triticum aestivum
  unsure (1)..(625): unsure at all n locations
  Clone ID: PAT_TA_95250
gcgggtagtcgcagggccaccagtgcgtcaaagaggttgtcaccatagtggccgttgagggtggcgggcatcacagagcctaggcgcgtcggctggaggcgtacatcaaagtcgtccgcgagcttcttgacgatggtgaacttgtccaagaaaccgacgaggacctcgtcgaacaaggagacgaagctgtagtccaagcggccctccccctgggcggctcaagcaaatactggnaanttcctccgtgcccgggcgcaagccggcgtcatggacatttgnacagccggctgatctcctgctcatcgcctcccatgggccnacttaactcctaatccaactnatattgcattccagtgatcanccttgccctttggtaaangctaangtcgtaagattnaanacatcctcaaacctctaatgacctgcctttggtgtatatagtggggcaaccatccttttggcaagtntaatcaccaaaggaattnntaataatgaaatggtccctcgtgcggggaattantantacggnctcanttggcaacaaaaanttngttactatgaccttanttccantttacttnttacaaaatttagctnanaaanttttatncttgacataccaaat

SEQ ID NO: 95251 - DNA, 406 bp, Triticum aestivum
  unsure (1)..(406): unsure at all n locations
  Clone ID: PAT_TA_95251
gtcatacctcaccatgccttaccagacataaccgtctcaacgaagaactagagacatgctcgtgtctacccaagacagagactttcccggattcctcccgataggcatgaaaggnatacganggtgattactatcagaagcatatcaaattccaacagcaaggaatcatcattatgtactcatgaatgtgatcataacaccacataaaatattnaatgcttcgtgtcaaggtgacgtcntatttgcaccaaatgactcacaacaaatattagttgggggtcaanaatgcttgccttcaagagtatgcangaggggtgcatttttgaaattgccttctccnccaaaancctaattaanngatgatcncacacantcnaaactgtnaaaaagttgcccgattttttca

SEQ ID NO: 95252 - DNA, 648 bp, Triticum aestivum
  unsure (1)..(648): unsure at all n locations
  Clone ID: PAT_TA_95252
ctcgccccaccaactcccctagaacgtccgaccgcacaccaggcggtgccggactattttgtatgctctcttcggcagccggacactagggacttctggggtctacgagattatcttctggcctcatcggatctggagaggccctccgcggcgacacttcggggtcgcccgcttctggagtggaggagtctgggggaaggcgtttcgctctccatcatctctgggaagaagatcccccgaagacgaatcatttnagaggggcttgaggccgaactgcaagataattgtggttgttttctcaagaggaaaaagatacataccttaactaataaaaattttgggatcacttacganccnttgaggtttnattccctcgcggcttntgcacaaaanaccccccgaggcaagacctctgtgggaattctctcccgtttggaggctcnattccgggntctccggaanatcctttctccccggtgtctcctcgnggnaaatgctcctggtcnganaagtaagatgggggcctgttaccgtatatcccccgnaacttcttagggtcaagnagggnnacccccggggggcgacaattnccnaatgntctttaccccnaaggctctttaatcgnngggaaaccggttcaataaccct

SEQ ID NO: 95253 - DNA, 622 bp, Triticum aestivum
  unsure (1)..(622): unsure at all n locations
  Clone ID: PAT_TA_95253
gcagcatcgccctcgggatcccacccgaaccaacccacgcgcagccagccatcttcccagatcctcatcgttttccccgtccacccaatccacccagcctctgatccatccgtttgtggccgccggatggagatccaatggccaccaaagcgcccgagcctcccacagtgctcgattcagatcggatcgaggcctccatgagcgcagccccgagttccgattcgagtcccctccgctgcctcgtccacgtcaaagcctgccagatcgccgaaccaccgcctctgctgtgtcgctgcaacaggagacgaccaccatggcaagcccgagnatggganttcgccgcgacaagcgactccatggacccgacgccgatcgattctcgcggcaacttttactgtcggagcgttccaagtctccgactccctgcaantcttcgccgcatcaaactgntaccctgcacgcgcggncctgttcgttgcaagtnaactgctcngctcaangcgcgtcgcgcctggagaacgaccctggtnattggngtcgcataagctgcgtcgcaantcanncgccgancatntccgctcgcgtcgtctagcccttggttgcttaaaagganaagccccgc

SEQ ID NO: 95254 - DNA, 548 bp, Triticum aestivum
  unsure (1)..(548): unsure at all n locations
  Clone ID: PAT_TA_95254
aaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccnggggcaacggaaccggcggcganccatctacggcgagaantcgccgnacgagaanttctccacaanacaccaacccgggattntctccatggcaacgcggggccaacacaaangtcccattcttnatctgaactcccctgcaattgggtcnacggaanaacgtgncttcgcgaagtcntcgaggcatgnctcgtcaagaaatcaaaaagnggntccgcaacggactgtcaaacagtggtatcgacaatgcggnacttaatcgccgccgcggtccctttccctctc

SEQ ID NO: 95255 - DNA, 179 bp, Triticum aestivum
  unsure (1)..(179): unsure at all n locations
  Clone ID: PAT_TA_95255
ccacaccgacaccccatccactttatctcagttgagaggtttagaatcggtgnagcacaggtgcancaagagctgcnataggaaggagcnagcagcaatggcgaggtacatcctccttgccgtgntcctcgtcnggctggacncgatctctggntttcaagccaaggncgccgncgctg

SEQ ID NO: 95256 - DNA, 636 bp, Triticum aestivum
  unsure (1)..(636): unsure at all n locations
  Clone ID: PAT_TA_95256
ccgaagcagaaaaagcatcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccaagtgcaagatatgcatgcagactttcatctgcaccacctctgaagcaaagtgcaaggagcatgctgaggcgaagcatccgaagagcgacctccgtccaatgcttcccccanctcaagcagtgatatctgcccaatcaagattgagaaaagagattnaaagagagagagaagtgtcataatccaactaatataacatttcccgcaatggactgatngtttgactaacttgggtccgnatccnggtgtgctgctgtcccaactgctttggtggtgtgccaactacaagtatcctcctccaacaacctttgggcnanatacttaaccnggtggntgcnccccngctaatcattatcttcanaaattactttgtaaaaaaaaanaaanaancggggcccgttcaattncctaangatctataccnccattgccnctttaactcgtngaacctggttccatttaccttanaaacctttccagggtt

SEQ ID NO: 95257 - DNA, 275 bp, Triticum aestivum
  Clone ID: PAT_TA_95257
tttttttttagtacaaatgtttattttcatatagtacaagcttacaaatttgtggtattacataggcaaatggatcttttttacaaggatccatgctttattcaagaaagtaaatccgtatatactgcatggtgctgataaactatagtactcgatgatgcatggaccgactgatgtacagtaagtaagtggtgtttaaaggagccgtccaatggtccgggtaagtaagcgtaagttggcatgccgcaagttttccgcccgttccccgcgcgtcg

SEQ ID NO: 95258 - DNA, 534 bp, Triticum aestivum
  unsure (1)..(534): unsure at all n locations
  Clone ID: PAT_TA_95258
ctcccctgctgcatcgccctgcagctattcagtggcgggcagctcacccaagaaatttcatgcacttgctgaggaacccgaggcgcggttgaagctgctctgtctctcaggtgaccggatcttgcaagcaaaactgaacttccactttatcaagtgaggcagggcatcgagtggaacgatgctatggtgtagaggtggctctgcaggccagggaggcccttgcttgacgaggcggtggcctacatccccgccggaggacaaatatatctacctgctttttcttcagtctgacctgctgcttcttcacagtccggcgcgctacatcctcacgcaggttcgaacatgacaagcttgccttggtggaagactcaatgccgaggangtggattgactgcatctgcgtcaacaacaanctggggactacnatggaaggtggncctggactgcatccggtgttgcggttggctcaaagcaaacatggcatggcggagtaagggggggggccggtacaaattccccnanaggatctatacc

SEQ ID NO: 95259 - DNA, 615 bp, Triticum aestivum
  unsure (1)..(615): unsure at all n locations
  Clone ID: PAT_TA_95259
cttggtgatgactcaggatgactgggagcagattcagattcaggatcttgtgctgcgtctccatgcccttcatcaccatgtattagtctagcatgtagctggaaaccttctccttcaccatggccaccagcagcccaaccaccatggtttgcaggaataatggaattttgttcggacatgatgttgtctgcgtgtgacagactgcctgcatgtgcagatgaaatgaaatttgctcagaaagtataacaaataacctcatggtacatgtgaaatttcttcgattacagttcatataaatatcctgagaggcttangctttcaatgaatagttgcccatttcaaaagcatccttgttcgataataatggtagcatccccttccttacaaatcatttctgtcacccctcacaagcgtcagtgctgatnacggccacnantccctgccctgaanaanccanttcagcaggcagaccgagcaancacaacgcgatccaantcngaggcccgtaaccggtattgtggacanaaccacatttaaatgtggtactnttanaaaggganattgcacantgggngtaaaaatgnncgaaacccccgttccnaacgacactcctcc

SEQ ID NO: 95260 - DNA, 606 bp, Triticum aestivum
  unsure (1)..(606): unsure at all n locations
  Clone ID: PAT_TA_95260
ctcgtccactccaaaccctagcctcctcctcctctcgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactgctctgcacattaagctccgtgctactgggtgggaaacaagacaaaaactccaggtcctgggtgctcaagctgcgcttaagagctcttgcacgttctggcatgaagattggacgcantgaggatgttancccggtcccactgacancaccgccggaaggtgtanaagaggaaggagntgtaattcaagctcgttnangatggaaaatacaagctatcatatctgctctggaacttgtcgtacacncgttagatgttaatcantctgngnttanaatttg

SEQ ID NO: 95261 - DNA, 645 bp, Triticum aestivum
  unsure (1)..(645): unsure at all n locations
  Clone ID: PAT_TA_95261
ctcactttctacatgtcatcccaatcttggtactcttgtggtttctttttgttgctctagcttgtaaatgtacctgtgttatctaaccttgtttactcaggttcatctccttttaatccaactcaagaccacaaggtaagtatatgcatcacactcatgtgcatggggatttcttgttgatgtacatattgtttgcaagaaagactcatgagcatgtaggtacatttcctatattcacatcttttgctctgatgcatatagccaagatacatgtaacacatttgcttactctatcatgcttatgcattcacatgctcttacattccatatttacatgattgcatacatatagggggagcctatgcatgttacatgtctttctaaagctttacttgctaatctctatatctttatctaaagctttggatgtagttgtcatcaattaccaaaaaaggggaaatttaaaacacaaatgctccatggggtgatccaagtaattaatgcaacatacnctggtggnccaangttcancaanaagttcaaataatttaanaaggntggnatgncaaaggantggacctnaagacatatgcaaaggtcatcaaccaatccaagancanntccaattaggatcaagataattng

SEQ ID NO: 95262 - DNA, 316 bp, Triticum aestivum
  unsure (1)..(316): unsure at all n locations
  Clone ID: PAT_TA_95262
tttttttttttttatgntaaaccagggnaantttagttaagggggcctgtttacaacaacncatggcanggcacctgactgctgctgtncgccnggtncatntagaangccctcgatcaggtagcggttacatngtatagnagtagtagatcnatangatcnatgcngcacgctcggtgcatngcatgatcgatgntcaatgatctaccagctgcaggcaggggcatccccagntggnggccgcacttgcactgnntgcagncgcaanccgccgttctcgggacgnccatctccangccnggcnggncctcgccct

SEQ ID NO: 95263 - DNA, 597 bp, Triticum aestivum
  unsure (1)..(597): unsure at all n locations
  Clone ID: PAT_TA_95263
gcaaaattcacagcacacctgataccatgccaacacacagccttagggcatgttggatactccggcaggtggccaagagcggtgaggatctcctcatcaacaatactgcagagcaccgtcccgtggaaaataaaaatatagtattgacagtcttcgagaccttcgcctcaaacaataggcgcaagcgagcactccgcagccttgccgaagtctgccacgtcgcagcaataaatccatggaacgacacggctataaccttcaatgccaatgacgagcctcaattccgaacagcccgagcaccagccgctttggtccttagtccaattgtggacggcttccggcctactaaaatgctcatggacggcggcagcggattaaacctcatctacaaggagactcttagcaaaatggaaatagacaagagccgcattgagcaaagcaacacgaccttcagaggaatcatccccagtcgggaagcacgatttgcgggaaaatcacactagatgtgtaatcggcacccngagaattataggtcgaagagatacattcaagtggnccgttnatnncggtacanncctttanggnggaggatcngat

SEQ ID NO: 95264 - DNA, 601 bp, Triticum aestivum
  unsure (1)..(601): unsure at all n locations
  Clone ID: PAT_TA_95264
cgaggttgcagttgccatcaagattgagtcgctgctgaaatatcgtgccttaagcactctagcgcacaaggaagatgggacttgcagaatcctccacgcttgcttagcaaggagcgcttgattgaaagcctcagggtctctaaaacccattccaccatcccgcttcgatgtacacattttccgccaagaaatccagtgtaccttacgctcaccattcgttgccgcccaccagaattttgaagagatcgaggtcaggttccggcacatcttcttcgtaagctgaaaacaactcatggtgtgggttaggtactgcttgtaatccagacttgatcaatacttccctcgctgcttttganaagccttggccttccatccaactactttgcctttcaagcacgttgtcacatattttaaaatancctccttggactgtcaacagtgttggcaatccaaatacgctcgctcaaagcttcanacggncaaccaatgcatcttnantgnattttgttccctcccnaaagccttccaaagaaatanaggatttgtaataaccnttggccgancccccanaccaaagatacttaacatacaagtttcatca

SEQ ID NO: 95265 - DNA, 543 bp, Triticum aestivum
  unsure (1)..(543): unsure at all n locations
  Clone ID: PAT_TA_95265
gcacgtgccacgtggtggccctttagcggcggttcgtgcaaaaccggtactaaagggaggggggntttantcaccaccctttantgccggttacagaacanacactaaanggtcttacaagcatgaaattccacacattttttctcaacaaaattaataataatccatggcatanctaagacgtctagtgagctgccccaggtactcacaangcgaacgatatagccgccancagcttccacctaatccatttcccgtccacgccnctgccggttgttatgataatcatgacttgataaatcagttgtattaacgcggtcatanctagctggatgcgcncgtcgctgaacaagccatgtttgtanctagtanttantgctccctccatttttatttanttccatattancttttgtcaaagtcaacctttgtaaactttgacggagtttctaaaccancttntaacacatttcaatancaaatactactaatacattatcattgaantcnttacatcatatnattgttatggtaaaagttaaa

SEQ ID NO: 95266 - DNA, 591 bp, Triticum aestivum
  unsure (1)..(591): unsure at all n locations
  Clone ID: PAT_TA_95266
ctctctgtaaacttgctagtgggtcaaattcctcccaaactagacttactttcgaaactgttctacttggatctctctggaaactcactantgggtcaaattcctccganattangctttcttaaaaatctanaatatctctatcttggatcaanccaactcgangggagcattcctgatgagcttgggcaattgctgcaattggnacagctgctcctacgcaacantaagcttacangtgaattctcacgcatgccatcttgaactctttangttcactcaaatatttangcttggggtccaatatgctacgcantgcattgccanctaatattggtgaccgttgcctaatctcattgaacntacctttgnctggntaacatgtttgaangnaacatcccaacttcctaagcancgctcaanggttaacaacggataatttaccacntacattcacngganaattccaactcttttgaaaccttnaatctgacatccaanctnggtaaacacttnaaaanggacacagnatggaatctaaatgattgaaaatgncattcnaagaanntaancctaaatcggtcaggactt

SEQ ID NO: 95267 - DNA, 587 bp, Triticum aestivum
  unsure (1)..(587): unsure at all n locations
  Clone ID: PAT_TA_95267
gctgagtcttacaactcttgtcttttgatacatttggttctctgagttgtaacacttaaacttgatggtcgtttgctactttatctgctattctgtaatgcaatgataaatcccgcatgaagtcattctgtagacgtccatttttcattatgcatatcattatcttcgttatttgcttatatgcataatgcattgtcttcacactttgatgatggcctccacaaagcataacctgccatgtgcatttgcattcanacgcaaatcatttatatgcacatcttgaaggggagcctcgtcttatgtatgaagacantactcataacactaaacttcacatacttttatccccgttgaaaacttcaaccantttgtctcatcactgaanagggggagattgtaagtgcatctattgccacccctagttaatttggngtattgacggaaacttggttgagggacnatgtgtttgtganaatgcaggataacacangtatancagtccatatgatccggttactacaaagatgaccctaaaagttnaaacatnaagnatggggcttaanaatccgtgaaacatacatgaaana

SEQ ID NO: 95268 - DNA, 272 bp, Triticum aestivum
  unsure (1)..(272): unsure at all n locations
  Clone ID: PAT_TA_95268
gagangaaaagcttggctgagaatcgcctggtcactgcagccantcacggtggtggcgctggtgctaactgggcttgtcggtctgtgagcnaacantgagcncgtgccatnggntgaagatatgttccattgncangcaacaataatgggcccatctgacancccatattccggtgganttttcctatttactatccacttccctcctgattatcctttcaaaccaccaaaggtggcattccgcaccatagtgttccatnnaaacatcaaca

SEQ ID NO: 95269 - DNA, 597 bp, Triticum aestivum
  unsure (1)..(597): unsure at all n locations
  Clone ID: PAT_TA_95269
ggcgcgcagttgtcttcggcattgcaaggcgggttccttctccgaatacattatagaataagttgaatacgaggatagtgtccaaccctgcaaaataagttccacagtcctccgcagagagaataatttttcctcagatctaatttgctggcttgttttgacagcatgacgtcatgtcatggcccggtgattattcaaaccgtttctcttaaccagctccacacatatcgcgaggcggtttcttgacacgtcttgccaaagcggagatcgtgttcccctaattacgggattcttattaatgcggttcgtgggtaacccaaccgtgtctaggactcctagattataggtaagtcctaaacgactacggagaggatgcttgatattcaccctctttaataaggggacaaggtttcnctttttccttccgtgcncaatcaaacccttcccccgccccaattntaacaccaaancccagtcaggngcnccggatttaactatgtcggatcaacctcaaggcgatggancccccnccnttaggaaagncattanaactggggagcaaatttgacgccaggttccacanccctgncagggggg

SEQ ID NO: 95270 - DNA, 431 bp, Triticum aestivum
  unsure (1)..(431): unsure at all n locations
  Clone ID: PAT_TA_95270
cgcgtgcccacttctattttgcgggatcaagctcatttttgcaagtccggggaaattatccctatgcgcaaaatcctttcctaaccctctccttcttttccctctttcgattttcttttctgctataggatataagagaagagagagagaagcactancctaggccagcccataggcccagccgacccccaccagttctaaccctagcctcgacccacatctccctcgaacccctcctcctctttcgttcctccnagcgccgccagtagagcaccgtgctcgatcccatctcctctcgatctctccctctcnctcnccaaaacgtccccacncgtgcaagcacntaaggccgcaacgtntcgactcgcanggcatcgcaagcancctccggaagtgcccgaagcgccctctctcctaagttcctttcaatg

SEQ ID NO: 95271 - DNA, 584 bp, Triticum aestivum
  unsure (1)..(584): unsure at all n locations
  Clone ID: PAT_TA_95271
atcagccccaggaggcaatccaccaaccacacactggagtagggtattacaccgcaacggtggctcgaaccagtataaatcttgcgtcccttgtgcagttcctttattagtttagatctttgcgagacgggaaggtagaaggcgtaatcttcgcgcgcaccccagtgttcgaaccttaagggtctgccggaacccgaaatccgacatttggcgcgctaggtaggggtgcaccggaattcgtcgtccaccaccccgctctcctccgaccgtcgcatccatgtccgacgcacgtcnggcctgcgccnagcgccgggccgccatcgcttctcgcctcgcccagtcngcgcccgtcggcggcatcctcgtcgttcccgtcgcccgctgtcaacgccgcaaccggcctgccggggggcnantacaagcgtctcccagatcctccatgcggnaagaggcanatgctatcnatgctcgccccgcggttttctccgcgcgttgcgaccatggngcccaggggggcccgtacaattccccataggnttctatanncccccaaggcgtcnttanactcngatggnaaacccgcn

SEQ ID NO: 95272 - DNA, 614 bp, Triticum aestivum
  unsure (1)..(614): unsure at all n locations
  Clone ID: PAT_TA_95272
gtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgangcgtacctcgtcgggctgttcgaggacacaacctgtgcgccatccacgccaagcgcgtcacatcatgcccaaggacatcaactcgcccgccgcatcgtggcnanaggcctaactgtctctccgtgaacacgtatggttcggataattatccggtgtanttgtccnaattgcgtcagnctaactttgttaaaaaatatgtgtagttatagacaacaatnanagtattccttggttcataacaactttatttaaactanacatgtttctcaa

SEQ ID NO: 95273 - DNA, 610 bp, Triticum aestivum
  unsure (1)..(610): unsure at all n locations
  Clone ID: PAT_TA_95273
ggaactcccatcccccgacacactagcccctcaacccactctccactcgcgcacgcatcctcctccgctcccatggcgtcccgcgacctcgccgagagcctgctccccggcgggggcgcctccgcctccgcctcctcctcccacgacgagtacgaggagcgcgcgtacgactcggacgacaaggtctccatctccatctccgactcggagcccgacgacgacggcgaccccggcgcaccgcgcgcgcgcccggccttctcctggcggaagctctggcgcttcacggggccgggcttcctcatgtgcatcggcttcctcgacccgggcaacctcgagggggacctgcaggcgggcgccgccgccgggtacaagtcctctggctgctgctctgggccacggtatgggcgcgctcgtgcagctgctctccgcgcgcctcggggtcgtcacgggaanactcgccgagctcngcgcgaggagtaccgcctgggcangcgcgcgctgtgggtatacggactccgctcgtcgggctacatcaagagtatcggaaccgatgcataaaatcttcgggganctgccgttgggnggtctaanacgcttgatgntanctnat

SEQ ID NO: 95274 - DNA, 631 bp, Triticum aestivum
  unsure (1)..(631): unsure at all n locations
  Clone ID: PAT_TA_95274
cgcagccactccctcttgatctcaccctctctctcccgcagcgcccgaaccaccatctccctctatcccatcttcctcccgcagcctctccctctcgatccctcttcacctcctcgcctccccgctgcatggctcggcgccaacgccgctgctgcttcgtcgcccgtgtcgccatggtcctccttgtgcctttgcttcttcacttgcggctccgccgccccatgtccacgtcgccggccaccagcaggacgccgccgcagcgccgaccagcgccggcctcgaccgcctcctctgctccgcctccatcgccggcgaccacgaccagcgcccacctatgggagctctacgcccctgcctcgtcctcttctgtggctgcagaagcctgccacgagcgtgccgccgtgctgcttcgccgtccatggccctggctctgcaaggagctgacgctgccgggtcaactctcgccatgctccccgtcgctcttccttcacgtgaatgttgangagcgcaagcaacaagccgccgtccgcgctaagtctcgcctcgggtcgttgcgcgcgttncccggatcgaagcggcgacagatcgtcgtctncgttacangcgaagaacgtgctaatccctccatcng

SEQ ID NO: 95275 - DNA, 488 bp, Triticum aestivum
  unsure (1)..(488): unsure at all n locations
  Clone ID: PAT_TA_95275
ccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctagtaccatgtaacgctacctgatcganggtctttgtatgtatgtaagcacctgccagcatgagcagagcaagtgcactcccatgcatgtaaaccgacccctaaataaaatctcccgtggtttaacctaaaaaaaaggggggg

SEQ ID NO: 95276 - DNA, 589 bp, Triticum aestivum
  unsure (1)..(589): unsure at all n locations
  Clone ID: PAT_TA_95276
ccaaagcaagctagctgaagagaagacagggagacaccaaggtctccaggactgagcatggcggcgaagggacaaagtagatctgtgcctccaatgcaagggtcttccggccagcagagagccgcgtacacggagggccagaagccgccgccgccgcctactgcaggtagtaaagggttgtcgacgaagaccgctgtgtcgagcaacggcagcaactctcacccaccaagacagccgtacaaactcgatgatgcaagtgctgctggtggtaaaccgacagccaagggcttatcaaggtggtgaatggtgtgcgtgcggaagaagaatcatgtgaataaatatcagttcgtcctaattttctgtcaaatctacgattctgtggtcgaagaaactctctacatctggattgtatagcttgtgaaagtggtcgtgtagacaagtacattcattcgttnagcatgctcctcaatgatatcgtanccaattattaagttggtaaatttgtacgtatatcatacatatatattatatatacngnatgtaancaattnntcaataatacanttntactattcanaaaaaaaaaaaa

SEQ ID NO: 95277 - DNA, 238 bp, Triticum aestivum
  unsure (1)..(238): unsure at all n locations
  Clone ID: PAT_TA_95277
gcgcgcccccacccgccggcgacggccacatgccgaccgcctcctgcctccgcccgcctctccgcagcggncgctccgccgcggcgcgcctcgggttcnctcccccgcctcccccggcgcagctctanccggcggggctggcgantggtagctggcggaggangctcgccggggtcagggtggcggccgcctccgcctcgcncntcgacgatgctctacgcgcggggaaggcccatgc

SEQ ID NO: 95278 - DNA, 306 bp, Triticum aestivum
  Clone ID: PAT_TA_95278
ttgaaacgttgtactgttggactccaacttatttgtccccgtacaccatgcagcgtgcgtcacatgaaccaatgcttctattcctttttcagatttctcatcacaacgtggtggaacgcacacatgatggctgcttggcatatatgtttcatgcatggacacattatgaggggcgagcggaataatatatgtcatggtatttaaattacatgcggtcatatcatcgaggttgcaaacttgttgttgcgcattgagtttgaaatcttgtagttgcgtccgacattgggaaaacttgcagttgcccct

SEQ ID NO: 95279 - DNA, 561 bp, Triticum aestivum
  unsure (1)..(561): unsure at all n locations
  Clone ID: PAT_TA_95279
cccacatctagggcgcgcaccgcaggatcaacaagcaagggacccacgaagatggggttctcgcaaggtccttcaaggcctgctgggcgcagccccaactcatcaaaaaggggcatctgcctcacgaagccctctttgttcgagcattcatacaggaggcagcctcctccggaagcgaggctggcgctggattcgcccatcaagaagtccgagcaccgtgcgcagttctccggaaggaagcgcaagaccttggactcatggggccctgctgccggtgaaagccaatttgtagagaatgatgctnaagcaaaggatgttacaccgaatgatccttcaacaccatttggaccgtcacaacanttcttcaacctggcaaccggggnaactttaanaaaccantggcaatttcntccccccaacccggttgggtacgggtgaacaantgaaccanaataggntttaaaatccgggtcaaaataacaacattnctgaccctaaattgggnaaangatncaatnccnacaacgttccgtaggctgaagnaacaccgacctgggggan

SEQ ID NO: 95280 - DNA, 402 bp, Triticum aestivum
  unsure (1)..(402): unsure at all n locations
  Clone ID: PAT_TA_95280
ggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttaagtagccaagaggaaaagaaagcaaaagcgatcccgttagtagcggcgagcgaaatggggagcagcctaaaccgttgaaacgggttttttgggaanaacaatacaagcgtttgtgctgctaaggcnagcggtttnattgccgcaccctaaatggtaaanccaattanccgaaanatcactaactttagnnccntaacccnantacaagggnacnttgaacccctttttaatcaacaaggcaactt

SEQ ID NO: 95281 - DNA, 409 bp, Triticum aestivum
  unsure (1)..(409): unsure at all n locations
  Clone ID: PAT_TA_95281
ggagcatcgtcatccaacagtanatcagaacaanagcatggcgccggtgaangtgtttgggtcngaggcgttcacgaacgtggagcgggtgctggagtgcctggaggaggtcagcnccnagtacgagatcgtcgacgtcgacttccaatccaaggagcacaagggccccgatcatctcgccagaaacccgttcgganaantcccggcnttccagnacggngatctcacgcncttccattcctcgcgcgatctcacgcaacgtnctcccngaatcacaggacccgacnaagtcaacctgctnaanggaacgcnatnccaaggaattgaccttcgtctnacntctnggatggacgttgcatgnnctcaanctttcgacccnaatcaatngaatccgtngtctacaagacgc

SEQ ID NO: 95282 - DNA, 322 bp, Triticum aestivum
  unsure (1)..(322): unsure at all n locations
  Clone ID: PAT_TA_95282
gcggacctcggtnaggcgagctccgancttggtgncangcacgtggctgaggggnatcagctcaggggtctcntcngtggcatagccgancatgatgccctgntcaccggngccgacctcttcgggacgcttggtgaagtgtccgtcaacaccctgngnantgtcaaggggactgctgctcgatgttgacgaccaccttgcaacggtnggcgtncgataccaacatcatcagntatcaagccgtnttgccagcanngtntccccgcaacgatnctctcctactcnacngttggccttagtggcngatctcgncccaaggacc

SEQ ID NO: 95283 - DNA, 610 bp, Triticum aestivum
  unsure (1)..(610): unsure at all n locations
  Clone ID: PAT_TA_95283
gtcccactagcgctggcacacctccaccttcacgtagagcatctggcgtgccgcggtggcgggtggcgtgatcgaaaagacaacggcgctcctcaaccccgacgagccagaagaagacccagcttcatggtcatgcttctcggacatcctcgggatccacttccacatccattgccgccggcaagggatggagcgtgggcgggcgtgtgaggggcagggaaagagtgttgaaaacgacggaagtggactgccggtcaatgcgcatgggttaaccattaaaaaggaactcatccgggggaagctgacatgcaaggcgtcatatgggtagattcaaaagtggccggcgagaattggttggatggatgacatgccggcgccaagggctaacaccgagaaccacgcgcgtctccaatccttccggatgcaatccaacccaaactttatttcaaaaatngtcccagacggaatttatgcctacggcaatgttngtccttgnattgtctncnccccaaggggggggcccggtaccattcnccctaaaatganctatacgcggctnacggcgtcctttaaactctgacggaaaactgggtnncaantaacccttgan

SEQ ID NO: 95284 - DNA, 596 bp, Triticum aestivum
  unsure (1)..(596): unsure at all n locations
  Clone ID: PAT_TA_95284
ctggcgagcaccacacccacctgcgccgtgctgctctggcaagcggccgcatccacctcccaccgcgttgctccagcgagcagccgcatccacctcccaccgcgctgctacggcgagcgcctcgcctccacctgcccccattttgctccggtgagcgacgcgcctccacctgcgctggaacggcggctacaccgtggactagcggacgagatgctgggaaacggccttggcgggagctgcagtcggcgacattttttgctacatccggtactattttgctgggaatcaagaaattttttttgctacgattcacattttaagagtgtttttggctgggaaccgctcccaaatttttgctaccatggttttttggctacaaccgttgcancccttgncttttgatttttttggcnanattcatccaatagctgggacatccaattttgctacacgtttttattttgccnactgccncctaattttgcaacaccctgttttgattttggcggttcacctttgcgggacaaccattttgccaccggcctngattgcncacgtctaatttgcanactaatttgattgttgcggtcaactct

SEQ ID NO: 95285 - DNA, 586 bp, Triticum aestivum
  unsure (1)..(586): unsure at all n locations
  Clone ID: PAT_TA_95285
gagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtccgacgtctgcgacgacgcccaccccaagtgtccccagggctgctccggcgtgccgcgtgggtgtccgacgancccgaaatgtggcgctgcgcggatatgaaaccaccgtcgacggcacctgcggtggaccctgcaagaanactgattcggtcatgccggcatgatatttccgcctaaaataaaataaaactcaaggcgagatgacagctcatcctgcctatgcggtgtntgtgggcaacaatgcttatacaatatgtcnctcttcctccctgttttctctctcccaagaaantggggttgctggttgttcaactatccnggatacctccgtggaataacagcngtaagatggtcntgggtgcaataantgagtccctgtcaccaaaaaaaaaaaa

SEQ ID NO: 95286 - DNA, 532 bp, Triticum aestivum
  unsure (1)..(532): unsure at all n locations
  Clone ID: PAT_TA_95286
ctctggtgccacgtgtactatattgctagatttaactttaatctatgagttgcttcgtatctattttggcataaatgtttcatcatactaggatttaattggtgatcttacttttgttgccttttggtgactatgaaatatattgcattttcatggaagcaggagccgggtagttgttgagcgggttgtgggagaggcggtcggcgagcgcgggctagacgggaaggtgatgcttgtgatggcgaccatgccggcgggcanggcaaggtcgattgtgtccatcatggtgtttccnagggagancgangcatctgccatcgcgcatctgaagaatcgatgctcngggcgagttnaccaacgtgggcggcgtgaaancggacggncttaaaggcggtgacangttgctctcgtcgcaacgtctctcaacttggcgganagcganaggaaacggtggacatgaagactcgacgcctgcnctgtgacacgacaagccatgttttgtataaagatacaattgtnacatatcccaact

SEQ ID NO: 95287 - DNA, 394 bp, Triticum aestivum
  unsure (1)..(394): unsure at all n locations
  Clone ID: PAT_TA_95287
atccctcaaagtgtggttgagagtaagcgtcaggaattccgcaatctgaagcaaggctctttgtctgtctatgactacaacaagttgttccagaagctcgcccgttttgccaagcaggatgttcctgacgagaagagcatgatctatcagttcaggggtggtcttcgtgaggaaattcagctcgctcttgtcctctttgagccgttgagatacatgagttctanaacatggcactganncaagaggcggctcacttgangtgttgatgcttccaggaagcgtgccacanatgttactcngtcttcctctantcaagtgntcaagcacanaannattggcttcatcccntcgttcggtnagcnntatcagcagaagancaaagtggatgtttttt

SEQ ID NO: 95288 - DNA, 486 bp, Triticum aestivum
  unsure (1)..(486): unsure at all n locations
  Clone ID: PAT_TA_95288
gaattcttaattcanagagttatagggagggacttatgtcaccacanacanaaactaaancangtgttggatttaaagctggggttaaagattataaattgacttactacaccccagagtatgaaactaaggatactgatatcttggtancattccgaggtaagtcctcagtctgnggttccgccccgaagaagcaggggctgcagtagntgccgagatcttctactggnacatggncaactgtttgnactgatgnacttaccagtcttgatcgttncaaaggncgatgntatcacatcgancctgttgctggggangacagacaatggatctgttatgtagcttatccattanacctatttgcananggttcccgttcaagcatgttnacttcnaatggaggtaacgtntttggnttcaaagccctacgtgttcacgtttgnaggattacnaattccccnactnatcaaaaacttcaaggccacc

SEQ ID NO: 95289 - DNA, 386 bp, Triticum aestivum
  unsure (1)..(386): unsure at all n locations
  Clone ID: PAT_TA_95289
cgcaggcgccgctgcggggccatcgtgatcagtacgtcgaccatggcgcggcagccgcgttgccgggcgactaccagcagcagcagccgaatctcgactgggacagctacggcgaggcgtcctatccgtgggtgccaccccactggccggccccggccgcggcgccggcccttgattggggagcgaactacggaccggcgtggggctccgcctggcaactgcgaccccagcgcgccgccgtggcacagcggcctgggcttctgatggacggagcggcagagctgggtcgcgcgagtcngagacgagcactacgtacggcagaccggatnacgagacaatacaatcnaagttaaacacagtcagtttaacatatatgtgctgggcaa

SEQ ID NO: 95290 - DNA, 308 bp, Triticum aestivum
  unsure (1)..(308): unsure at all n locations
  Clone ID: PAT_TA_95290
ggaaccgtacgcgcccaagccggcggccgaggggaggggctactggcggtggcacanggacgatttcttcccngagccgtcattcgcgagctggggcgcgtaccgctccgcgctngcctnnacccccgcnangntccgcnaccgcttcantggtcgttccatcnatnncatcattctctgancgctgtggngcncacancgagaatnatattctccgctcctcncntggtgtggacctcacttngttcggcttcctgtctcatcatncgntcgggatcttcnttctcatcngccatgacgngcacgaa

SEQ ID NO: 95291 - DNA, 652 bp, Triticum aestivum
  unsure (1)..(652): unsure at all n locations
  Clone ID: PAT_TA_95291
gtcgcccacacgatccaccagcaccagcacctccccctcccctccccctcctcgccgtctcccaccgatcccaacccgaggtgcgctccctcccctgctctcgagccccccacccccggtcccgcggngangctcgctcgcctcncgccgcgccgcgggcagccaatcgccccccactccgcgcggggaggctaggtagctcttcgttgggttcancatgggcccggtgaaggagggngccgncatggaagagggaaccctggagatcggcatagagtacaggacagtttctgggtgtggcaggacctctggttatcttggacaaagtaaagggcccaaaataccattngattgtaaacatccgattgggagatggcacaacccggcgtggtcaagttctggnagttgatggtgaaaagntgtcgtgcangtctttgaaggnattcaggaatagacancaaatacacactgttaattcaangcgagtcctgaaaatccgtatccttgatatcttggcgtatttaacggtctggaaanctangataatggcccnatattgctgaggctactngtacccggagttcattaccaagtgaganactaccnngggtatnacaggatacacatnagtattnncatgccgggcaagtnn

SEQ ID NO: 95292 - DNA, 504 bp, Triticum aestivum
  unsure (1)..(504): unsure at all n locations
  Clone ID: PAT_TA_95292
ttcatggctaaatttggcagtttcccttttttgcgcgatgtggaatggcattaggggatctacatctccttatatagatgtcatctgagcgtggtgaggggcctgtttgtaaaaaaacatggaccgttcgtattcactcagtgcacggaaatcgaagcgacaatagggaggaatcgtaaggggttattgccgggctgtcgttggtccgaattataatgaagaacccgccttgcaaagccgaagacatgagccggatactacatcgtcattgtaggcaagttcgggggctactgagggagtcctggattatggggtcctcgggtgtccggtccgtatancatgggccggactgatgggctgtgaagatcaagatggagggctttacccgtgtccggatgggacttccttgcctgggtggnaatttggcgtccggatgtatgantccntttccgtaaaccgactcgtataacctaaggcctccgtgtcnaaanaaacggnggatta

SEQ ID NO: 95293 - DNA, 584 bp, Triticum aestivum
  unsure (1)..(584): unsure at all n locations
  Clone ID: PAT_TA_95293
aacaacaacaacaacaaatccttcaacaaattctgcaacaacaacaactgattccatgcagggatgtcgtcttgcaacaacacaacatagcgcatgcaagctcacaagtattgcaacaaagtagttaccaactgttgcaacaattatgttgtcaacgtttgtggcagatccccgagcagtcgcggtgccaagccatccacaatgtcgttcatgctattattctgcaacaacaacaacaacaacaacaacaacaacaacaacaacaacaacaacaacaacaacaacaacaacaacaacaacaacaacaacaacaacaacanncancaacaacaacaacaacaacaacaacaacaacaacaacaacaacaaccgtcgagccaagtctcctaacagcagcctcagcaacaattccatcgggccaaggttcttcaagccatctcagcannaccacaggccaagctctgtcaacctcacaactcccagtcnaggaaatanggatctacacgganacgtacggnatgtgaatgtcaaatcctcatatgctcacacattcgcatctggatcttggataatanaaanaaact

SEQ ID NO: 95294 - DNA, 367 bp, Triticum aestivum
  unsure (1)..(367): unsure at all n locations
  Clone ID: PAT_TA_95294
ggcaagcactgtctgcaccagcctttttgtcaaatcaagcagttgccgaggcagcgtggggaagtggagacgcccacgtccaatcaaccaccacgcgtcgaccgaggccgcaggcttttgggggcccgcggcactccgtacttgacctttggcttcgcctcgaagccaagcccgagcgcgccttgggcccgggggctactgtcggcgttctgggaacggggggtccccagacttgcctgcctgcggcccacggcgtggctgtgctagcaagcctgttacggnccatcttcatcaacaaggattcaagacctccaaggggnggncccggntnccaaattcncccnataangagtcttnttaccgcgct

SEQ ID NO: 95295 - DNA, 579 bp, Triticum aestivum
  unsure (1)..(579): unsure at all n locations
  Clone ID: PAT_TA_95295
atcgctaataaataaagctcgccaagaaagctctaaaaaaaacaaatcttccaagcttacatacacatatttacagacggtgcattattcactgtcgtagcaaatggaaaagcaagcactgagaattcactttagcctgttgggatcagtctactcctgtggtcatggactcatgggaaatcactaattaagcagtcacgcttctttcacgtcctgctagaccggtgtcgtctgtccggctgcctgttcccccctcgccatcatcattgggcatttgagtgccacgagtttctttaactcccgggctattgggttactgcttgtagcacacttcgactctgtgatgggtcattctcaatcgcctccttaacccgtacgtagtacatctgacgggggacntgatcccgggtgtacangagatcgcgttgactttancangagccgcaataggatcgacactccgcatgtcccggactggcggcatccctgccctccggacgcgtgcaaanctgtctctgtngagngaaatcggcgcgtcacaacactntaacgggctcaactcgacaanacgcggccgaa

SEQ ID NO: 95296 - DNA, 613 bp, Triticum aestivum
  unsure (1)..(613): unsure at all n locations
  Clone ID: PAT_TA_95296
cccatgtctacaaaggcacccgatcaatgccgtgtagctgacggcgtctggttccaccccagcagtcctcatctcctcgaacaccagctttgcatcctccacttcccctttcttgcagtgtccatttataagagttgcgtagttgaaagcatttggctcacactcattcttcctcataaatccaaagatgtccgtgccttctccacctgccccaagacggcagaaccgtccgatgatcagattgtatgtcagctgggcccggacatgtggcctttctcgattatcccctccnaaatactcaangcttcctttnatcttaaccaagcacgacagaccaaccaacaatttcgaataagtgacaagttggcctcacatcgcgcaagtgtancaccatttcatccanaccctggaaggcgtcccggtcncgttccttgagtatgcttgatgaggagttttanaccagtttngaacgggnaagatnttcccggggccccaagccgtataagcggnaagatngggaacggagnnanatcgtcagnaaagnnaggctgtcaancgngcgtgagacacgaagagcgagaccaggctgcggcgagagcgagacgaaaatttt

SEQ ID NO: 95297 - DNA, 502 bp, Triticum aestivum
  unsure (1)..(502): unsure at all n locations
  Clone ID: PAT_TA_95297
cagttgaagtgagatctgcgctaagggttcatcagcaaccatgaagagcaccaagctcgcggcgatcctgatcctccaggccgtcctggtcatggggatcctctcacacgtgaacgccgactatttccccaagtgctgcaacaactgcaggtccttctcgggggtcgacgtctgcgacgacgcccacccccagttgccccaagggctgctcggcctgccgcgtnggtgacgccgaccctcacaaacttccggtgcgcccgacatgaagacaccgttcnatggaaccgccgcgggncaatgcaanacatgatccgtttaaggttcaggtcaaacaagtttccccctaaataacccaaatnaatacatcanggctagttnntttggcctgctataggcaaatatnttacgcactcntcttggcagtttttcccccccaaaaagtggggggctnnattgtcacntcccctcaanaaaatttagatgtntnttcaaaaaaaaaaaa

SEQ ID NO: 95298 - DNA, 496 bp, Triticum aestivum
  unsure (1)..(496): unsure at all n locations
  Clone ID: PAT_TA_95298
ctcttctctcctcctcctctccgcccccgcaccaccaccatcggagaaaagccagcgggaagcggggagggaaatcaatccccatgcccccgcccctcctcgccggaccagatccccggcgggccggcgcggagccgtaggcggggaccggcccggccgcnaattgggccggggaaggccccggagccgcggcggctcaagccngcgcgctcagcctgggacggcagcggcgtcccggaggaggcgctgcacctgggtgctcggtaactttgacnaccgcgcgaccgccaagcggctcgctggcttccgccgctggcacacatcgacgccgctcaacgccgnanactnaacctnccctttctgctacccgtgttcccggcgcgcctggtcgcgcgctttccgcgcctccnatcctcnggtcaaaggaancccgcgcgccatttangctatccccacatggggcgcctacccnccctgggttccaatngccgcccca

SEQ ID NO: 95299 - DNA, 611 bp, Triticum aestivum
  unsure (1)..(611): unsure at all n locations
  Clone ID: PAT_TA_95299
cgacgttgcaatgaagcgggggcgctgttgccggcggcgcgacaaggcgaggacggcaacgctgccattaagcgtgccctgctgccggcgatgctgcaatgaagcgggtcgccgttgccggcggcgcgacaaggcgacgacggcgacgctgccatgaagcgtgccctgctgctggcgacgttgcaatgaagctggntcccgttgcccggcgacgcaacaagcgaagattggcaacgctgccattaaccaagncgcttgctgccggcgacgctgcaatgaagccgatctaccgtccnaagcgcaaaagtcaagggacgaacgcgcttccatgaagcgcctttnttccggcgattttccatgaacncgttcttcttcccgcgaattttncaattaaccggtnctgcttctnggatcgaaanttttaggacgggacctcaataacttggcccctttgnttcngttttttgcaacggtccctcaaggntccggaagtgtgtgcaaaacggaaaatnngcacacaaaacctgtggttctnncatagaaacaaccgggtcgnttactataaagntnataataacntacacacgncaagttgcgtttgcatattntca

SEQ ID NO: 95300 - DNA, 354 bp, Triticum aestivum
  unsure (1)..(354): unsure at all n locations
  Clone ID: PAT_TA_95300
atttgcagctgatgagtcgaatttcatttcaaatatcagtttgaaccttgtaatcttcgaatttgagccatataactctggaatttgaaccttgtaatatttcgagcttttgtgggtgcaatcgttgaaatggcatccgtatgagactccgtatattggggagcactattttgaccttaatatgcaatgggaattaagatttattaaccattcctccgaatcctgtttaccttggtccgattctccatagcacacgattctggttatagctaactccggctgcgattcttccgacattgttgcacacagttggttccttcaaccgtnttccctgtagattcgcaanattnanta

SEQ ID NO: 95301 - DNA, 607 bp, Triticum aestivum
  unsure (1)..(607): unsure at all n locations
  Clone ID: PAT_TA_95301
gtgttgacatttctaactgaggttgaacaatactactccctccgttccctccgttccaaaatagatgactcaactttgtattaactttatactaaagttagtataaagttgagtcatctattttatagaacggagggagtactaactaaaactccgttcagaaaatgaaancacatttgcctatctagattcaaactacaaaaantcatttccaataacaagcattctcatgcagcatacagtcccaggctaatatgattaaataacaaccgganattctcaaaaccaagccaaaacaaagccaaccacagacnaatacatgggtagacaatanctcaaacaaatcccgatcaaattcngcttcntaacttgacgnatttcaacttcnggaatattgtnccaaactttaatccttttccccgattnaataaaaggaacccccggangngtcatctgccaagccttgaatcctcaaaaaannngctgggcaagcctccctgctctcntaanatnaacgtgcctgatggggccananataccagnccccttcgccganttgctnacccacgnatnttccaatccagcaagtttccggaggaatctagga

SEQ ID NO: 95302 - DNA, 572 bp, Triticum aestivum
  unsure (1)..(572): unsure at all n locations
  Clone ID: PAT_TA_95302
acgttttgagtgaaactttgatgctctgcattctgaagactgagaggttccttggcaggctcaggatagatggcctcaatcgacatatccacatcaggcagaaaaatccgatgattgcgaccanatggctgatatgagatagtggagtgaantttgattnagccgcatgacccatggggcgttnaaactcaagccaaacagttntaaagcctggatgcagcaagttttgcgaatgaagaatccctgtcattnnacattttcccaatgnaagatatannaaaccaaatccttcaattgcaccnttcaagctttgaagttganaatgtncccttttaattggccaaaaatttcccccttaanaagttaaaanngtcctttggntgaacccaagngtttcaaacnaaactccccatgggaataacaaaccttttngggaatnttnnccaaacnggtncncgcccnantaagtntanttccgnaaaaaagccccaaaactncacnngaaactgaaaccatccctcaaattgcaagatgggnaactatnanccaatgattnaaaggtttgcttaata

SEQ ID NO: 95303 - DNA, 468 bp, Triticum aestivum
  unsure (1)..(468): unsure at all n locations
  Clone ID: PAT_TA_95303
gacggatttgagccacagccgagcacgccgcactgtcacaatgggcatgatctagctctgccgccggacagtgcccagagtgccgctcaggtgtccgctccgacccttagctcggagccaactacgccggccgaggacgggtggctagacgccgcctccgggggctacaatatctacagcgattcgagcccgaataccancttgtccttttgtgaagtccntgacccaaaggtgcccggctccttttcccggactcccaaatctttccgnaccctttccgattttgaaccatttgntcccgattnacggattcaacgcggncgaatcttttaanatccgcctttttgggaatcctgattcacaaagtttcccccttttacaanganncccttgccgatatggcacaaggttggaatcgncacaaaatttnaaccaccacaacaatttaancaatntcnaatttaacga

SEQ ID NO: 95304 - DNA, 486 bp, Triticum aestivum
  unsure (1)..(486): unsure at all n locations
  Clone ID: PAT_TA_95304
aggctgcccgcctcgttcgccgatgcttggggccttcctnctncaaacngcnggactttaagtccngccctcgaacgcccgaactcgatgcaagccgcttgcacctccgcccaccgatgcaacaagccggcgtgngaaagnaagggccgcacccgtncgccgcctccaacagcnaagacccggtattgggcaagctccccnagcaacggccacatccacagccggattcccggtaacggccagtccccnagccaacgccgccttctaacagccgatttcgctgccaagcagtacccnagacaccgccncttcnacagcgatttcnctggcaacaacttacccnaacaccgccgcttcnanagcgattttnatngngaacagctaccaaaangccgccgcttcaaagccgacccggtgaacaantaccnaccaaaccttttccaaaaccgacccaatggaanaanttcaaccacggcttnccaaaac

SEQ ID NO: 95305 - DNA, 624 bp, Triticum aestivum
  unsure (1)..(624): unsure at all n locations
  Clone ID: PAT_TA_95305
attctcttcttagggtcaaataaattttcatgtgcttaactattgcaattaattaccatgtgtcccaacatttttgtcactaatcagcacatgattacatattttgatatttgagcgacattacagagtagacaaaaccttagctggaaaataagagacaagcattaaaccatgacctctgtttggntccagggtgggatccaaaatgttgtctcaagtatatgataatttcatcttgggaataagtaccagcaaacttgctccacaaccaccctccacacacaaaaaaatatatactcccacaactaactatcacatattcaaatgtaacnctgtgcagcacaacagatacaaccaaagtaccttgggaatttatcanttccgatgatatgcaacagcttatcacctatgactatggatgcanccaacctaaagtcncagtcnaccaaanccttatcagggccaacacctanacgacatcnacgggcatacacggtacagcatttccctgccanattattnaaatccatacacaagntcaaactctttgtctaagcggtcncatgtanctcaggaanagncagtacctccaagnagccgcaagacccccacantggnaaacan

SEQ ID NO: 95306 - DNA, 170 bp, Triticum aestivum
  unsure (1)..(170): unsure at all n locations
  Clone ID: PAT_TA_95306
cgtgactccaaccgggactaatgccccctttagtcccggttggtaccacgaatggggaccaaaggnctcttttcancangtcccgtttggatgggannaaaccgggactaaatggggggcnctttantcggtgtttggtntcaccanncancaagcannaagaccctgtg

SEQ ID NO: 95307 - DNA, 340 bp, Triticum aestivum
  unsure (1)..(340): unsure at all n locations
  Clone ID: PAT_TA_95307
ctccccctctcctcccccccgccgccgctccccagatccgctgccatgtcgacggagaagaagcagctgaaccccatgcgggacatcaaggtgcagaagctcgtcctcaacatctccgtcggcgaagagcggagatcgcctcacccgcgcctccaaggtgctggagcagctgagcggacatcacctgtgttctccaaggcgaggtacactgtcaaggcgttcggtatcaaggcgtaaatgagaaaattgcgttgctactaacnatcnaggggtnaagaaaggcaatgcantgctggnanagtggctgaaagntaaaggagtacaattgccaaggagaatt

SEQ ID NO: 95308 - DNA, 625 bp, Triticum aestivum
  unsure (1)..(625): unsure at all n locations
  Clone ID: PAT_TA_95308
tttttttgtcaccaccatggtaggcccctatcctaccatcgaaagttgatagggcagaaatttgaatgatgcgtcgccggcacgaaggccgtgcgatccgtcgagttatcatgaatcatcggatncagcgagcaagagcccgcgtcagcttttatcctaataaatgcgcccctcccagaanccgggtttgttgcacgtattaactcctaagaattactacggttatcccgagtacaacntaccatccaaacaaacttataactgatttttaatgagccattccgcaattttcaacaatttcaaatttggttcnatactttgcacatgcatggctttanccctttttnagaacaanaaatgactnactggaaggatttaaccaagttacaacntcctttnggtggactaacaacacgcattcgttctgcgcttcaatttccgttngaacccnanagnaacagccggccgtcctcctccntttaacngganactcancaaccttgaggntttggncaaaaattcctttcctacaantaacgtggaaagtaaaggaaanccgttccggttttccaattccaaaacttgggtcggtcagnaaccaaagggcnnaccntttctagagatc

SEQ ID NO: 95309 - DNA, 426 bp, Triticum aestivum
  unsure (1)..(426): unsure at all n locations
  Clone ID: PAT_TA_95309
ctccnaccccnaccgtctcgccgccgcnacnanagctagataagaaaaaaagananagnagaactcgttgggagtgctcgagacggtccccgggagaagggggaattcttgaaatcggaatcggaacaagccgggcgcgctcgggattcggggttaccatacaattttcccaggaacctttnagtgaatgttgctaatgggagtccaaagggtgggcaaaaantcctagcattagtatttccctgatgttacgaagtcccctccggttacagcatttgaagacnttcacctgctgggaggcgccaagaanttctccggctgcatactccaactggcgcgaagaaccaccctgatatcttttttggatcccctttccccgtantttagnttttttatcattttatcccganccttttncccacatct

SEQ ID NO: 95310 - DNA, 479 bp, Triticum aestivum
  unsure (1)..(479): unsure at all n locations
  Clone ID: PAT_TA_95310
ccgcggcgccgcgagctctccgctgtccggcaagctgccggcgtgtcagcggaggcgaccgccgctgcccgttcatcctcaactggtggtttccgcagctccatcagcgcgcgaacttggagaaagaagggcaagatatgacacatctgtccaattttttaacccggggctggtggtggttngaancgctgatgggggcagctgaacccaaccaattcaagcgagccgattnacgaacggtaaaaaattatatacctcaaacaagcccaaggtatattccttgaaaaaaanccatttcattcagatttcccgacaaagtttccaactgaaacnttcaagcaccattngcaactgcanaatcccacaagtctgaatcctnaagnaaagaatttgttnacctgttattcttttttcnagatacatactttatanatacccaagttgatttcacaagtaacttaagtttctgataaatattc

SEQ ID NO: 95311 - DNA, 481 bp, Triticum aestivum
  unsure (1)..(481): unsure at all n locations
  Clone ID: PAT_TA_95311
gagcattctaccaccgcaccgcacgagtgaagtgagagctttgcacgaaaagttcatcagcgaccatgaagggcaccaagctcgcggcgatcctcatcctccaggccgtcctgggtcatgggagtcctctcacacgtgaacgccgactatttccccaagtgctgcaacaactgcaggtccttctccggggtccacgtctgcgacgacgcccaccccaaagtgccccaaagggctgctccggcgtgccgcctnggtgtccaacgagcccccgaaatgtgggcgcctgcgccgatatgaaaccaaccgtncgacggcacctgcngtgggcctgcaaagaantactgatntggtcaatgccaacatgatatttcccgcctaaaaatgaaataaaantccanacgaatgacagctcatcntgcctagcntgtttntttgggcaaacaaatattntacaattatcctgtcttcctccncgtttttc

SEQ ID NO: 95312 - DNA, 612 bp, Triticum aestivum
  unsure (1)..(612): unsure at all n locations
  Clone ID: PAT_TA_95312
cctcctcctagcaagctatatacctacatagtacagccatggcccccaccgtgatggcctcgtcggccacctccgtcgctcctttcnaggggctcaagtccaccgccggcctccccgttcagccgccgctccnaacggcgctagcctcggcagcgtcagcaacggtggaaggatnnaggtgcatgcagtgttggccatccgaagggcatcnaagaattnccnaaccctgtcctacttnccnaccgctcaacacggaggcctccctttaagcaagtccgactaccttgattccgtccaaattggntccttncctccganttnacaagtttggntcatcttcccgtnnanaaaaccacccctggggtataacaatngccgtactggaaatgttgnaactgcctattttcggatgaaccgacccagcaagtgattaacaaggtggaggagntcaanaaggattacctgacccctatttcncataatcggttttaaaanagctaanngnattcgtaactcangccttaaacaaccggctcaagatcgcaggctaaantatcacaagcatttaatgcattattttnacctaattcttgtttcttcatactcnattcn

SEQ ID NO: 95313 - DNA, 586 bp, Triticum aestivum
  unsure (1)..(586): unsure at all n locations
  Clone ID: PAT_TA_95313
tcgacttgcggcgacgtttacagttttgggattgtaattctggagatgctgactggcaaaaggccaacagatgattcatttgagaacggacttaacattgtcagcttcgtacaagtgagttttccaagaccagatactgaaagtcactgatgctgctcttcaggaggagtgcgagccctctacacaatccaatacagtaaccgagagcgantcatccgggtgcttgtgcatctgctgggaggtggacttccttgcacgcgccaacaccaagtnnagcggataaacatgaagcaagcaacggcagangcgttcaaccaagganccatatgtcaaagaacagcatcgttttcctccccaagngaaagacatcccaaaggacattgcatcaacttcccctttcnctacaanatttnacanacttccncaatggaaaaatatcnaaccagtttactttacaacatattcatcncatnactngntatgncaanaagtnnaatcatttctaaaaacccatgtaaaaggttctgcatttcataattaaagtatggcttggcccataaacanttcgntacacaaaaaaaaaaaa

SEQ ID NO: 95314 - DNA, 519 bp, Triticum aestivum
  unsure (1)..(519): unsure at all n locations
  Clone ID: PAT_TA_95314
aatttcaaaacaagaacattttctgaaattacgaacatttttttgaaagtgaacttcttttaaaatatatattttgaaaatatacaaatgatttccagttacaaaaaagttcatcgctaaaaatatattcattgaataataaatttttatcaatttccgaaaaaatgttcacgaattttaagaatatgttagtcaataaaaaaatgttcctgaatttcaagggaaaaatatcaaatttcaagaaacaattcctgctattaaaaaaaatcaagggactaaaaatattccacattttaataaaataattaacctgggatttaagaaattggtcattaaatccaaaattggtcctggaatttggcaaaaaaaatcgtgaatttaaggaaatgtgcatattttcaaggggaaaacccaattggttggtgaatgggaaagttccagaattcaaaattattgcaanttcnaaaaaacctggatgacagatgacagatncaaaaagccncgaattggaaagctcca

SEQ ID NO: 95315 - DNA, 633 bp, Triticum aestivum
  unsure (1)..(633): unsure at all n locations
  Clone ID: PAT_TA_95315
aaagtgtaccagcttttattcaacaaagtacgggcatgaatcaaataggcccaaactattgctgtcaggatccaatctacactgacaacacaaaacaaatctgaatttcaatgctatgggaattaactgcatcagaatctgctaaaaaatgactatgttgctggaatggagaggagcaaggagttggctgtacagcaagagagtttccactctgggaccatctcctacccaaaccaaatatccacaataacatatcaactataatgggtgcccggctcaatttacagttngagcaaagcaacgaacaaaattgtatccccaaggtttccaagcaagaatgcaacgcaaagaggcactgcactaatgcagcgcatggnatctatcaacaacatgtacctctccccgcttgattccctgtctccaaacgccggagcctcaaggaattccanttgcngcatccccgcattttanccattgggtatggccatgncncgccctgaaatnctngttnagccaccctgtttgactgctgtccaatcacggtacggantaccgccatggccgtgactactcatcaaggccctgttcatcaattattgacncgcggtgtacgacccattaggttncggcctn

SEQ ID NO: 95316 - DNA, 440 bp, Triticum aestivum
  unsure (1)..(440): unsure at all n locations
  Clone ID: PAT_TA_95316
cagaaacatggctagggcctagaagaccttaagaaaacaaaaaatatcagatttttttataatagttaaatagtctaattcaatttcttttttcattgcgtccatttagtttcaaactttcaatcaggtcaaaataaagaaaaatcaaagacaattcttggccaaagaaccaatggaaggaaagaaaaataataatacctccgatccataataagtgtcgcggtttttaactaactctgattcaaaacgcgacacttattttggatcggaggtagtacaccaataagaacagatgtaaacaaccaanacttgatgaaaaaatagactatagtaaaaggtaaaaagtaaaaagtaaaggaaaaaaacggtgaatctttcatgcttaaatatccaaggtgatgcttnnaaagagcataaaaatatccngaaaattanaaata

SEQ ID NO: 95317 - DNA, 192 bp, Triticum aestivum
  unsure (1)..(192): unsure at all n locations
  Clone ID: PAT_TA_95317
gttggcttctcctccccttccggttcgggttctggttcggttcgggtccgagagtagctagcctagtctagggtttccgtagttcgganaggagacaaagggaaagatccanggnngatacngaggtancgctgcttcntgggcnaggntcacntgngccaccgactnacaaagccnccagtaagcacttca

SEQ ID NO: 95318 - DNA, 254 bp, Triticum aestivum
  unsure (1)..(254): unsure at all n locations
  Clone ID: PAT_TA_95318
cttctcctccccttccggttcgggttctggttcggttcgggtccgagagtagctagcctagtctagggtttccgtagttcggagaggagagaaagggananatccatggaggagacngantaccgctgcntcgagggcggccncgcctgggccaccgacgacnataacctccagaaggcctncagccantacngcnagatcntcgangccaagatcatcanctagngtnagaacgncaagtcccgtggnttcng

SEQ ID NO: 95319 - DNA, 605 bp, Triticum aestivum
  unsure (1)..(605): unsure at all n locations
  Clone ID: PAT_TA_95319
gccatccctggcctccgaagtgccagggtcactggtactgttgcttctacgagccaaccagctatcttcgctcgtgcagaagcgggtcatgagtgcagtaagagctgccatagtcttcggcttttcctgaccgaggtgtcgggtgagccattcgtcacggacgctgtgcttaaaggccgctaaggcttcggtgtccggacattcgacgatttggttcttttttattaaagaatcgatccagatttgtgggtttgacctccgggttgctgggactatgtgactaaggtcatctgcgtccggtggccaaaacataattacttgnattgtctcgaaaacatgctccaaatctcccaactgccaataaattctctgggaagtatcaacaatgtcctgctgggcctttaactttcaagggaagtattaatggnttgnagattttcnacgncaaccaagtnaatatgagaaagaaancttcaatcaataaacggattgtcntcaacaanagctcaagttangggctaaaccttgtnaaaatgngctgattactcacgtgaaacananggtntcgggncncgtatggnanatacacggtttgtaaactgttt

SEQ ID NO: 95320 - DNA, 502 bp, Triticum aestivum
  unsure (1)..(502): unsure at all n locations
  Clone ID: PAT_TA_95320
ccggcttcgtgccgctctgtagccgcgtcgatcagctgttggatgcgtctggtcatgtaggggagctcgtcggcccccantccgtttagctcgtcaacgattgtctgggcggcgcgtagattcttgaggggcgtngcgtanactangcggtccgctcccancatgctggcgatngccgcaccacgtttcntnacaacgccganttaggcttnggccttngntggacgccgtgttccaaaggcggcgcatcaacttcaagctaatgggttctgtaaagctctcaaaggtggtacttccggcctccgtattaaggcaagcgcttcctccatctctcangtcagattcccccggattgggacgncaaattttncaatgcggcttcaaggcttaatggctntnccctangangcaccctttgctgatacacattngggtacgtnctccgcatacgcnagggtngngcccccngnacnattcccccaaatgatccttattacccccc

SEQ ID NO: 95321 - DNA, 576 bp, Triticum aestivum
  unsure (1)..(576): unsure at all n locations
  Clone ID: PAT_TA_95321
ttgcattttcataactcgtgaaatgccgagtaggcacgaattcccccaatttgcgacctaccataggatttgttatgtaaataggtatatgttcctttccattatgaatcgcgattgtatggccaaccattgtgggtagaatgctagatgcccgggaccacgttactattgtttctttctcctccttcatattgaccttttctatctttgccaataaatgatgagctacaaaaggatccgttttttttccgtgtcacaagctggattacccttttttccctttttaaaagagtggcatccaagtccaatatctccgatttgaagtacggaggtcaaaataaattgaataatgatcnaatgggaaaaaagaaaaaaccctttaactgggataaagggcggtnttancaagtggtttnaggaattggttgtnanccacaagccnggtnaattcccggttcntcgccancgcatatgcaatccnaaaancatttccaaatcccantncttttactnaggggacaanaataaacacgcaattttccttccaaatctctcaagcnaaggtaccanggtnng

SEQ ID NO: 95322 - DNA, 587 bp, Triticum aestivum
  unsure (1)..(587): unsure at all n locations
  Clone ID: PAT_TA_95322
tgcaggcgccgcctccgcactctgccgccgcagccgcagccgcagccgcagccatgggcgcgtacaagttcgtgtcggagctatggaggaggaagcagtcngacgtgatgaggttcgtgcagcgcgtgcgttgctgggagtacaggcagcanccggccatcntgcgcatcaccaaggcccacccgccccgacagggctcgccgtctcggcttcaaaggccaagcaagggtatgtgggtctacccgtatccgtgtcaagcgtngtggcaagaaanaggcaatgcccaagggtattgtccnatggtaacccnaacacaaggtattaccaactcaanttcaangngaacaagagctgttgccnaaanaaaacttgcgcaagtggttggcttccngtgccaatcccnacgggggnaangaggatccaactacanattttnaggnaccctntttnaantttgccaaaangtttccnnattaccaaggttaaagngccttnaaacctttaaaaacaccttnattccnggccaaantngcggaaaaattcctggccgctggaaaggcacgcacanaagaaaggcctcaaggaac

SEQ ID NO: 95323 - DNA, 386 bp, Triticum aestivum
  unsure (1)..(386): unsure at all n locations
  Clone ID: PAT_TA_95323
ccacatcctcatcgtctccaacctcggngaaaccctatcctagccccgccgaatcgcgagtccccccgaagccggagcaagccgagatgtcccgcaccggaccgatcgcccaggactgngagccggtggtcgtgcgcaagaagctgcnnaacgccgccgccaagaangacgagaangccgtnaacgccgnccgccgcgccggcgtcgacatcgacatcgccangaagcataangctgggacaaacanagctgctcatagcaccacatcnctcaatncaaagagcttccatngatgatacaagagatccttgctcaatnancgtntgccgtnnagacctgnatnaanacattatcaangnttgaacggncaagagnccaaacatgca

SEQ ID NO: 95324 - DNA, 516 bp, Triticum aestivum
  unsure (1)..(516): unsure at all n locations
  Clone ID: PAT_TA_95324
ttacaacatccagaaggagtccaccctccacttggtgctcaggctccgtggtggcatgcagatatttgtgaagaccctcacgggcaagaccatcaccctggaggtggagtcatctgacaccattgacaacgtgaaggcgaagatccaggacaaggagggcatccccccggaccagcagcgcctggatctttgctggtaagcagctttgaggatgggccgcaccctgggcggactacaacattccngaagganccacctttcactttggngtccntctccgtttggtgggcaattaaagtccctgggcaatgggactctgcttccgccccngggcccgcaanctccncctttngtgccttcaatgancccctttgtgtccgccgtttccnattctgnctttgttcccggtaccgtaattgagcatgttacattttgtaccttccacttccngcgggntncaacacttttggggaacaatgataatnaacctgattcatttgcctttgcggtggnttt

SEQ ID NO: 95325 - DNA, 621 bp, Triticum aestivum
  unsure (1)..(621): unsure at all n locations
  Clone ID: PAT_TA_95325
tccacacctaagagggtggtgaacagttgccaacgtagcgaagagttaagttgccatgataccataatgagacgtcttagaggaggagaatcatagaattattaccttaagtggcaaaaagaattacttttgatacatagttcattgtaacccttcataccagcctggaggcaattcaccaacaaccgtttgggtagagccgcgttngaatgggcatactccggactgggaatggatgatgttggattaccttggtttgaaagacaatgcaatggatgattttgctttatcaaccaagaaattgattgaaatcccatggtaagacacttttngaagacgattcatgattcnantnatttactngagaaaggttatcccataatagatgttcacaaatgggcgggtgccaagcctangaacaaatgcaaatgcttggnatgattcccaannactaagggattaacccacatttagagtggtccacngttttaaaagttntncataaccgaggaacgggganacccanntatccnatgataaactaatgnccnctgcctcaagaantaacattcatatcacaaggttacaanacctgtcagatcggcaaanacatacacatgt

SEQ ID NO: 95326 - DNA, 245 bp, Triticum aestivum
  Clone ID: PAT_TA_95326
cgccaccaagaaacccaaggcaagtgaccccggcaaggaggttgccgggtgtgccgcttgccgggccttggcggccgccgataagccaggaggctccgacaagcagtattgcaagatccaccacactgagggccacgatctccaaaactgccgacaggtagagctgctccgcccgagaagcaagaaagcccgagtatgagcggcgggacaaggataaaggccagatggtccgagggattcggaac

SEQ ID NO: 95327 - DNA, 549 bp, Triticum aestivum
  unsure (1)..(549): unsure at all n locations
  Clone ID: PAT_TA_95327
cgctgtcttatttcggaagattacagtcagctgtcccttatcattgaagacgacatacgagaagagttgagacgattttgtatagaggttgcccggtttggagatctgtgtgaagatcctcaatggcacaatctcgatagatgcggttctgcactgacagtgacatctaagaacaactccagtgaagaacacctcccatttgcatatctgataaaattgggcacaaaatacatgggttctgcgccaaagaaatgctagcactggacagacttnaacacgctcattatttancaactgttcccggttaagaaacaattgatgctatcaagancaaaggggtgcgtgaaggccttnaaaaggaatcntatggccaaaatatggaaaattgttnanaacttgtgggatncntngctcatcaacctgnaatnaacaaacttctttggnnacatgccgacaacatcggganatcntgnggctaaaaccncaanacttaggccgctggatcgcttgcatacncaagtnatttgagtaaaacttgcatgcatcaca

SEQ ID NO: 95328 - DNA, 637 bp, Triticum aestivum
  unsure (1)..(637): unsure at all n locations
  Clone ID: PAT_TA_95328
aatgcgttgaggcgcagcagttgactggacatctaggggtaaagcactgtttcggtgcgggctgcgcgagcggtaccaaatcgaggcaaactctgaatactagatatgacccanaaataacaggggtcaaggtcggccagtgaagacgatgggggataaagcttcatcgtcgacgagggaaacagccggatcaccanctaaggccctaaatgaccgctcaatgaaaaaggagtggggggtgcaaaagacagcaggaggtttgcctaagaagcaccacccttttaaagatgcgttataccactgattnnacgccctttcgctgaaagattaacggggctnagcattctgcccgaactgtnggatttcaaaatcatcncgtagggaaccnttccgcctttaaangggaaacaaccgctaaaaccgggtccacnaaaccggaacanaatgtccgtttnattacgaaactgnggganancaatgcccnaaaaccaaggttctcccaangtcgtcanggaggtgagtanggcctaaataggcgaaaggntntcatgcnacagtcatatccggtcaccctgntggaacnggangagagcagtnccagtggtntagttagncagtcctctttttagaaaggtaa

SEQ ID NO: 95329 - DNA, 634 bp, Triticum aestivum
  unsure (1)..(634): unsure at all n locations
  Clone ID: PAT_TA_95329
gagagaactagtctcgagttttttttttttttttttttttttttttttttttttttttgggcgttggcaccgggggcgagcggaagcggcgcctggacgccccactcatcaactccgcggccaaactgcagcgccgcgagatcggggggcggnagctcgccgcgcgcggngggcggcgccgcggccgccgtgcctgagcggttccggaacatgcagtccaggaagattttgacacatatgattnatgatgcncaactaatttgggaagcaaanttttcncaaaaaaaattccaaaattatggaaatcgtcccaacaaaaanattaaatttccccttgcccaacccgggctttgggcgcctttaancccaagtaaaaaaaacggtaacctccttgaaatttaaccccgacnaattatccggatttgttccaaaacaagaaaacatcnctatacgnccaatttagcatcaagncatttaccacatngaatgcaaaanacccaacganatatagggggacaataaatcgggttcccctttnacngaanccgaatgcccgtttgtnnttnggattaangaaancccattccgcaanggggnncaaaggtttgntaaaaacccctttaataancggaaa

SEQ ID NO: 95330 - DNA, 564 bp, Triticum aestivum
  unsure (1)..(564): unsure at all n locations
  Clone ID: PAT_TA_95330
gccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagtcgaggacggccgcaccctcgccgactacaacatccagaaggatccaccctccacctgggtgctccgcctccgcggcggcgccaagaagcgcaagaagaagactacaccaagcccaaagaagcaaaagcacaagcacaagaagtgaactcgcgtcctccattctacaagtcgacgacccaccggcaagtgacaagtcaaggaaggangccccaacgccgactggggngccggacttcatggcaacatttgaccncatatgcngaaangcggtcactactctacaacagaagttanaagtggcgcnttgctcgctcttttactactatnagatcaacnattaatttcnttgtcttaataaac

SEQ ID NO: 95331 - DNA, 570 bp, Triticum aestivum
  unsure (1)..(570): unsure at all n locations
  Clone ID: PAT_TA_95331
tttttttttttttttttttttttgaaccacaatccagtgaagccgtccatgcatggcaacaaacgtgtttgcaaaccgctagatgggtcatcgtgcaatggtcgtccaccctatatgtcatgtgcacagtagtttcctaagaccgacagagtgcagcaaggcagtttaagaaggaagtgattgggattttgggacgagatgaatccgatacatgtggcaactgttgatcaacctatatacctaatggaaaggccggctgatgaaatacnatcaatccgaaanatcctgcctaagtacaattanaacngtancatcaaaantttgggcaataaaagggntccnagggcccnaactttggcccnaaacnngcttttcaaccctggctnnccaaaggacttggaaccccaacccggacncccacnaactttgactttgantcaaccggnaaanaggggccacnctccaacggcaaggccgaaggccaacacaccgnnggtgtcaccgcanaatacacacggtagttcccaggggcccacnctaacttgnnttaacccanaaccccggggtaaa

SEQ ID NO: 95332 - DNA, 239 bp, Triticum aestivum
  unsure (1)..(239): unsure at all n locations
  Clone ID: PAT_TA_95332
agggggtcgggcagagctacaagagtgggaggcggaggggagctggtctacatcaagatattgggangcggnggggcggnatggcnactagctgcacaacangatgcaanccgcnatggtgctactacatganacaaccgcgtcncctaggaggcnactcnggggaaccctancccgtcgcgccnccacnccctctccccggntccccctgccgcgccgcngccgnaggaaactgccgg

SEQ ID NO: 95333 - DNA, 316 bp, Triticum aestivum
  unsure (1)..(316): unsure at all n locations
  Clone ID: PAT_TA_95333
ccggcgtcgaggacggtggcctgctctgagctgcggcttagggaggtgaaatgtagggctaataagccgcaggtggcgtgtcgggcgcgaccagctcgtgtatgggcgcgagcaggacgcgtcgggtgcgccgggtccgcggcgactagcgcgtgtgtgtgggtagcacgggcgtgttccgtgcgggtgcatgcagtgtgtgtgtgtgaccgctggcgttgggcgaaccgcgcggggttagcgcgggcntctgtttggagtcatcccgttggccgttcgccggaaacgcgtcnttgggcgcnaacattgcggatcg

SEQ ID NO: 95334 - DNA, 418 bp, Triticum aestivum
  unsure (1)..(418): unsure at all n locations
  Clone ID: PAT_TA_95334
ctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatccgtcatcaaggcccgtccctncaaggttgtttgaggctccactccaagactggggaagcatggtcacgcaaatgtcacttttgttgccattgacatctttanatggaaaagaacttntaggtatcgttccttttatcccacaactgtgactcncccaagttttaccgccaaatttcanctgatttgacataactgatgatgtatntcactttttaacnnanaattggaacaccaagagacttacttccact

SEQ ID NO: 95335 - DNA, 678 bp, Triticum aestivum
  unsure (1)..(678): unsure at all n locations
  Clone ID: PAT_TA_95335
ctccgtctaggtgtataagtcatcttaggtttcttgctagttaatagcattccatgcaatgaattaacaactacatgtcatgtttgaaagtctcaagccattgaaagcatgcacgacccacatctcgtattggttgatatgtcatgaaacaagaaacaaggagggagttaatgtacagtgcctaagtgttttggggattatttgggttaatgtacagtgcacggcccacacctagatggagggagtacaaagagaaaaaatgaatgcattaaaggaatgacattctaacaaaaatgtgaatgtgaactacatatgtgtgcacgtgaccaacacatacattggtccaatacaaatcctaatgcaagaaatacttatggnaacatgcatgattggataatgtggggcttgcagcatagattacaaaacatgtgatttacactngcagcagactgtccttgtgcaaaattcagtccaaggaaaaantacnatgggtgtacaacattangatanaagagttacancatcaantgtaggaagaatgcagtaccaatccaagantaggattggaaagagnacanttgtaacatagaactttcatggtgtnaatgcatgtnccattncanagngatnaaaaaaancatttgtcacngactttcatanacnaagtatttctnatng

SEQ ID NO: 95336 - DNA, 588 bp, Triticum aestivum
  unsure (1)..(588): unsure at all n locations
  Clone ID: PAT_TA_95336
gctgcatcctccctctcccacatcgcagctctccttcctctccttcctctcctgactcctcatgagtcacgaccatggcttctcctcgccgaccctagccaccgccggcgatcgccctgctcccgttgtcggccctagcctccttctctgacccccatcccctcccatcctcttctccctgtctctcctccagcccctacctgcaggctgcagcagcggtgagccggcgacataggacaggcagcaagcagcaacctaggccaggcagcagtgccggtgacctaaggccaagcagcaacgccgtcaacccctccgaacaagtccccatggttcaacaaacancaaggtacatgtctgctaagattcactcaaggttttaactccgctatgantccatccaatttggggaacaaattngcaggggcnaaggnagtcaaccgctgcaattctcaaatctcaaganaattcagtaacaggttgggattcnaacttgattactcnaaattatccnatgaatgcaatgttggaaaaaatttggaggatataggagaanaaaaatgcaaatangggnagtaaacctgacgngnn

SEQ ID NO: 95337 - DNA, 580 bp, Triticum aestivum
  unsure (1)..(580): unsure at all n locations
  Clone ID: PAT_TA_95337
ccgatgtcccctatcttgtttaacattgtggtggatatgttggcagttttgataggaagggctaaggaaaatggtcaagtaggtggattggtgcctcatcttattgatggaggggtctctatcctacagtacgctgatgatacaatcatctttatggagcatgacttggctaaggcaagaaatatgaagctggtgttangcctatttgaacaattgaccgggttaaagataaactttcataagagcnagctgttctgttttgtgnagggccanagatgaacangatgcttataggcaatttgtttgcgatgtgagttgngacagctaccattctcaatacttgagngatcctaaccaccatcgtangctaacatacagagaatggaagtncatccaanggaccgatttnagnacaaatgagttgctgggaaggcanctcattcatatgnangcgattatcctaataattcnngctcacaatattccgagttctccntcttccttaggacaattggtgtagaanancggctcaaaatngcgtctttggaagttntactangnaaaangcttcaatggaccn

SEQ ID NO: 95338 - DNA, 390 bp, Triticum aestivum
  unsure (1)..(390): unsure at all n locations
  Clone ID: PAT_TA_95338
gcgcggaaggctccgcgaaatttctgctcaaccgaccagcaaagcgtgaaaggatagagcactggccatggttgtggccggaaacagaaaccacctatttgcagcaggaagaagacgcggtgtggtancctggtancgcttttgactcaaccatacaagcatctgttctatctccatggtgctactacgtactcagctgggaagagcacgacgggtccctctctcacaccaaccacctttctctcctcctcctcatcctcctctctctctctctctctctctctctctctctctctctctctctctctctctctctctctctctcacgcatccntcctcntttttcttccntgcanctatgctagcacaagggttgctccangggggggg

SEQ ID NO: 95339 - DNA, 610 bp, Triticum aestivum
  unsure (1)..(610): unsure at all n locations
  Clone ID: PAT_TA_95339
aaaggatacaaaaacgtgagtttaatgtaggtgattatgtattgttatacaactctcctttaagattttttacaggaaaactcttctctaaatgggaaggtccttaagttatcgaggaggtctatcgttctggtgccataaaaatctacaaattcgaaggcacaaatccgagggtggtgaacggtcaaagaatccgaacaatatatctcaggtaatcctataaatgttgaaactaatgttatttgaaatccgtaaccccggaggagtatataagggacaccttccctgaacgtttcaacctcccgaaaaagaagaagtatgttggtacggtaaagtaaactggactcccaaaatagttctaatacattttcctccgtttccggatattttaagaaaataggaaaataagaacatcccggaaagacaagagtcancnaggttgaangggcgcgccccctgatcaatggggactccttagcctccgaancccttttcttgcannanactctttgnccgtaaaatcattaataacncccaatgtttngncacgtccatgcaatactgggttttgttcaacnattcncaaatntaaggnaggancantctcccc

SEQ ID NO: 95340 - DNA, 612 bp, Triticum aestivum
  unsure (1)..(612): unsure at all n locations
  Clone ID: PAT_TA_95340
tttttttaaccataaataacaaagttttcatccaagaaatttacactagcctgcaagcgttgaaattcttgccatcgctcatcacaaaaaaaaatgctgccatcactgctgttttagttttataaacttatataagattaagtaggtttgctatctgagttactggtgaccagtgttaagcttaagaccatcttgagtcacaacaataaactagaaatggtcttttggattaaaccaagggacagacatgcaacttggaagaaacttccatgtccgtttctaaatccatgccgcatctactacttccaacaaaccaaactaccacatatacacatctggggattcctcctaagaaactacatcccgtgggtgaattgtccgangcacgactcctctccccgacaacgggattcacaagcaatgcatacattccccacatttacccctggccggttgctacataaaagggaggttcccacagtgggtacaattgttgcctggaatcnggtgctnggcggtgctgggcgcttatgaacactcgttctgaaatagatggccaacaactctacacatacaaggattaacaagtttgcanatccnagcctccangac

SEQ ID NO: 95341 - DNA, 563 bp, Triticum aestivum
  unsure (1)..(563): unsure at all n locations
  Clone ID: PAT_TA_95341
gcagtatccccgccgccgccgccgcgatgagcacgctcctccgccgcatcctctgcagcacgcccgccggcgcctccctctcccagcacctccccttcgccacctcctcccgccgcaccccgcaccgcttccgccgcagccaccgcgcgcccagccagtcgccgtcacccgacgccgtatccgctgccatcgcctcnctcccctcccggcctcaccccggccgtcctccgcatcctcgctccgcctccacctccgactccgctcctcttcccgtcctcacccatccctcggccggccacttccgggccgacccgggccttcctcgtcgccatcaagcgctgggaacgccagtctacacgagtcgacgnactgggctcttctctcctctcccntcctgcgtcccggggcctctcaaggcgcctctattcncgggantcgcaantcgggaaggntcactcanagtcaatggtctcgcgacggcgggcgnccgcgcgaactacaaggnnctaagggcgcgtcccggggaaanatcangcaaaattatgaagtncgggtgttcgaaa

SEQ ID NO: 95342 - DNA, 251 bp, Triticum aestivum
  Clone ID: PAT_TA_95342
agttcttctccggcccaaccgacctcagccatcctttgacgcttcacctctgggccccggccggcgccgcttcccccggcagataaaggtacctaccgtaagccaagaaggtggtgataaatggggactccgtcccctgctttttgattagttggtgctagatccgtatcctccatagatctaatctaatctaatcaaggggattcctttttcttcaaatgcttgcttttttactccgcaaaaaaaaaaaa

SEQ ID NO: 95343 - DNA, 498 bp, Triticum aestivum
  unsure (1)..(498): unsure at all n locations
  Clone ID: PAT_TA_95343
ttcataactgtcaaaaagaatgctacacacccaacatcacaactcgcatgtatatttgcacttatgcacgatacagtatatactacttgatacacatttacacaaccgcatgttcgccgctccacactgaaagatagtcagagctagctgcccatgcatgtatgtgttatagagattacacatgacatgtgtcatgcatgtatgtatgaccaaacatgcaagacactcccgttatacgtacttaccttngnaaaaggcgctagtcccatgcacgccgggcatgccatggaggatgcaggtggtgggacagtgggtatccnggtatgttatgtnnggtgctaatccnatgggaggccgcgatttatgaaagggcactgggaacgagggacggaacttgcttnccgcactggttggaccaacacccaaantggnacggggacacaacttngccttcaacnccttggcttgatggngggcaaaggcaaacncgtttagcgg

SEQ ID NO: 95344 - DNA, 585 bp, Triticum aestivum
  unsure (1)..(585): unsure at all n locations
  Clone ID: PAT_TA_95344
gtcggggtggtgcaccacctcggaagcagtctgtcataaagctcgggcgctagtggctggctccatagagggcatttccggcattaagctcggctaaactccttcaacttttttgaaccaaggtgatttatgacacctcggatacagtccggcgttggagcttggacatagtccggcgttggagctcggatacagtccgacgttggagcttggacatagtccgatgttggagctcggatacattccggcgttggacctcggaagcggtccggcgttggtgctcggctgcaaaagatacctcgaatgcagtccggcgttggatctcggacgcaagaggacgctgccgcccgggaacaacttcaaacctgaggtgtggcatgaaaataacaaggcattgataaaggcccgaaacttaaaggggatctcggatacccgacgtgtaaactcttcggatgcacttcggcgattctcaagatcgaagatgagaagattcttgaaccaatttcaagaccgacgaccgaagatgaagaacantcnaaagatccaggaggtcccaactnaagacggtcaagggntacgacgtta

SEQ ID NO: 95345 - DNA, 169 bp, Triticum aestivum
  unsure (1)..(169): unsure at all n locations
  Clone ID: PAT_TA_95345
agtccgttgctttgttgctgccgcggtagctaccgtgtccgtcnatcatccgttatccccgtcgtcgccgccgccgccgacgggggccatgcatctgcacncacgccggcggnacnccgtggngcngcnccgcttgntgatcnccgccgcggccgtcgccatgtcactc

SEQ ID NO: 95346 - DNA, 153 bp, Triticum aestivum
  unsure (1)..(153): unsure at all n locations
  Clone ID: PAT_TA_95346
cctgccccagccgagcgccgttgaaccgggcgaccaatccctccctgccgccggcgagcaatctccgccacggccgccgcagcagagcgattgntcgtacatagatatattttggtctgcctagntagactgctacatctaggtagtcggtgt

SEQ ID NO: 95347 - DNA, 592 bp, Triticum aestivum
  unsure (1)..(592): unsure at all n locations
  Clone ID: PAT_TA_95347
gttggtcagccggtcaagaagcccaaggtcgacgagaggccaccgctgcccccgtcgccgggcacggcggcgaagcggaacagcggcgacaagaagcctaagatcgacgagtggccagcgctgcccccgtcgcccggcacggcggcgaaggggaacagcggtgacaagaagcccaaggtcgacgacaggcaagcgctgctgcctccgtcgccgggcacggcggcgaaaggggaacagcggtgacaagaagcccaaagtcgacgaagaggccaccgctgcctccgtcgccgggcacgaaggcgaaaggggaacagcggcgacaagaaactaaggtcgacgagtggccggcgctgccccgttcgccgggcacggcggcgaaagggaaacagcggcgacaagaagccgatgcaagcgggnaagctggcgcggcaagttaggtcaaggtnaagcngtacaactccctggnaaagtgattactgctaactangattacnggatcaaaangggaaatnactaacaacttcacattggngtcatgtanttaatacgtttacctcctgtanggtttcccccttttggaaaaatcatacaa

SEQ ID NO: 95348 - DNA, 601 bp, Triticum aestivum
  unsure (1)..(601): unsure at all n locations
  Clone ID: PAT_TA_95348
ttttttttttttttttttttttttttttttttttttgcggaacacacctaatagttgttaattattgaacttcatagtgaaaatacatcttcgttaagtaaaaaaaggaatacaaatcagaacaatcgaattacgatggacctacagggccggtaatggcactctgaaatcatctcaaacacttatgtatctccaaattcacatagatagatatctaattagttcagatacatggattaaactccagtgcatacagccagaatcactggacctccgcatggcaaagatcttccggatcacaaatcacaaaattgcaaagtttatgctgccatcttgtatccataacatttgttatcccatcttttttcatggctgatgacccacatctgtggagtaataaaaccgatgccatccgcattgggtaagctggctctgatgtacgcttatgatttgggccactacgttcgtctatatagacctttattgcaccggctcctatcgcatactcgcagatgatctgaagcctcgcctccntcatggnatgacacttgacgacaaaacagtntgtatananacaagctgctcgctgaacacacatcgg

SEQ ID NO: 95349 - DNA, 233 bp, Triticum aestivum
  Clone ID: PAT_TA_95349
ttcgttgtgctctgctcgtgtgtgcgtgttttatcgtctggtcagtgaacttagtttaggttgtggagacatggcatgtgtcataccgaagaaactagagataggtggaagcctgacgaaatcaaacattttcaagaacgaacagagccatgaatcgtgaagctgtcttttgttctttcgatcgaaaacattgtgggctgaaatgaatggaaaggagtgccaaaaaaaaaaaa

SEQ ID NO: 95350 - DNA, 218 bp, Triticum aestivum
  unsure (1)..(218): unsure at all n locations
  Clone ID: PAT_TA_95350
atgtnaaggtctcattacaattacatgctctatttanaacagtanatagtagcantaataaaagaagaaattaaagaggaagagaanaagaagaaaaangattggtcatggagagctttggacatcatcccatttctcaagagagtaacangctactctanctagaaccngtcntgtctccattnnatcgattanantgncggctacttttccngcgg

SEQ ID NO: 95351 - DNA, 458 bp, Triticum aestivum
  unsure (1)..(458): unsure at all n locations
  Clone ID: PAT_TA_95351
gcttgatccgcgggtcttcagaataagctgttaccattcaacacacaaacaattcttacacgccaaagatgatccaaattatatacatatatgaggacaacatggtatatatatacagagatatatggacagaatgaagtacgtacagtcggccatataacttaaatccatttcaaagagctcccctgcatgacgcgcttctcaacacccggccaccgccgccgccgccaccacatcctcctccgcaacctgcgccactcctgccgccaaccgctccccnagtggtgcggcgcccgttttcggttccctcccccgttcntccggcgcaacccgaacacggatttccacgatttgctgccgcggcatgnaagacgaaaaccagacccacgacggcccggggggaattctgcaggggtccccggcggaatctccaaccaaacgtngccaacacctaacat

SEQ ID NO: 95352 - DNA, 407 bp, Triticum aestivum
  unsure (1)..(407): unsure at all n locations
  Clone ID: PAT_TA_95352
gagcggtgcttcatctcacacattgatggcggcggttatcggcggcatggcgctatggaggctcggcgtccgatgcgcgggatggagcgcaggaggaggtagctgtctggcgtcatgggtgacgtcaatggctgagtgaccagacaaggtaagatgcctcaaatatgatctaaaagacggacctgtggaaagatggcggcgaacgacacacgggtgcgtcctgaccggatttgtgcccccagaccccgggtatgttggtcaactgggggttcccgactttttgatgtttaagcttaaggtgagttggccttgagccgcccaattttanacccttccatccntaaggataagaattagcgnatattttgccaagatggtggttccaagaatattggttggtatacttg

SEQ ID NO: 95353 - DNA, 283 bp, Triticum aestivum
  Clone ID: PAT_TA_95353
gtctcctcctctcctcttccctcgacgccgactcctcgctggcctccgccttccctctccgcgtcacccccgcaatccttgccgccgcctcctctcctgccgccgccacctcggcctcgtctcctctgtgctgcctcctcctctccacttctctccgccaccgcatggccgccgccgctccgtctctttcttcacgcgactcctgtaggacgaaccatccccatcctccatcaagcgctgttgtgcgcgtgggtcttggaccggccgcaggtctaggagcaga

SEQ ID NO: 95354 - DNA, 606 bp, Triticum aestivum
  unsure (1)..(606): unsure at all n locations
  Clone ID: PAT_TA_95354
gccagaaataagtgtttgtgccagagtgggttagaacaaaggagatggcatgtagcgctagaagttgctggtttatagtgcgtccattgaaggagtggctgttttgcggggcgataagagcattggggtgttgcaaggcgatccagtctagccaaggtgttgtattcgggagtagagcttttaccgcgaattcattaacaaacagttgttctgcttatgcaantttttaggcctaagaccaccacagtttttgggttgcacacatttttccaaggcaactaagcattggagcaccgggtacactttcctccgcggccaaaaagaaacacgcctaaccgatcctagggttttaaaacctttggggatgangaaaacagacataaaataaactataggatccaagacgtggatataggatgacctaccccttggnaagattttgcacccacccttaagatttctacaacccaatgatagtagnagngtcaaggtacctgtgggtcnaggaangcaagtaatcgaggaangttaagtntcatgcatgtgagcaaaggnntcgcaaantggggactcatggacaacttgttnataaggnataggcatgcn

SEQ ID NO: 95355 - DNA, 610 bp, Triticum aestivum
  unsure (1)..(610): unsure at all n locations
  Clone ID: PAT_TA_95355
acattgcctcaaattaatagtgccactagattaaggtgcaaaataataacaacactgctttatcatggcagtgtcaaaatagtagcacaagagcaggatcaacaagcaagatctttggcaaacggtcagaccaaaaaggaacatacctcatgatgggaaccatatctgcagtcaaagccatcatagaagggatgacaccagtcaccaacatggatgattcaattcatggggaccttttggtgcattcacctaaaatgaattagtgtcccatgagctagcagctcctcctcctcctcctcctttaacaaaagggtccaacccattccattccattaagtaaacgaaacccatagacttctcctcataattgcaataaaatngacaacacaagttggtngtgaactccctgganagtagcgacaagacattcacctctaatgaaaagaacacttatttaatgggaanttantagncatgaaaaatgcatgatcaattatgggggnatacatgaaacacatgggtaacggtcctactttacatgtgacgganattacantggaatactaaacggntgggggacaanacaaaaggaaccggttgcccattttcg

SEQ ID NO: 95356 - DNA, 594 bp, Triticum aestivum
  unsure (1)..(594): unsure at all n locations
  Clone ID: PAT_TA_95356
ttccagggtcatatagctaaaaaaataagtaaatgtatgaaaagtaacaaatgaacacagaaagggtttaaaattgatgatgtggctttgaatggtgcattttgaacactcacaaagtctggagttcaaataagttaaaaaaaaacaaatccctatgtaacaaacgagttccgtataaaaccgggatacttccgaaagagattgtccgtttttacatgaantgcatccattttttgcccgtaacctctcaacttttaacacatcctatgtggggtgaaatgatgataccgtgccatcctttcaaccttttccagantcatttggtantgcttttcatttccagtggtcatatagtccaaaaaatgaattctttgtacacacgatttccctntgaaagcaaatacttccnaaagaattntccgtttggtacacgaangcaccatgttccncgttacctcccaatttttaaccacattatatnggggtgaaagnngaacctgccaattcaactttggagatcattgtanacttcattcaggcatataccaaaatcataangctgaaatacaatgaatcaaaaggtggaatttgagt

SEQ ID NO: 95357 - DNA, 398 bp, Triticum aestivum
  unsure (1)..(398): unsure at all n locations
  Clone ID: PAT_TA_95357
atacaatccagcttctggtctgctctaccctgaagtattaccttctttatgacaggaatttcatgagaattgcaccaccttttgtgaattcttgacatagtgatacttcttgccatcactgttcattcctcggccctcgtgttgatgcaaccggaataccgacaaatgaattgtgatgtgtgaaatcaatactgctagcaactctgttgcttgggtagttaaaggataataattcattcttaagtatgttggtttccgaacaccttcctaagactgattcgtgctacctatccttatttccgggcaccttcccattggatgagtaggtcctgtcaantcctcaccatttggattatatcgtcttgcccctcaaaaanaaatgtctcccaaaggggggg

SEQ ID NO: 95358 - DNA, 594 bp, Triticum aestivum
  unsure (1)..(594): unsure at all n locations
  Clone ID: PAT_TA_95358
aacaccagataaacataaaccagcaggagtagggtattacgcatcacttgcggcccgaacctggataatccccccgtgttgatcttctaatcctgctctttccacggccccgtgcccgccaaccatagcaaaagggattctacgtgatcccgtaggtgtcgtttcccccgacacatccatcgtaagataacccaaaacttgggaaacttcaatcacacaaaactcaacaaaaccttccgtgagatccgttagtataagaataataaatcactactataagtattggtatcaaacaaaccatatttgtttttgtattatatctactgtattccaacttttctgggggcaaaaactcatccnaattaaacattagagcatcanaataagcacacaacacaaagtaaacagactttcaaaacataacatcctgtagaatccggacnattcgaatactccgttacccaatttttttgagaaattaggatgactgacaattgtaatggtctacnnaaatgganggnatttacgcnccnataaaacagattattctgaggataaagttcantttcanagataacaattaccagaagntcn

SEQ ID NO: 95359 - DNA, 504 bp, Triticum aestivum
  unsure (1)..(504): unsure at all n locations
  Clone ID: PAT_TA_95359
ctcggatcccctaccctgctcctcaccccaaccccccctctcgcggcgcggcacggcagagaggagtcggcggagatgtcgggcgtgacggcggacgaggacaagaagcccgcgggcgacggcggaggcgcccacatcaacctcaaggtcaaaggggcaggatggcaatgaggtttccttcccgcatcaaagagatccacacagctgaagaagctggatgaacgcctactgcgaccgtcatcctgtgggttctcaaactcccattgctttccttttttgatggtccgtangtcccnttggtgagcaaacccttgatganttttagatgggaggaaagggaacaaattnacccatcttcacagaaccgggaggggctttcctcgccctttaaaagacttngctgcacctggctgtccaagtcctaagctacttttnaactanattaaatttagattnaaaactttcnagntaaatctttncaacngnaggggggnntgaagtnaa

SEQ ID NO: 95360 - DNA, 374 bp, Triticum aestivum
  unsure (1)..(374): unsure at all n locations
  Clone ID: PAT_TA_95360
gtttctaagggccttaaatattcgaccctgtttcacatcaatgataacaatcatgattcattacaaccctcaaggtaaaataaagaggtccagcaatcctttttttctcagaagtacatgaatatttacagtaagttgtgtagctaagggataacaagaagctcaagttgtaactccaactttaccttccctactctttccactagctgggcaagtgaaaaacaagtatatgggaatatgaacctggaccaaagtaacaatatacgtttgtaaccaaaatggncactggttcccaaagaaagattctcaaatggcctcaacataaacgggtttttgggcaaagttccaantatacaagtattttccgggggggg

SEQ ID NO: 95361 - DNA, 668 bp, Triticum aestivum
  unsure (1)..(668): unsure at all n locations
  Clone ID: PAT_TA_95361
cttgatcttatcggtggtagtgctacaagcgagtgacactagttcttgcaccgatcagatccaacttctgcacaggatgctggacaagctgtgggacgacgtggtnggccgggcctcgcccggagacgggcctcgacaaagctccgccgggccgccgccacccaacccctccgccatcaaacacagctgcaggggaaggcgattaagcagtcgccgtccgatgccgaacgacccccgaccacgcccggtgacgccgttcgtcctccaacgcccgccgcgccggcggcagcgtntnggcggagcgttttccacccccgggganaacctgggcaaccaaagacctcccgggccaactccttccgaccgcccgcagccaatccccccancgntctaacgacgggttttacaacgaaccagacnaaggacaagganaaccacgctnaataaagcccttcggcaaagaacngaangaaggggctcaacatttttccacgccncatgttggcngcctttgggtaaccaaccggcctacctagtgcttcnaaggctcattgggttgtctcaactnctacnacgtcnataangctgaaantaanttctggccgnangcccctgatgcaacaatgangggtnatttttnccgttaanccccntttaaatccccgggt

SEQ ID NO: 95362 - DNA, 446 bp, Triticum aestivum
  unsure (1)..(446): unsure at all n locations
  Clone ID: PAT_TA_95362
cgcacgtcaaggaggactcctgagcatcgccactcaagagcctaactggtcccgtagcccctcacctcttggctcgtcctggtgatctggcgacccaacgacggctgaggtacacgcggggtcgggctctgccgaggcaagaacaataaagcaaacaagaaaagctgaaggagcataatctaattattacaaaacacattgttccaaagcaaataantttaaacgcctcccaaaagcatgtcccatgatgcaagataaaaaggtgaaagcagatcctccgggcactccttnaaactttgggcgtccncaacaacangccaacggaactcaacgncaaggactcgcttgtcccaacgggtatctngganggcaacaacattattgttnaacaaggntccaaaanancttcancgggggtaataacaaatcccgganccgtgttaccg

SEQ ID NO: 95363 - DNA, 614 bp, Triticum aestivum
  unsure (1)..(614): unsure at all n locations
  Clone ID: PAT_TA_95363
gtgaaatcatagatcgaactgccgaattggcaaaattcggtgctatcgctatcatagtatccgctaagttcacgggctggagataagcggactcgaaccgctgacatccgccacagggtaaaccaccgcctctcaggcctccccgacgggttctaccatagaggccaacgatagacaataactcccccccggaacacagcttacaactttccatccgtactgtgctctccaaagagcaatcttctcaaaaatctcaaaaacaaaaggtgctgantgggaatcccattcctaaggatcttgtggtcccggggaaccatttacaggagaaccaaggaacggggantctcccctttttcccnccgaccctttgatcttnaagagctggttttaagaacgangattgnccttctcccgaccttacggcccaaccgggaaacggacggtaagtgttccacttattgaacaagncctatggccgtccgtnaccctgggacgcccaaggcnctgggggtgnntcctantcctacggggtgggagnatgggtccgtcaagggatttcctccttgcacattcccaaaggttaaggagtatgatcagtatccaggcaacttatc

SEQ ID NO: 95364 - DNA, 616 bp, Triticum aestivum
  unsure (1)..(616): unsure at all n locations
  Clone ID: PAT_TA_95364
gtggatacctaggcacccagagacgaggaagggcgtagcaagcgacgaaatgcgttgaggcgcagcagttgactggacatctaggggtaaagcactgtttcggtgcgggctgcgcgagcggtaccaaatcgaggcaaactctgaatactaagatatgacccaaaaataacatgggtcaaggtccggccagtggagacgatgggggataagttcatccgtccgagagggaaacagccggttcaccaagcttaaggccctaaatgaccgtcaattataaaggagtgggggtgcaaaagacagcaggaggttgcctaagaacaccaccttttaaagangcgtataccactgatntnangcctttccctgnaagatnaacgggtagcatntgncnagtgtnggatgtcaaaatcacccgtagggancttccccttaanagggaacacccnaaacgggnctacnaaacgggaccaaaattccgctgagtnacgaaaaatggtgaganccaagcccgaaaaccaaggntctcccaaggtctccacgaggtgatcaggccaaattagncaaggntatcatgcacagcataatctgtcacccttttgacgggacggagtngttc

SEQ ID NO: 95365 - DNA, 627 bp, Triticum aestivum
  unsure (1)..(627): unsure at all n locations
  Clone ID: PAT_TA_95365
ctactcccctgcctcccccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcnatggccattgggtcgttcaaggagcagttgatgtggacattgggagccaatccctctgctgagggtggtggtgacgatgagggtgtcnaatgaccaagcgtgaagtggtttgacatggtttgacaccttccgtcttcaangagcaactgctttttgacaagaagcatttnactctcaacatgaagcgctacatcaaagaactcaactggcaacttntaaggggatgactagtttttcnaagaagatgttgatctgccacgaatacttcttaaacaantcaaagacttcattccttngttggggaaaacatcatgatgatggcggttgtgtcncgtacaaaaggaggaactcnatcaacttctgtacttganatggctgaagagcaatgcaatgganatatcaaaatcttgggncccatatttgnccgccaagtaggtgcatcaanccaagtgggcataa

SEQ ID NO: 95366 - DNA, 204 bp, Triticum aestivum
  unsure (1)..(204): unsure at all n locations
  Clone ID: PAT_TA_95366
tttttttttatttttggccaaaaggaaancaaaaggtaatcnanggaacnanaaaaaancccaattttggtaggtccaactnactttcaatgggntccggaaaaaaaaannaatncggaaaacaancaaaancctgggaaaaaccaaantnaaggntaaaaaggttnggnaaaaaaattaaggaaggaaatcccaaaacggaaa

SEQ ID NO: 95367 - DNA, 662 bp, Triticum aestivum
  unsure (1)..(662): unsure at all n locations
  Clone ID: PAT_TA_95367
ccgggatgcaacagcggtggcatccatgtccgcccagtatgtcttcacacgggcgagagccatccgcgcaccttctatgcatgtcgaccgctttatcgccttgatatgcggcaccgccccaaggaattgctgcaacaagccaagatagctcttcggcttgggcctttccggccacagatgagcgaccacatccgtcatggcaagtccggacaatctattcagctcaagcccactcaagccagcgatnaagtcaacggaagtgggacgctcccggactatgggaattngagaccagtaaagtcttccatttcgtgatccttctgggctttgggaagtgcacaacccgcatccgccggactccgccgccaaatccagataaggattctccggacaacacaatgggccagctgacatactcgggttctgtgaactcctaacgcagaagaaaggtttccaaaccgcaagtctccgggttngngcattcctccttcaatagccgnanctnatccggggnacctngacttgggtggcggcttctnaaggcctcctgctcantcggggtctcctcaagaactcaaacggcngtagatcttaattcaggcaatcagcatctctcctnttggagnagaacttttggcnttacnctccgtacttaggaacga

SEQ ID NO: 95368 - DNA, 634 bp, Triticum aestivum
  unsure (1)..(634): unsure at all n locations
  Clone ID: PAT_TA_95368
gagaaacatttccttattcctctaaggacaattttgaccgttgtccaatgatccactcctggatcactcttgtaccccctttccagacacatggcaaggcacatataaggtgcggtacgcatcacgacatatcatatagagcctatggctaaggcataggggacgaccttcgtcctttctctttcttctgccgtgggtccagctttaagtcttaacttcacaccttacaactcaaagcaagaaccctctttggactggatccattttggaacccttcaaaaacatgtcaaaggaatgtaccctgtgaaancctnacaagcgtcttggatctactcctaatagattttggatacccaatatgttagcattttacccaancttcctttggaaaaatacattcaaacaacctttatgctttcccanaattctacacattccggatcaacaatatncanccacatatattatcaagaagtgtaatgtccaancacttctgtaaatacaattctgcaaacttgtanagaccaaaagcatgatacccaacaaagcgtatgttcaacncgagatgcttgcncatcataaaaanccngggnttnaaatttacacctnggtnaaacctncggtngcaaacntc

SEQ ID NO: 95369 - DNA, 379 bp, Triticum aestivum
  unsure (1)..(379): unsure at all n locations
  Clone ID: PAT_TA_95369
cccagtccatcccccgtcgccctcacgctcttcgtgctcgccgcctcccttcgcgtgctgcctcatggcttccatcgccggatctgccgtgtccttcgccaagcccgtcaaggcaatcaacacgaactcgctctctttctctgggtccaaggaggggcaatgcatttcttccgcctgcagccagtgccgatgagatttgctgtttgctgctcaacaaagcaagatacagtggagaaggtttgtgaattgttaaagaacactttgctgttccctgaaaggactgaantttgcggtacaacaaattctcctgacctttggagctgatcaaatgggacacgtccaattgtgatggctccaagaagattcaaatnaatgttga

SEQ ID NO: 95370 - DNA, 464 bp, Triticum aestivum
  unsure (1)..(464): unsure at all n locations
  Clone ID: PAT_TA_95370
ctagccggatacaacttgtctgatcaagcaactatgacccctacgcctagtttccgcacgtaccccggtctattcggccatgcgagtattcggaaacactccgcaccttcgggtccggaggttgaagtgaaaaggtctgccatgacaaatgctacaattcagccagagttacatatatcaaggaaagtacatagtcacttggactcaaacacttcctcctctacaccgtccaaaangtgggtctaatttacaacctgttggggaatatttggcggcacttctacttgggtcatatactaaactaacgggatttcttccccattcnacctacggtcccgatacnggcaagttattagattcacttngtatacatgtcttcacaatggccaagctctcgcgacctcttggnaggccgaacttccatagtaggnacacgccgcccttttaananctacagntctcca

SEQ ID NO: 95371 - DNA, 463 bp, Triticum aestivum
  unsure (1)..(463): unsure at all n locations
  Clone ID: PAT_TA_95371
ccaaccagtactaaaggcctcgcgctgccaccccaaaatttagtcccacatcgccgggcgaagggcagccgcactggtttataaacccagccgcggctacctctttgaacttctctatatagcaggcttgtgggcctaaattttgcgcgctgccctgtgtgtctgctgggcctttaaggcctgtaattgcacgcccgtggcctagcaggcccacagggcagcgccccaattttttatagtgttttcttttctgctttatttcttcctattattctgcgtagtttttgtatagtttttcctttccaataaattatttcctccnattatttctgacaggcttgaacaaataacganatgcactctttttaattttaataactaattacaactccngcttctccgttaatgnaaaacaatttcactcngattctttttcaaaatttgggtaatanccnaggggggg

SEQ ID NO: 95372 - DNA, 498 bp, Triticum aestivum
  unsure (1)..(498): unsure at all n locations
  Clone ID: PAT_TA_95372
gtcagatatgggtagctgcttgccatggggatcatcgtcgttggtactatttttgttgttacagttcatgcttcacttgtcctctggctacttctnggagggagagggctgcgctaatggacatccggtcttccctgataagagcgcagtgcccgtatgcgcatgatccaatggggggaaggatggtgannagactactggattcgtgggattcttgtgaaatgcaataatagaacgcagcgggtatctcatctctacctttcctcctgtatatctggaagacagatgttagatgattggttgggatttnaaacgcctccgtgttttcctgcattcccaaaaacttcaatacctaaattctaatcatctaattctttccngttcaataacttaanaaagnaatgtaacctgctccaaatctcctttcaacaatangtgtgtnggtgggcacttctaatcccaatggctggaacaaacaaatcaactggcaagcactaa

SEQ ID NO: 95373 - DNA, 416 bp, Triticum aestivum
  unsure (1)..(416): unsure at all n locations
  Clone ID: PAT_TA_95373
ccgtctcctcgccgaagcgccgccgctccaccgccgcagccgccatgggtaagggtgcacggatcgctggcccgagccgggaaaggtgcggggccaagacgcccaaaggtgggcgaaagcaaggacaaagaaagaagcagcccgcgcnggcccgcgcccaacaaagcgcatccaatnacaaccgccgctttcgtcaccgccgtncgtccgnttncnggaaagaagcgccggcccaactcctcccgagaattaatttagtgggtctcgccgccanctccttttttttgtttccccntcaattactgtgattcctttccnggtatgcatgctaagaaattaagnaagactaatcaattaccgtattttccgtnatgttggggaatggaatcncaactgattgtccaantttatatttt

SEQ ID NO: 95374 - DNA, 610 bp, Triticum aestivum
  unsure (1)..(610): unsure at all n locations
  Clone ID: PAT_TA_95374
attccacgactcttctatcacccttgacgccttctatgagaacgctgctgtgcgagccaatctcagcatgcatcctatccatggagacgccttgctatccttgtccggtctttttggaaccaaagcctttaacctaggcgggcgaatggaggttgacgctgggaatgttctccgcaacagctatgcattggagggccattaagcagcagtgccttcaccggccggactgcaagttataataacccgcgaccagtgttgctgatggtgtcccacaagttcaaggagaaaccgcatgtcaaaggagctggatgcaccgctcatccattggcaaagactctacccctctttgtcccccgcgtcctcttcaaacacgatttccgccaactgatcaactgcanacaacccaaanacgtttgngcaatttggaccanttgccgacctgacccgtcctgnacnctttcgcnaancnagtgtgatactacnnctggaaaaanntggacggcacgtgggtaaaggcaatttgtntacgactggtgccgtnccggttgttccatgtcgtancccgttcnatgttgtttgatgcaanaanccctggtccnatgtatagttg

SEQ ID NO: 95375 - DNA, 620 bp, Triticum aestivum
  unsure (1)..(620): unsure at all n locations
  Clone ID: PAT_TA_95375
gcctttactcccgttctactcgacattttgtcaagtggcaaatatcttgtgttttgctatatattctaacctggaaaatcatctaacctttgctgccacacaagaattggttttcatattgtccatgttgtaggattccatgccttcggctgaacaagatttacgcttcctaattgggggtacgagtttctctacaaagcacgcctacgtccttctccttaagagagcctatgaagacaaaattataggcattatcttggagaatgatgtttcctaacaagatcaaatgtttgtctgggctcatgtttcacaaccgcctcaaatatatgggagccaactcgcccacaagaacaatatcgacaaccaaggagtaaccatgatgacaccaggcggnaagagactgccgccgctccgggtgctccggcgcgtcgtatccttctcctcccgccacgttacaanttaagaaacaacgctccgtctntcgtcagntcaacattacagctanagggggangaatacagatccggtcctctcggaagatccagagaattacatacnaaagaccggaggagatgcgagatccccagaagatgggaantcttgagggggaagaaaaaaac

SEQ ID NO: 95376 - DNA, 588 bp, Triticum aestivum
  unsure (1)..(588): unsure at all n locations
  Clone ID: PAT_TA_95376
agaatgacaatacttgaatttgaaaacatgttatcatgaatggaataggtactgaaaaacaggaaggcatgacatatttacatgcatgatcaacatgctaagcacatgacattgcaatagagtagatacactccaggacattatatgcatgttgtacccatatcacgggccaagttagagcaaggaccttgtggggtgatgaggattcatcatctttctgcaagtcttctgaagaactgcctttacatgttctatcatattgggtatcattgacatcaagtttattgggcctttacattgctccttgagtttcttgtggatatatcagtgtgtgcaattatatctgacatgcatgggaagacaactagtagttagatttatgtaatgagtgcctgtaggagacgacataaatagtaggactcgggttaactantagcaacaagtctcaaaaactaaagagagaacacagatgaaagctacagaatattacgtctgtnccagggggggccgggtaccaattcncctanntgatcgattacnccgccacggcgtcgtttaaactcggacgggaaacctgngtacaactaa

SEQ ID NO: 95377 - DNA, 610 bp, Triticum aestivum
  unsure (1)..(610): unsure at all n locations
  Clone ID: PAT_TA_95377
gccccgagttccaacacccagggctccagattcgggtaccttcgatcttcgacaatgtacggccctgacctatgtggccggtggatgccctcctccgtcacggaagaggacgtgctaaagctgagagacgccaggtacttaacctacgagatttcacataggctgcctgcccgagggcaagttattccgactcctgagcttgggtgagagcgtcgtgttcgtgtctcacctccgtcggggtttaagcttcccgacggattccttcnttgagggggctcatgttttactatggggctgggaattccatgacttggctcccggagtccatcctccacatctcatcattcattgtcgtccgtgaacctcctccggnactaaccctcacttcggcttgtggtcaaaacttcaacgtggancgaagatgattgaaggggtcaggcaaatgcggcgggcggttataacaagaaggcgatctccatggnccaanggctcttcagaagaactcggntgtggnacatatggttcatacacgctccaaggtacaagaaaggcnccgtctcttcgtcgggcctcaaacagtaactctggtaaaaggacttacggggctcaa

SEQ ID NO: 95378 - DNA, 555 bp, Triticum aestivum
  unsure (1)..(555): unsure at all n locations
  Clone ID: PAT_TA_95378
agaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcaagctgctgcccctgctgctggaggtgctgctgcccctgcagctgagtcaaagaaagaagagaagtcntggagaaggaagagagtgatgatgacatgggcttcagtcgttcgactaattgtggggaacntgtgtctgaatatcaaccttggcaagaaactagatcaatgatgtttaaccttaataactgattgtgaacacggcaagnaatgtttgatangtaatcaaccctggtgctggtgattaaaaaaaaaaaa

SEQ ID NO: 95379 - DNA, 483 bp, Triticum aestivum
  unsure (1)..(483): unsure at all n locations
  Clone ID: PAT_TA_95379
cacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgattcgtatcgatttactactaccataccatgttaccgcaactgattnaagggcctttatgttccactgactgcatcaacancaagtgcaatgccatgatgtaaacaggccccctaaataaaactcccttgattaactaa

SEQ ID NO: 95380 - DNA, 517 bp, Triticum aestivum
  unsure (1)..(517): unsure at all n locations
  Clone ID: PAT_TA_95380
anttgggaggccganaggagaatcgaatcnatactcccggccccggacgacctgcttggctgcgcgcgtctcnataccacctacctcntcgccgtcagagcctcttcccacgcgccgctcccctgtccccgngcccgccgcanccgctgncgccccctgccgggacgagatggangtcgccgccgccgccgccgccgtcgccgtcccgangcacaaggtgaagaagcanattaacctcttctactgcnccnagtgcgangagctcgccctcaaggtcgccgccgcctccgacgccatccanctccagtccatcaactggangaacttcccggacgggttcncgaacctcttcatcaagaangcgcacnacatccnggggcagcacgtggnttcctcgcctccttcagctcgccggcgattatcttccagcaagatcccgngatncggtcngntctcntcanccagattnntacgnctcagtcnanntccgttcnntcnacatcnnatnttctggctt

SEQ ID NO: 95381 - DNA, 187 bp, Triticum aestivum
  unsure (1)..(187): unsure at all n locations
  Clone ID: PAT_TA_95381
gataatangagcagngcctggctanggttttganatttcgtcggnggggaatcgaccgncgcctcatctccannagcacccgccgcngccttcnctcgcccccgacntcntgcgctccgccgacnttctcggagctccgcgggctcactgcnccctcctcctcgagcaccaccgcccgantcaccat

SEQ ID NO: 95382 - DNA, 538 bp, Triticum aestivum
  unsure (1)..(538): unsure at all n locations
  Clone ID: PAT_TA_95382
gaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatcaacgtcgacggcactgcggtggacctgcaagaagtactgatcggttcatgccggatatgaatgttccgcctaaaattaaataaaactcggacaagataacancncatcntgcctaagcntgttgtttnaacaacaaatattntacantagtctgtctcntcncgtgtttcncccccaanaaaattgggttctgttgtcaacatcngaanaccccgnnataaaaccgtatgatggctggtgcaanaagtagtncttcacccttaaaaaaaaaaaa

SEQ ID NO: 95383 - DNA, 648 bp, Triticum aestivum
  unsure (1)..(648): unsure at all n locations
  Clone ID: PAT_TA_95383
gggacatgatccaaaattaaatccacccacccaccacaacctatattctccaagcaactcaggtcctccagatatatacgacctaatgtatgtgcggcagcagccccaggaaacggtccatcacttttgggccagattcctgcttgttaaaaacaagatcaaggactgctcagacgacgacatagtttcggttttccaccgcaattgcacaaatgaagggatattgaatgccctcgatcatcgccacatacagagtttcatggaattatcncatgtagtacaaaagtaatgtgcgatggaaagtatattgagggcccaacaaattcaactgggagcccgcccttcgatgcagtgtgcngaccgggttaaaagaatatacccggtgggtcacccgaccaccgggccatgggcaataagaacaagccttcgcgggaacaagtccttcttgacaaactatggacaagcctgtctatcatacatccgcacatatccaactcatatctccgggcaactggtacccaacaatntcaaagtgngagcacctacaantcagaagntccacgggaggcactnnntcaaatctcannttctcaaacgggnacggtatcngactccaatcanattcgntnacntgacnacggaaacttn

SEQ ID NO: 95384 - DNA, 625 bp, Triticum aestivum
  unsure (1)..(625): unsure at all n locations
  Clone ID: PAT_TA_95384
gccacccctgcgggcgttgctagccggaagccaccgcttggcttggagaggctcgtcgcgccgcgggcgttgccatgctgggcaccggccgttgtccgctgccgccgctggcgctaggcggctggccgcctcatcgaaaagatgcaggccaaggctcgtcggagcccatgctccanggctgcggccggggcggcgatggcacgaccaaagaggcggccgaagcgcanaccctncggctgctccaactcgcggcatctccggttttttgcngggcgatngtgtccgggttctccatccttgctccaaaagnggacaaccctngaagggtttgaaggcgaaccccaaaccgtttgngcaaaacccgggnggtggcatnctaggccggggccgggccnccggcacggccggcaaaaaacngcatngcaanncttcgcaagcgngaagcacaaccaagaagngcngcacattttgtananccaacncccggatgatctcaacctttcgaagcgaaaaggcgagcgggaacactntcgtcaatgggctgtgcatcatccggcngtgcctccaaaccggattggttcaaatataagtgcacataatnttctaaaaangggccgtccatncn

SEQ ID NO: 95385 - DNA, 574 bp, Triticum aestivum
  unsure (1)..(574): unsure at all n locations
  Clone ID: PAT_TA_95385
cttcactcgcgctgagtcgggcaggctgcaagcgtggtaagggccacagcaggcgaagcggatccgcatagaccgggcaaacaaatgagatatattccatgtaccctccttcatctctttgatgtgtttggttgtgttatttttccaaggtaagcaaaaccaattcaaccaaataaaattaacatcatgttgtggcctaccatcacatatattagcatcgtgcttcatgcttcaagatacttcgcgaagacttcttaanataagtttgctnacttttaaccgggttccgttaaatcaatttcanatatnanggttgctccctggtgctatcaaanccagtttggnacataanccnccanagttacccatgaaangttgtcaaaggtgcttggttcttgacngaatgttccaacaccaantnctaacannggaaatgcaaaancaaatctnnanccagttngaagttccaacttcaataanaantcaaaaacttcannactccgntnaaacnatcaaggaaatgaggaanttttcaaanatggtttatggncaaatgggcatccaggtcaaccat

SEQ ID NO: 95386 - DNA, 642 bp, Triticum aestivum
  unsure (1)..(642): unsure at all n locations
  Clone ID: PAT_TA_95386
cttgtctttgatctttgttcttgatgcagtgctcaaacatcttcatcttgatggccangcggacgtcggcggcgaaagaggaagaaggagggcaacagggctgccgaggccaagcggcctaccgtggctacgatgactctgagacgaaaggaagagaccacctcgcgtccttccgtgacggggtcggcctcccgaggcttggggcccaacctcaggaggagtccgtctccgcngctgggctggctctggaggcgcatgcgtccatcgcacccgttgggggtctgagagctccggagccccctatcgttcttgctgctgctttgccggcctaagcgccggctatcggtgtcaaaacaaccgatntcnggtaaggggtcccnaattgtgcgtctgaagatcnaaggtgacaagagacaaaagggacacattttaccaagttcngacctccttaataaagtaaaacctactcctgctgattaacttatnaatatagggtanaaattttnactcaaggggggccgtaccaaatcccaaaatatcnataacncntnatgcgtctttaaactctancggaaaacctgnttacaantatcccttaaaaancccttccacnggtananaaaggccacnntncctcaaatt

SEQ ID NO: 95387 - DNA, 618 bp, Triticum aestivum
  unsure (1)..(618): unsure at all n locations
  Clone ID: PAT_TA_95387
acaatacgtcccccggacgagaccccgaggccagaaaattccccaaaccaaaccacatcccctccccttccctgctcccgcgagctcaccgcccgaatccaagctcccggctgctcgcgtgcggtgctgtctggagcagctgcttgttcgcgctcgggttgggtcaccggagctgggatccgggcggaactccggatttggggccggccggtttcatcccggtccattgttttcgccgccgccaagctgcccgcagccgtcctcgtgaaaanaattgctgggtcnttcgcaanggtctanagtctgaaaaatgcatcccaaggtctcatccacgcggacccggcggcgccgggagcggacgtattgacggctgccggatcctcgngcngctcatccnnaacagcnggaggacttcaccgcngggcgctgcncttcgtgtgcangccttaangactggtcccctcnncaagantccaatnaaaatcaacgggtggngcgtggacgcaaccgacancttaanctctgcccaagccgcaattttccactctaagtaagtctncangcaacnttcagatccggccgngggcgngggcgcttttcccgtnccaaanccctagn

SEQ ID NO: 95388 - DNA, 477 bp, Triticum aestivum
  unsure (1)..(477): unsure at all n locations
  Clone ID: PAT_TA_95388
gctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggaatggagatggcggccgaaacggcggctgcggctgcacccaatgcaagtgcggcaccagctgcggctgctcctgctgcaactgctaaatncatcatcgatnaatcatgcaccgtnccctgcctgcatcatcgatttgtatccatttaataataacatacatgttaaccgcaactgatncaaggccttatgtnagcaactgaactgatcaacattaagtgccatgcaagatttaaacaggcccctaaataaaactcccttattactaaaaaaaa

SEQ ID NO: 95389 - DNA, 650 bp, Triticum aestivum
  unsure (1)..(650): unsure at all n locations
  Clone ID: PAT_TA_95389
aaaatataagtgtttgaaaaatattaatcaagcatttgaaaataaatgtgtatatagaaaatttgaccatgcattgaaaaaatgatcaatatttttaggaaaagtattagaatcatccaactgatctatcacgggcataaaccgcgtgctacagtcaacaagtgtccttggccatccaccgcttcccgtcaagtcgccacgaccttatcttttcacgtcatctctactccatacatttccttccccacctctcagttcggccccgctcgacagaggagctccaatggcaccgtcgccctgcgccgctgctgcgaactagaggggagcgcgcgccgccgtggactgcaatcccgcgcgcgaagcgacaccggtgctctgctggtgacgcaacacgcaagcaagggggcgacaccntttttgtccgctcccggcgatgcagtacgggctcctcggcaaccccggtgttgtaaggnanaaccctcaacnaccgcggttgcgaccaacacccgtctctccacgtgttgtgttcaactntccgtgcgcgangaacccgngtcccacgggctnattcgcgnggggattnatgggcatcatcagccccccccaagtccntgaancctganattcccggcgaccanccccangtccnn

SEQ ID NO: 95390 - DNA, 515 bp, Triticum aestivum
  unsure (1)..(515): unsure at all n locations
  Clone ID: PAT_TA_95390
gaagctgaaactgtgttttgacataagcgtagaaatcaagcaaaacagggagcacttatttgtgtttgaggggaaacgtccacacgtaatgtgtgtagtcatctagcacaaccaaataaaactgatagccagagatgctcgcaacaggagatgtccatacatcaagatgcagtacatgaaagggaaacatgctggtgctggtagagctgctaaatggcaggcggacgtgcttgcccaaactacatgcatgacacgaatggggggtggacttgctgaagctaagaagatcggcgcccagacggagcgaagcgtgcccgagcgctgatgccacaaggtgggagtccnacgaaaccggcgaaagccgaacgcnaagggagcgtcnggcgaccaacagagtaagatcaccgtcaagatcacatcngagatnacacttggtcccaaggccaagcgatgagncatttaaaggagcccggatcaagtacatccgagcctgccgacaaaaaagccgccttgac

SEQ ID NO: 95391 - DNA, 628 bp, Triticum aestivum
  unsure (1)..(628): unsure at all n locations
  Clone ID: PAT_TA_95391
ttcaaaaccacgatcttgtagcaactcggtaaggtggtcataccacgcacgtggggcttgtttaaggccatagagtgccttatcgagttgatacacgtgatccggaaagtagggatcctcgaacccggggggttgcttgacatagaccaattcattaaggggaccattaagaaaagcacttttcacatccatttgttgcaacttaaagttgtgatggtaagcataagcaatcaacaaacgaatggattcaagacgagcaacaggagcgaaggttcaccgttagtccgatacctcgacttgggagtancttgtgctaccaacctgcctgttgcaaatgatttcccaatgggancctgcctgtccntgaaatcactgggcccaatgacattgtggtccccgatggccttgnacaactcacacctggtgtcccnaantgttgattctcaagcatggattgancaaccgggctcaacgctcanaactttggggtaacacaagagaaaacctgattcaaanattgcaattgctacaatgctanccttacaanantcgacanattcanaaangcctgntggacttgaaaactcgganacctcaatcccccggtggcgggaggtnattaatttac

SEQ ID NO: 95392 - DNA, 401 bp, Triticum aestivum
  unsure (1)..(401): unsure at all n locations
  Clone ID: PAT_TA_95392
ccgaggccaaggcggccagcatatagaacaagtccgccttgttgtttacaccggncatgtggcacgcctccacnccgcgccggccgtccttggctcctacataacncccctccactgctctcactccctttgatgtcntcttcccccaccacaagctccatcaacaactcgccattgccgctgcactagcctgctgctagctggtagctctatctacggnancaagcgaggagagcgcntgaatgggtcnagatggaccggctggtgatccccggngccgacnaacgacgtggtggtgccggtggagccggggcggncggccatnggggagctcacctgcgcancgccatgcacaccatgcccgtcgncttctncngcaaccngncgtcangggcgcttnc

SEQ ID NO: 95393 - DNA, 189 bp, Triticum aestivum
  unsure (1)..(189): unsure at all n locations
  Clone ID: PAT_TA_95393
gcatgagccactcaccagctttcaaaggatatgcgggtaaggattttttgcacatattcaataatcatatgccagtagcccccgagtcttgaagaagttggcccaactgatttaagagtcattacatcactaggtactcacggagaggagtaacacgttattgaatgagctanaagaatgccgaacaaa

SEQ ID NO: 95394 - DNA, 444 bp, Triticum aestivum
  unsure (1)..(444): unsure at all n locations
  Clone ID: PAT_TA_95394
gaagcgtcgcgttggggagagagagagagagaggggagagggagcggcnagcgagcgancgaagcatccatggcggngcacaacgaggagtcggtgatggacaanatcacggagaagttccacgggtcctcgtcgtcgtcgtcgtcgtccgacgacgacgagaggaagtcnggatcgtcntcntccgtcaaggccaagatctaccgcctcttcggccgcnagaagcccgtccactccgtcntctgcggcggcaagcctgccgacctcttcctgtggaggaacaagaanatctccgntggggtgctcgcgggcnncatcgccatctggctgctgtttgaggtcctgnagtacatctcctnacctcctctggcacggcttcatcctcacctgggcanctcttcntctggncaacgctcnccttcctaacactnccctccaanttcc

SEQ ID NO: 95395 - DNA, 530 bp, Triticum aestivum
  unsure (1)..(530): unsure at all n locations
  Clone ID: PAT_TA_95395
caagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcngtggaccctgcaagaagtactgatcggttcatgccggcatatgatatgttccgccctaaaataaataaaactccggacnaatnacagctcatcntgcctangcgtgtgtgtgtgaccaacaaatantntacaatagtctgtcttcgtcccgttttccctcncgagaaaattggngtgcttgttgtcaacaaccggaatacnccgtgataaactgtatgatgnctgntgcaaaaaaaaaaaa

SEQ ID NO: 95396 - DNA, 634 bp, Triticum aestivum
  unsure (1)..(634): unsure at all n locations
  Clone ID: PAT_TA_95396
ccatagctcaaagcggcgtcgagcacctttgaacaggctcgtgaaaccctccatactttctggaggggtatcggatggccataaagccttggccatacttctcatggctttccgggcccgctcatgcaccacggacagctccttaagcatgtcgcctcgaaatctggatacttcttcttcaggtcgaccagttaatagacctacaacaacaaagttatggtattatgaattgtgtaataatatgagtctctctgatggttctaaaaagtcataccaaatatgtcgcctttcaacttctcaatctcttttcgtgcggccgataactgatcctttaactctttatctgcagcaacaaattatgctattctgaatgtgtaataatatgatcctccgatggtcctaaaaancatacgaatattcccttcaactctcatctctttcgtgcngccgataacgatctttaacncttaaccttggtgttggatttccncccaagttacctcnacatnncatgaagctttaacnccaattggcgggacanataattgtgtctggntgttagtcaggaaaacatgtctccctagaccgagtcaacatctaattgtggcnacgntatccggganngaaaacatan

SEQ ID NO: 95397 - DNA, 542 bp, Triticum aestivum
  unsure (1)..(542): unsure at all n locations
  Clone ID: PAT_TA_95397
cacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgttcaacgagccccgaaatgtggcgctgcgccgatatgaatccaccgtcgacggacctgcggtgggccctgcaaaaattacgatcggtcaagcccgnatatgatatgttccgcctaaaatttaataaaactccngacagatgacanctcatcggcctangcgtgtgtgttgttaccaacaaatattttacaatagtcctgtctcctcnccgtgttttccnccccaaggggggccngtaccaattcncctaaangatcctataacnccnaatngcctngtttaaantctgacgggaaacctgggtnacaactaa

SEQ ID NO: 95398 - DNA, 240 bp, Triticum aestivum
  Clone ID: PAT_TA_95398
ctgtattctgatgcatcccaagggggcgtttctggcctttgagaaccgaaaagatcagtgccatctccgtgactcattctttcccatgtctcattttctgcagggccattgcttccactactagaacagtacacaggcattggtatgatgcatgaaaacaaaagaaaaagaacatttgccatgttcacgacgatgaagatgacatctacttatgacagtgtaggacataattttttgtca

SEQ ID NO: 95399 - DNA, 223 bp, Triticum aestivum
  Clone ID: PAT_TA_95399
agaaaagaaatttagaattcattgtttagatgagaaagataaaattacacaaaaaagaataagaaagagcaataaaaaattattgtgagtagtagtgaagacagtgaatataagtgtttatagtttgctcagagtgctagagagatcaagtgtagagaaagtagagaagaagaaagaagagatataacaagaattttctcaagagttttataaaaaaaaaaaa

SEQ ID NO: 95400 - DNA, 587 bp, Triticum aestivum
  unsure (1)..(587): unsure at all n locations
  Clone ID: PAT_TA_95400
caaccagacggcaggtaagggaggaggagagcggcggcgaagatggtgtcgctgaagctgcagaagcgcctggcctcnagcgtcctcaagtgcggcaagggcaaggtctggctcgaccccaatgaggtcaacgagatctccatggccaactcccggcagaacatccggaagctggtaaaggatggtttcatcatcangaagcctcagaagatccactccaggtctcgtgcaaggagggcacatgaggccaagcanaatggccgtcactctggatatggtaagcgtangggtaccaaggaggctacgctccccaccaagatcctntggatgcggaggatgcgcgtcctgaagcgccttctgcgcaatancgtnaggccaagaagttcgacaaacacatttccatgacatgtncctgaagncaagggtaacatttcaaagaacaagaggtcctcatggnnattaccacaaatcaaggctanaaggaacanaaagacctcncgatcatttgaggcaanccccannacaangaagcaggaaagaactcagangagaaanttgtcnggccagnntntcacacacatcggtca

SEQ ID NO: 95401 - DNA, 650 bp, Triticum aestivum
  unsure (1)..(650): unsure at all n locations
  Clone ID: PAT_TA_95401
gaacaatgatcttatttgggcaccatgtttccttgtaataggatagttaatacttctatcttgagtatgccttcgtgcataagtactgaagctttttgtttgaaaaaacctcgactcgtatttcctgcaatcagaaaaatttgaacttcggcggcagttataccgccagccggtttatgatcttgaatatatgtatcagtaatacaacaaatangtgacacaaatacctaccatgtctggggcatgaagctagcttaaccaacttgaacgaggtttttataaaccatcaccatcaataaagcggggagagaacactcccatattaaccgtgctgaatcaacacancccccttgttacncnatgagggtaacaagaaaagtaaactggcatactctcccngtttaaanggaatcnaaccaccgctgaaccggaaaagnttttgttgatataaaagaaccaacaaaacaanttaaagaaccatgaaatacanggaacaagnaagataaaacttacaacatagcatacgancgtcaatggaatacatggccgcaggntattccaaagtgtncatgatcagtagcagtacaatgaccctganaatncaattaagntggaaggtcngtccatncccantnttggnttgccaaagg

SEQ ID NO: 95402 - DNA, 629 bp, Triticum aestivum
  unsure (1)..(629): unsure at all n locations
  Clone ID: PAT_TA_95402
gcagaacaccctcgtagtacatctcggggtggcggtgctccttgcccttcggcggcccctccttgattagcttcatggcgtctaggttgacccactgcatttttacatgggcgaaagcccggcgtgcaccttcaatgcagatggatcgcttgacgacctccagccgtgggcaggcatccacaagccgcctcaccaggccgaagaagctgttcggaaggacgtcgccaggccacaaccggactatgaagcccttcatggcctgatcggccgtcttatgtagctcgaccatctgcttcagctggtcactcattggcaccggatgctcggccagagcatactgagaccagaacagcttctccgtcaagcttccgtcctcggctggtaaaattgtgcggatcagacacactgcggggcaaatctgcnaatgctcctgaagtgctccgggttcnggtaagtatcaatatnccactttacatgcttgcttgcatatanaaagcttaccgccgctancttctcaacgcgtcatnnccgaagggctctgggctcggctggaactcggtctanggtcgcggaannaaatcncggtcttaataagtcaannccaagtctacaaaaccggaancngggnc

SEQ ID NO: 95403 - DNA, 653 bp, Triticum aestivum
  unsure (1)..(653): unsure at all n locations
  Clone ID: PAT_TA_95403
gtcacagtgtaccctcgacgccgggggtgatgcaccgcagctcatgtcgaaggagacccgactggaagcgttgtacgcaagctgtccggcgggtgattttgcagacccgaaaccccgcactctcgggagggaccccgtcagggagtgcggtggctatggctgccctaggtcagcttgaccgtccctagagcctcgtggatttgttgccctccaatcttgaagaacggtgaagaacgagaagaaagatacaagggtaggagataaaagtagatgaacacaaaaaagtagtagattgatttgttcaattgtgtgttgttcaatcagccatcatctctcatctatttatgaggtgggttggacttctggcacaagaaaaggactccaaatttcgtccaaatccttccaaaatcaaccgaacttggattaagtaagtctgagataaccgttcgtttttgattctacgggcacaaacaactcngatgaagatgatacaaaagcaaatttacatttcaacgaggaaacaacttcagttgaactttttttgatcaaggcatctnagggcgatcnctctgcaaaanagnacatggggctacaccaaatactaagggttcnaggtcncccctttgcccggaggccatcaaggnaanttcant

SEQ ID NO: 95404 - DNA, 188 bp, Triticum aestivum
  Clone ID: PAT_TA_95404
gacaatccctgttctgttttgggtagcacggatgttcttagacctgggcctgcggctatgaaacttgccaagttcctcgcgcaaaggctatcctatccagctttttattctcggcagtgtgtatgggactgatgagttgttgtaaattgtatcaccacgaaaccacgagttcagttaaaaaaaaaaaa

SEQ ID NO: 95405 - DNA, 271 bp, Triticum aestivum
  unsure (1)..(271): unsure at all n locations
  Clone ID: PAT_TA_95405
cgaagacttcgaagctcgagccgttccccgttcccaccaccgcccctccgcccggctcttccatggacggcctccagcgccggcccgcggcggcggccgccgcgagcgcgaggggcgaggggcagcctccgggcgggcagcgcgtcatccactgcgacgtcgagccggcgccgcgggcgtggcccgggatgnanatgctggccctcgccgccgtcctcgtgctcnggggcctccagttcctgccggtttacacacttcncnaccacgccga

SEQ ID NO: 95406 - DNA, 195 bp, Triticum aestivum
  unsure (1)..(195): unsure at all n locations
  Clone ID: PAT_TA_95406
actcaatcagtcggccgctgttgctccctgctctgctctgctggagtaggagcatgggaagtaggagtaggtaggtggtaaaaggggagggaatcatcatcgctgatccctcatctagtgaacacgatctccctcaccaatcaaaacacctctgatgaaaacggataggcaagggcatnatnagncgtctcacag

SEQ ID NO: 95407 - DNA, 660 bp, Triticum aestivum
  unsure (1)..(660): unsure at all n locations
  Clone ID: PAT_TA_95407
cttcacaggtggtgtcatgaggacattcacctcaagattttcaagacactttttgggaacctagattttcttcataggggaaccgtcctgcagttagtgccaacttatctagcaaatacttcaccattctgatttttgaacagtttatagtttgagtcaaatgactcatcagaagaatgaggagattcacatgtaaagccatataaattggatggatcaactggaggtccctttgcagcaacccatgaggttttggggtactgctcaggcttccaatatgttccatcagcattgagtttcctctcaaaggcaatacctctttcctagggttcctgttgaggatctgctttttaagcacatcacaaagagtctgatgccctttgaggcttttgtacatgcctgtcatgtacaattccttcaaccctgcatcatcagtgatactagcaacgtcctcagatgangaattagtgatagcagagatagttgaaagaattgtaacattagcagcatttgaacatcaggtgaagaattccatatcacgttcaaagcattcaaacatgggggacaattctcctgagaagcccgatttttacaacaatgatccgncctcgaaatntcanancacctancttcaaatntgcttccgaaaatcnaaaaacn

SEQ ID NO: 95408 - DNA, 317 bp, Triticum aestivum
  unsure (1)..(317): unsure at all n locations
  Clone ID: PAT_TA_95408
cagccactcacttatttagccattcatctgagcatctgtgcntctgtgaanaagtctgtcatggcnatgaccacaactctcaatgtttttaactancttgtctgtgattgtaattcttgctgcanatcangttgaagcncggaatcatcgtcctgattgtcnttcnttctcgtgcggnccacttgactatgtatngcctccatttcgtaangcangtgatcntcctgnatgtggctatcagntcttattagctagtttgnancgataccaacgcnangattcgcattgacaatccatcatacnactgtgtctgatat

SEQ ID NO: 95409 - DNA, 594 bp, Triticum aestivum
  unsure (1)..(594): unsure at all n locations
  Clone ID: PAT_TA_95409
gaaacactaaaattattatggagtatgaccggttgcaacacacacaggcaactaggtaggtgtatctgctatctagttagttatgccgtcgttgtgcttgtcgtttgttttgcttctccttgctttgatgaattccataagcacacgcagcgcaacgtcgacgtcctcgctccgcagcagcatctcggacacctccgccggcgtaacctccacggccgcaagaattcttgaatctccgggaagagagcgtggcgtcgaggaggtggtagttccgggcagcgtcctgaagcctcccaaccacagtgtcccatgtagacgtgcattccatgcngccggccgtagcagccccggtcnaagcggcctggtattggtggtgaagacnatgaccgctcctcccccggtgggtgacacaagcgtcgatacgtttacaagccgacatgtntcctgtgngctcangccctggaanaactcctgctccgaagtctcctcgtntctcgcctcccctcgttcgtgtcgcaactggnggntaactgcgtcttctccggacanggtcaantgagtaaagtctcnnacaagatggcntttggaantnng

SEQ ID NO: 95410 - DNA, 595 bp, Triticum aestivum
  unsure (1)..(595): unsure at all n locations
  Clone ID: PAT_TA_95410
ggttcttccggacaagcacctcagtagagaaagccgaaaactgactgtcatgataaggcgagagctggtcgctgttcgagaggtctcaagtccttaaagactttttccgcttcgggcgaggagtcggccttgcccgacttaggcgtatatagcgcaccaaattcggccttccgaatactaggggcttcgccaaaatttaaaattgtagacttctatggctaagtgagagtgataaagccttatagtccgattgcctggntcgttgtgctgaacacctccctccgaaggaccaaaattgggataaagatgctcaagtttatccccgaacacctcaattactaattacatgggggcagaagngacgaatggcattctcaaattttaaaaaacggcgcacaaaaggnaatattttaattaacaagcttgcataacgcaaatgaaccnnttcanattacnggttacagagtacttcatcaattacagtttagnnatccccgcnnaagggggaacttaggaacgtcantcggggngggatcnctgcctcgggacctcttacancttaagntcantcncatgactccccgnaaaggcgnng

SEQ ID NO: 95411 - DNA, 566 bp, Triticum aestivum
  unsure (1)..(566): unsure at all n locations
  Clone ID: PAT_TA_95411
attttgagacagagccagcagttgatcttgataacccacaacccaaaaataaaagaaatgataaaagggactttgttgctagaaaacatggtaaggaaagagaaacatgggttcaaaagcctatgtcctttccacgcaagtcaactaaaaagaaagatgatgaagaatttgaacgctttgctgaaatgattaggccagtccgcatactcgcttgactggatatcttaaaaatgcctccttatgcaaactacatggaagacatcatcaccaacaaaagaaaaatatcggaagctgaatctccaccatgcttggctaatttatacttttaaaagatggagtacctaaagatttggagattcaagatccactatacctggcttcaatcaaaaagaactatgttnaaactgctttatgtgatttaagaccggtgttagggtatgccttccccttaaataaagactngatttgataaaccacactacggaatacttgcaaaggntgataacnacgcatactacgtattgtgaggaggcngtgtgtgcaagtacaactgacgacttgtaact

SEQ ID NO: 95412 - DNA, 632 bp, Triticum aestivum
  unsure (1)..(632): unsure at all n locations
  Clone ID: PAT_TA_95412
aaaaccaaattgtcgactgtccggatgcagaggccttagcggcattcaagcataacatccgtgacgagtggctcgcccggcacctcggccaggagaagccgaggtctatggcagccctcacgacactcatgacccgcttttgcacgggcgaggatagctggctggctcgcagcaacaacacatcaaggaatccgagcacttcggatactaaagatgccaacagcagaccacgtcataacagacacaagcgccacaacaacggcgataacgtcgatnatacgtccggtcaatgccggattcaaaggtctagattccggtcagcggaaaaagcattcaaaagaantatcccgggccnccatttgggtnncatacttnatcctccgtgtcaaatccaacggacccccgatnancatccancacaccaacagagaagctggtgttcaaagcangccggaantttaatgccgaaaacaaggacaagggntgcatataatgaccaggangaccccggccgccgaaacgggaggcataagangtccccacaagtgaagatggnaacatgtntccaaccacattcaaanggatggacgtgactaaggantcatcatgagccgtccccaagtcancaaggc

SEQ ID NO: 95413 - DNA, 603 bp, Triticum aestivum
  unsure (1)..(603): unsure at all n locations
  Clone ID: PAT_TA_95413
ctcagctcgacagcaatggcgagagcctgcaagtgcagccccgccttgaggctgctgccgaacccgatcacggcacagctcccgagcggcaggagccacggaagatgcagatgccttgccgttcacgcgcagctcccagccgaggatgccgatgattaccccgctgagtcacccaaaagggtccaggttacacaagagcctcaggaggagccgccggaggggagccgccgggcggcagacctgatctccgtcgggacgtcgcgcggcggaggagattaagttggggcaagcgacttccgagctgacgctcccggcagctgaaggtgggacgactgattgaaggacgggcacaacgacgccgactcctgggtgcacttcctgggnccaacaacacaccattnngatgtcnatnaaaaggcaatgggcaatcgctcacaaaatattgatccngtccgcccatactgacaaagatgatagcaatcgacattacgngctnctcctccaagaaantaaancggtgcctgaancgngaagnatctcgtcacattnaagcaggaacaaatcattcannntatcaagnacatcananaagtacaggntagn

SEQ ID NO: 95414 - DNA, 631 bp, Triticum aestivum
  unsure (1)..(631): unsure at all n locations
  Clone ID: PAT_TA_95414
aacccaacacaaatatatattatatatatatatgttttcacagctgctgctacatatacattggttatttggagtcatatctcatactagagcgtgcgatggttgtgtgcatcagtcgatgcagaagctggggttgactgcgtctatggtatagttcacggaaatcttccagaattccatccggcacatacatacgccgccgggatatctccggcatcttacggttctctttaatgaagtataattaagcagtggtgatacttggtagtataccacgtatggcggtactgtatttgattggagccgatggtgcatgcgcgtgggctggatcattagttgggtgatggggatgatcctgccgtaagccttcctgccgtcgtccttgggggatggtgatggtgagcacgccgttgtcnagcgcggcgtggacgccgccggccgtcgactccgcattgggcggcaaccgcacgtgcgcacgaactctcgggatccgctccacgcngtgcaacggtccccttgcctcggcgccggcncctgccgcgatcggacaccgctccgctcaactcaactnactctcccgcgcagccggnctcgcatgacagtgccctngggtcnctcatcaagccgcgng

SEQ ID NO: 95415 - DNA, 599 bp, Triticum aestivum
  unsure (1)..(599): unsure at all n locations
  Clone ID: PAT_TA_95415
aggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctgggtgctcaggcttccgtggaggcatgcagattttccgtcaagaccctcaccggcaagaccatcaccttgggaggtgggatcctcgggacaccatcgacaacgtgaaggcaaagttcaagacaaggagggcatcctccggacaacacgcctcatctcgctggcaacaactnaggatggcgcacctggctgactacaacatccagaagganccacctcaactggtgtcagcttctggagnatcaattttgcaaaacgtcacgggaagacatanctgagnggatcccggcacatcacatttaaggcagtcnagataggnggatcccggcaaaanttattcctggaacactggntgccacctganatnaatan

SEQ ID NO: 95416 - DNA, 621 bp, Triticum aestivum
  unsure (1)..(621): unsure at all n locations
  Clone ID: PAT_TA_95416
aaccaaattggtaaaacgattgaagcatacatagacgacatggtcatcaagaccaagaatgtcacaggattggtggatgtcctccgcttaacatttgaaaatctccaaacatatgacatacagctcaatccggacaaatgtgtctttggagttcctgcagaaaaggtactcggcttcattatgtcccatcaaggaatttaagcaaatccggccataattcaagcttgtcacaattggcgatacccacaaaactaaaacatgtccaaaaattgggcaggtgttgtggcggacttaaccgcttcatctccaaggttggggaagagaaagcattaccacctacaggtgctccaaacacaccaccaactttccaatgggaccgatgcggcaacgcancttgggaggaaataaaanactgttagccagaacccgttnttncaccccaatgtcngggagccatgctatgttactcaaccacccacaangttgangttncccancntcacgggagaggagggggcataatcctatcaaaaccgtcataagtatggnggcctaacagcaatcatntacccatacaaaatacaantctctangatccgaaantcggacanttcaangttg

SEQ ID NO: 95417 - DNA, 617 bp, Triticum aestivum
  unsure (1)..(617): unsure at all n locations
  Clone ID: PAT_TA_95417
atccgtctattttacatctagatgtgagataatatcccacatctaatatgacatcatcctatattgtggacccttccattgacaactatgatatgttccttcctccgtttccaactttattccttcatgctgtttgtttgtcctggttgtgtgtttgtttgtcaaagatcaacccaccctccaccccagcctaccccaaacggcccttgtggacaaaagccttgttttttatttttatttttttgtcccctattttttctagttgttggtcacgttattcctcctctctgcttttcttcttctttcctgtccttgttcctgtgtgtccacgatctanagaacaatccctgcttgctcaatcctgggctggccctccaagtaatgaatgatgcaanggaaggagaagttgtagtgtgtgcatatacaagagacaaacanatatgagactgtgcaacaatgcatcatgcataccaactacntcaagtncccaaaaattcaaactcaaatacnatgtacaaaggtggtganangttgggaacgttatntaacagantnntcaaggagaaattcatacctattatacaggtntngaactcaantatacaanattnatgcac

SEQ ID NO: 95418 - DNA, 645 bp, Triticum aestivum
  unsure (1)..(645): unsure at all n locations
  Clone ID: PAT_TA_95418
gtggactcaattcaagtttttttcggtgtcgatcgcattctgttccttggatgaagtgttttccctgctcgttcgcctctcaccagtttatcctttcggagtgttcaagtcatctcagaagattcgtctgtgttccaattaattcgaggttgtcacgtcattcaaatatttcaattgttccggtgcatcttatatctgttcatcaatccttttcaactgtgttttctcttcagtgggccctaacccacaggtcttttcccaggatcttacctgactcttctaatttccccagagttattctcaatccctttcaagtgtgaagtaagaatggatttcatcaagcctcattccttctccaagatctcgttcaaattaatgtcattgtttggctcaacctccttgctttcantctaacgggagtatccaataattttgggggngttcccaacgtcattgaagaacgaagaaganttcctcnaagtctgccgttcctcaaaatcgtggtcanctcagtacctccaantatcattgcannatcttccacaccgagagtcaggtgttcaatcttncgggggaaatcanncgtccaataccgggntctnatgttaaanagtcctgtttgacaanccaanattgnccattncg

SEQ ID NO: 95419 - DNA, 158 bp, Triticum aestivum
  Clone ID: PAT_TA_95419
tcgagttttttttttttttttttggcggaccccctcttaatagtacgactctcctacgactcaaatccaccgaaaaaggaacatagaaaaacgccgccttcaataatcttcgaggggctcctaaccgtcttgtgcctagtcatgaaatatctgaaata

SEQ ID NO: 95420 - DNA, 631 bp, Triticum aestivum
  unsure (1)..(631): unsure at all n locations
  Clone ID: PAT_TA_95420
ttttttttttttttttttttacaacactaaattagtttcattagattttttccataagatattatcatctatacgaaggtggctccatacatagttcgtcgtctcagttggcaataagagctggccatcgagcacctaccaactgcgtaggcagccatcttttcaaacactagcataactcacacaaacactctctctctcccccctccatgcgattgagcactggacataactccaccttacttattgtcagatattatacagtttttttttgcgggggaatattatacagtagttacaagtgccattggtttaaccaattgtcaaattcaaggnttacttcaacctacgcaaaccganggcagattagtacttgactggacaactgaacaactttcaacgcaccttaagcggtaacaactnancttctgaaaaacaantgccctnaatcaactaaaaaggnccaggttaattgggcaataaacnccccaaaaccnccgtggcaaaattgtacantttacaggatagtggaatgggatgnaanactgcctgactccatatgcacaatnaagaccatcatactaaatgntgcaaaaggattgaaangtcaantnacgncaaaaaaaaaaaa

SEQ ID NO: 95421 - DNA, 683 bp, Triticum aestivum
  unsure (1)..(683): unsure at all n locations
  Clone ID: PAT_TA_95421
aggggaaagtgatctctgaccgcgtgcctgttgaagaatgagccggcgactcataggcagtggcttggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactgggacatctaagggtaaagcactgtttcggtgcgggctgcgcnagcggtaccaaatcgangcaaactctgaatactagatatgacccaaaataacaagggtcaaggtcngcantgagacatgggggataagctcatntcaanaaggaaacanccggataacaactaangccctaaatgacgctcaatgataaagagtggggtgaaaacancaagaggttgctaaaacaacanccttaagaatgctatactcatgttnacncctncctaaaataacgggctaacatngccaacntggattaaatcacgtnggactccctnaggaacaccaaacggggcanacgaacaaatcgttatacaaantgaancac

SEQ ID NO: 95422 - DNA, 299 bp, Triticum aestivum
  Clone ID: PAT_TA_95422
ggacaatggggcaatggagaccgagaccgagatggtggccggcggcaaggcaaaggcggacctgccgtgtctgccagacaacacaacaagggacagagcatatatactggagtagcagtatattgtacagagtacatgcagaagagagtgaatttttcgagctcgaactccatggaactcgtttttttctgaaaaaaaaatccgaaaatcatatatttgaagtttcaaaaaaaatctgaaaaatatacacatgactctataaattttcatgacgaaatctgtttgagaaaaaaaaaaaa

SEQ ID NO: 95423 - DNA, 359 bp, Triticum aestivum
  unsure (1)..(359): unsure at all n locations
  Clone ID: PAT_TA_95423
ctggccgaagaggttgaagcccatggtcagtgaacaaagttttgtacagtgcggatctgagcattaatgatgtagagtacttggatacatagaatcattacacatgatttgtgattttacgtcggatatcgattcttaattcggccaaccgtgtccacattaaggctcgggagctactggggcttccgtgcttattatttataaatatgaaaggggtacatcgatcccctgatcttgtgttgccaccccgaccagtgtctccgggattactgcattgcctggttcaatgcaagaaatcaaagtgcttaagggttggcttgacccnactataagcaatgcgtcttcaaacaacacagnac

SEQ ID NO: 95424 - DNA, 615 bp, Triticum aestivum
  unsure (1)..(615): unsure at all n locations
  Clone ID: PAT_TA_95424
ctcgtgccgattcggcacgaggagcaggcccatgtcctacgctagtgagtgatcggagacttaatgctcacaacgagcgacacatattatttgtgccttttgggttgcgtttcttggtcaaggcgggttgtccgcccggatgcttagggtttggttgtagatgttcttacagctaaagtgtacttctgctccaagagctcaaatgagcttggtaaacagtaaaatagtaataatttttttccggataaaagacttgtattaccaagaaacattgggagttacaatcaacaaagggctaactctacaactactgaagnccctgaaccaaaccaagtcatattctaccttcaatcctcgcataagaactaactatcgctacanattctaaaaccgactacaaaggatcaaattacgtaaccaaaaaaacgaaccnctaaaanggcgataaaggttaccatcntgcaccgaacactcggggacatgacactcacatatgtaccgtcgttgtccaagaaaactcagagantactccctcaatccgagaaaacccaccataaaanaaccccttccccagcatcanacanatcattncacgtcatttgtcattcacaacgn

SEQ ID NO: 95425 - DNA, 604 bp, Triticum aestivum
  unsure (1)..(604): unsure at all n locations
  Clone ID: PAT_TA_95425
gttttttttttttttttgagtgtctcatgaacatcatcattatcttgttcattatcagaaggtgagtgttcattaccaggttgagtttcagcatcagagatagaaatttcattatcattatcaggagatttttctacttcaggttcactaagaggcatgcaaagtcctatcatttttcttcttctttttctttttaagaaggactacgtgcatcggtgttagcctttgagancntgttcaattatttttggggtgtccctcaaggataaagtggtccctggancattttacctcctccnagtgctaccctaacagcaaanccatgtatgttatggtcattcatcctaacaaccccctttgagattaacaactggtccnaacggggtttgnacaatagaacagtttccaacactccnacacattgngatccaaatacaatcacccaattggcaacatatcagatnaatcaatggtcaaaacattgcatggaataactggttcaagganttcaaccaaaaggatggcaggnganatgtgngntacatacatgactcatagaattcccacactagnatgggggntangcattttccaannggaattt

SEQ ID NO: 95426 - DNA, 648 bp, Triticum aestivum
  unsure (1)..(648): unsure at all n locations
  Clone ID: PAT_TA_95426
aaaacttagttttagttttctacgggaagcatttcggagctaccgatttgtaaaactcggtgacaccgaagcaactttggagtctaaacatgtggaatcagctagaccaggacacagttcggtgactccgagtttgctagggtttcacaaagtcctggtatcggtcacaccgatttgcaacttttggtcagaccgaaaatcacttgtgcactggcctaagccaaatcgatgggaccgattcctacaattcggtcggtccgagatgagtacgacaaaaacctaaccctaaatcttcaactcaaatctaatcaagaggatgttttctgtggatggatcaatctcatacttggaaagaaacatggcattgcctttctgctaaggaataagagtaaaaagatacacaaagagttgagctcatacctagcttggngatgactcgctacggngnaacggaaaggagattccgtttacggcggcggagacaacggcggaagncnctggaacaaaagngatcggagactaggnggnaaacggaancacggcgaanagtttggnaattcaaatcgaccacntantaaccngangcgngtacatggaaancgngacaatcaaaccaggncaaancggaccnaantcacgtnccaataa

SEQ ID NO: 95427 - DNA, 668 bp, Triticum aestivum
  unsure (1)..(668): unsure at all n locations
  Clone ID: PAT_TA_95427
ttttttttccctgaatattagcatttctttattatggatgactatatgcacactatcagcagtaactaacaatgttgtagcttaacaaaccttttcacatcaaaccaagcatgtgtgccccaagcaattctagtctcactggcaccaattcaacaatgatttaggagacccagccgcatgtttctcaaattcctgctcccaaatcgatgtccatggtctcaagttctcgtcctcgcaacttgggagtgataagcaagtcttgcttctctaaatgtgcatcaatccaccctccaatgttcctcatgaaacacatataattcatcaagtaatacgtttccttgggctgtgttaccgcacaaaagttccttgggttcggaaacattggcttccgtgctgccagattcggtaacaacagccgtctccctaacatccctaagntccaacctgcnccttcctcaacctttctcctcatccactgcaagnttcctcaactcctgcaactcctgtccacatataattgctaacacacataagtgaacatacaggtcnacccacaacctgnacanagccatcaatctgagtcacataaccttgaacccgaangtaacccaaagangnttggtggaatgccaaaaataaagntcncagntcaaggntaaanttacaac

SEQ ID NO: 95428 - DNA, 638 bp, Triticum aestivum
  unsure (1)..(638): unsure at all n locations
  Clone ID: PAT_TA_95428
ggacaaaccagcaccttgcgagccaacgtgcctttgtccttcatctcttgatgacgtgctctgcttagcacacaagcagaagtcgacacacaaacacatcagtagtagttcgtaaaattacagagcaacattagacaaatattccgaagctggttcttgaaatttttgggaagcttgggggccacaagaagtctctgcaaacattaatgatggcatttgattcttccctcctaaactgaaactggtaataatcaaaagcaacacaatatgttccccacttctgctcaaaccaacaaccaaagatcattgtatgaancgctatcctgaaacattactaatangggggaaggcaaggtatatagntaataggctggtttccacaactgacaacgaacccganctaatctcttaagacaacacncctcgacaagaaatacggggcaccatcgcgcctccgggacaaccatgagagtctgacggtgatcaacacaacgtcaanccgggggcacgggntacacatncagnaaccctcacaacnttcatccaagctantcaaggaaaacnagaggatgttntagaaaaggacgtactatcccccctcagtnttnccgacgtattcaagnattnttccaccgtgg

SEQ ID NO: 95429 - DNA, 643 bp, Triticum aestivum
  unsure (1)..(643): unsure at all n locations
  Clone ID: PAT_TA_95429
gcttatcctgcccctattgtcttgtgtcaatctaagggaacttccatgtcgtccagcttttcttctctgtcgccacctttccttaacatcattacaatcttctgttagaacgtctccattaacatcacgattttcttcagtatgctcgttggcatccccattgcttgccaggcctcgcagccgagcagtttccgctattaggtcattcaccagcatctcggtcgtccttgtggtaatccctctcacataccatgcgatgggctgtgggggcaacagagcangttcaataagctgatccaaggtaatggcagatccaactcttcctctgccagcagaacaagaatcatattcttccagcgtatgtggatcaagangaagnatgcttccttgtcaacaaatangggctcnatttcaagcaacctcaaacttcttcataaaacacttcgcccttgtttgaactnacagtgtganttcttcgtcctggcaacaaaaaatggactgacaagatgcaagacaacaaaggaattcaaaacnctcctgtcactnaacaactgctcaacctnataanaaaacttctcaaacacttcttaaatttgaaancttgtcccgggcantaaagttgaacngcncgnggaaccgctaa

SEQ ID NO: 95430 - DNA, 265 bp, Triticum aestivum
  Clone ID: PAT_TA_95430
tttaacgtgaaccttgtacacatcgatcttattattcaacaacactgataaaacatacactcgatttcgaatggattgaggaacaacccgaagctacacaccaacgaaacaatgaaaaatatggacatgaggcacgcgacttgaacagtctgacttcacagtgcaccactgtttagcgaattacgtacttcgtacgtgcttaaaccgcgtgctccatcatggctttgaactcggggaacccgagcccgccgtccgcgccgtgcgg

SEQ ID NO: 95431 - DNA, 660 bp, Triticum aestivum
  unsure (1)..(660): unsure at all n locations
  Clone ID: PAT_TA_95431
ctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtgtgtgtcgacganccccgaaatgtggcgctgcgcggatatgaaatccaccgtcgacggcacctgcggtgggacctgcaagaantactgatcggttcatgccggcatatgatatttccgcctaaaattaaataaaactccngacgaaatgacancgtcatccntgcctangcgtgtgtgttttgaccaacaaatattntaccattatgtcntgncttcntcgctgtgttttctcctccaagggggggcccgtaccaatncncctanatgatcntattaccgcctcantggcgtcntttaaactcctgaacnggaaaaccngggttacaaantaanncctggngaaaccccttcgcaactgggtatacaaaaggcccacgttgccttcaaaatnccacctaatgcaatgaaccccntcggataccgggggn

SEQ ID NO: 95432 - DNA, 643 bp, Triticum aestivum
  unsure (1)..(643): unsure at all n locations
  Clone ID: PAT_TA_95432
actagagttatcagcacgattttcaccacacatgtacgtacatatctacatacctcattatccaggtaattgactaacagaagatctcacaacacgtgatccacgccaccaatagaaaaagaaacaaccatcaagtgttttacaaggcagtgtattgtggtttgtttcacaattaatacacaaacaagccatctttgggccaaccaagtttaagagcagatagagcaaaccaacaatgttacagttaaataaactacaggaactacaagaagtgttgtcatgaacaanttaaataaccataattgcacaatgcaacatttttgggttaacacattcaatggctacaatgtttttttaattggataacaatagcacaagggtaagaatnttagaagacccacaaaaacttgggaantacttggtatgaacatgctgagggcattnaggttnccaaggcagntatgcttagtttcacaaatatcacaccacangaaaanactactanaggccgagcaagataaggacatgggtaaaccaagtgacacatatttgacagaagttgatctncagaaaagaactacaaagttgcctnaantgnagtccaaaatccacatccatnnaatataggcatctactcattcgc

SEQ ID NO: 95433 - DNA, 401 bp, Triticum aestivum
  unsure (1)..(401): unsure at all n locations
  Clone ID: PAT_TA_95433
accncagacccttttaaatgtagcacanaanagtgganctcgaanattgatgtgtnttcgantcatnagganctgctggtaatcatccgatatnctcgtattggtgatgttantgntgntgtnatcaaanangcattgccccaaatgcctctagaaagatccgaannaattcgagctgtaattgtangtacatgtaaanagttcacatgcnaagacngtanaataatccnctatnangacaatgctgcggttaaaaatgatcaaaanngcaatccaaaangaatcnagtttttggcctattgccnacgaattnaaaagattgaattttaccaacatagttcatnagctcntgaagtaatacaaatactagtatgngaaatnncattaaangattaatttac

SEQ ID NO: 95434 - DNA, 616 bp, Triticum aestivum
  unsure (1)..(616): unsure at all n locations
  Clone ID: PAT_TA_95434
gcgtggcgctgctgcgagtgacgggtgcgggtgggaaggcgccacacgtcgcccttcctctgaacgtcgcccgcccgcccgcccgcccgcccgctccagcggccgcgtctggctccgcctccgtgcccgtgcctttcccaatctctctacagagcatttcctcctccccctccacgagatagcagcggcgcccgtgcccgtgccctccgcgcggaggtccaccgctcgtcgctcgtccggccggttgccccatccgcctccgcgggtttcatgaagagcgacaagtagtgcccagtgggataagaatggtcacangagctatcactgctctaagatgaggctgcngctgcgtctgctgggtctgtgcttgatataatcctanttgtggtcnaaacatggaagctacaacgcaaacagaaatgttgatgaanacctccccgtttgatacaataatggggtctaaaaggctgctgttaaggatcccggactggaaaactaatgcaaggttcnanaaactgntcacngcaaggtcggntttgcnangganatggacctacccacatgggctaancattaggtaaanaactgaanaaagatcacaaaatanagtgttatt

SEQ ID NO: 95435 - DNA, 648 bp, Triticum aestivum
  unsure (1)..(648): unsure at all n locations
  Clone ID: PAT_TA_95435
aatctttggggctcaatacagtttgtcttcctccaagtatttacctttggatatgtgcatggcattccactatcttgttgagaaatacacaacttatggaggaacactttttatattggccttctaagcttttcgcccattttggcaatcgatgccaatgggggagaagtttcagagagtgttgtggagaagttttcagagtttcttcttgctttggtcttgttcctaagcatttgcatctcatactcatgcatcattggttgttacattgcatggtgatgcataattccttatataaactccccttgaaagtgattgtcatcaattaccaaaatgggggagattgaaaggacatgcggtgcccccatgtgtggttttgggtaattgatgacaatctctatggactaatgggtgccttgagttatatttgaaggatttgtccataggctttcctgggagtcaattctcggttcaagganatttgtgatgacaagggcnatcaaggaataccaaagatggcagtgaaaggtgataagacaagcaaagatgaatcagttgataacacacaaactaaagattnccangggatagtatccatgnaggaacatgcantaccntggtcaaccangatcagaagtcttgngggtg

SEQ ID NO: 95436 - DNA, 622 bp, Triticum aestivum
  unsure (1)..(622): unsure at all n locations
  Clone ID: PAT_TA_95436
gttatagtgagtatcattcttttacagttttggcagtagcatgggtagtgcggttaaatacctcaagcgaggatcaccttgatttagcaaaagtaccacttatgtgggctcttcctccagcgttggctccatcaaggtggcggacggaggaacgggcaggcggtgaggaggaggcgacgatcagggggaggtggaaggcagtgggaaggtgcagacagtggcaaaaatggccaaatgtgagggccctggatgagttttgggtgggtcccnccccgtncggntttgtaantggcggacgtctggacgctcgcaaaccgcgagtttggtttcggtttgtgggatttcaaacgttcagtttgggtccagacaattttggtgaacgccgttagatgccaaaataattctgagctgtccgggccgtgttggtattgcccaagggaatgaaggtgcccggttgtagatgcccnaacaagcaaggtgaaaaacagagaagaacatgggcatcanctccccggccggtcctcctaatgcgtaccggggacaaagnatcaacaacccggtagtccanactggtgngccccactcagcaacggancaagacantcactaacaactcntcaga

SEQ ID NO: 95437 - DNA, 642 bp, Triticum aestivum
  unsure (1)..(642): unsure at all n locations
  Clone ID: PAT_TA_95437
gcttgctggcctccagtgaaggcaccaacgaactcgtggcatagatctgaccaagaagaaatggaatccgccggaaagtgcatcaaccaagacatgacattgggttttagggccaacggaagtaattggcaagcaccttgtcgtcacgagctccaatggcttgtatcgcgatggtgtagatgctgaggaactttgacgggtgggtcttgtcgttgtacttcttgccgacgtcgggcttgaacgtgcggtgggacggccactgggaactgccacagcccacaggtaaaagcagggcaacccacctcgtaaggtaagccgccggagcctctcggcgctgggtggtccatagcgggccctgcccgcctgtctgactgggtgggcgcgtatctcgccggtgctcnatggtggtccaagcgtctcaatgggctcctccccaaanaactggcgttggncccgtggtccgtgggtcngacnatncatggaatncatcaaaagctcatcacnacggacganatnccgtggctgcttgaggataaattcacaaggcttggaatctgcccncaacccggaataattgcncatggncccggctanggccccgcctgcncccttttggaacccaaaannnccagggcgcnaatn

SEQ ID NO: 95438 - DNA, 649 bp, Triticum aestivum
  unsure (1)..(649): unsure at all n locations
  Clone ID: PAT_TA_95438
ggccggcccgcgcacgcgccggtgccgtctcgcgctttgtctccgccgccctcgaagcacatcctgggcccttccccttcgccagcttcacgtgcagtttcttggacggcgccgaccgccgcgtgctcgcgcgctggttccagctccttgccaccaagggcgtcaagcagctcatcttcgccaatcgccctgccccgcttcccggcctgcgcctcccttcctcactcttcagctgcgcctacctccgccggctctggatctgtgcctgggtgttcccggagacctccaccctcccgcgcggcgccggcttccccaacctccgtgaagctcgtcctcggccgcaacgtcatggaggacaaaagacctcgagttctgctcggcgtnagcccgtgctggagatctcgtggtcnccgggaacgagaccgattgacgcttgtctcgcaagcccaacctanggtgcgcgcaataagcttgtccgcctggacaagtcccnttgtgggacgcccaaanctgaacgtccttctaacaatggaanacaaaatanacaaataanattggcatcnctaactggcttgtgganactgaacagaagaatatgaaattgaaacacataggtganaaggacgaagacactcaagtcaattgctna

SEQ ID NO: 95439 - DNA, 640 bp, Triticum aestivum
  unsure (1)..(640): unsure at all n locations
  Clone ID: PAT_TA_95439
aagaccattattctgataacaccgaaaccttattctgctaacacccgaaaacaaacaaaagcaaccactgcccacccggtgcatcccaccccacctgccgcacgacacatacctccctcctaacccgatccaagccggcctagtgcaacccaccttctccggcgtgatgcgaccacccgagcagtccgccccaccctccccaccatctctgcatgtggcgcgtcccacccgtaaaaaatcccggccgcctcgcctcctcctttgggcggtgtcaccgcggcgctctcctacaagacgggtgatactctccaacgtatctataatttagtttgttccatgctgttatattatcattcttgggatgttttacatcattttanagtaattttaaatcatttttgggtacnaactattgacataatgccaaattgcaatttangntttcggacgttttttaaatcccanggaatcaanaccnaagggtccaaaanagnnaaacttttggggattttttggcaaaagaaacaatggtcggaaaaccccaaggggcccaggggancncccaagggcctagnggcaagcnccctttggttgcccccgggggnccnaaccccntngcaaaaaacaattcaaaaccagg

SEQ ID NO: 95440 - DNA, 413 bp, Triticum aestivum
  Clone ID: PAT_TA_95440
ctcccttccagaaccttccctcatcccctcccctctgagatccccccatgccgacggcgacggcgatatcgctctctccgggggcctccgccgccagacgccaaaccaaccccctccaccgcgccgcctcctcctcctcctccccatcctgcttcaacccgccgcagccgaggcggccgctgccccgaggcgccgtcgccgcctccgcctccgcccccgccggacgccgcgtcgcccgctgcaaggccgccggcccctccgccgccgaccacgtgggcgatgtggaggagcagacatgggacgaggtcgtcctgaggtgcgagacagtggtgctggtcgcgttctgggcgccatggtgcggcccctgccgcctgatgcacccatcatcgcagactggcaaaggcctacgctgg

SEQ ID NO: 95441 - DNA, 573 bp, Triticum aestivum
  unsure (1)..(573): unsure at all n locations
  Clone ID: PAT_TA_95441
cccaaacacaacccaaggcctgaaaattactccttttcgacaccgccacgcgtaagcctgacccaaacacaaccttaggccagaaaattactccttttcgacacccccacatggaanaccgaccagaacacaacccgaggcctgaaaattacaacatttcgataccacaacgtgtaagcctgaccagaacacaacccgatgcctgaaaattacaacttttcaacaccacaacgtgtaagcctgactanaacacaacccgatgcctgaaaattactcccttttcgacaccgccacctgttaagcccnacccaaacacaaccaaagcctgaatattaccccttttccaaaangccacgtnttaacccgaccaaacananccgaggcannaaattccctttttgananccanattttaanncgaccaaaataacccaaggttgaaatncactttnnacacacaaatttanccgacggnaaaancggtgccnaaattaaattttgaacccactntttccnacaaaaaaaccntgctaaataccctttaacccaatttncnatcnaccnttccatgga

SEQ ID NO: 95442 - DNA, 596 bp, Triticum aestivum
  unsure (1)..(596): unsure at all n locations
  Clone ID: PAT_TA_95442
attaaacaaaaagcctttgttgcaatttatttcagtggtgtgctcgattccttaggtaattgaccaagaaggtaaaacagaactaaaaaatcactgtggaagatacgtgaactgataggcatcgtcgatacttaaggttacgtacttccagttggaatattatttactatttagtcattcaaatgtgtctatgtagcactggcacaatatcaaaaccatgtggatgttatgaacttttatcttgtttaaactaaaccttttggattaagtactatgttctctttgctattagtgccactatttttttgggtgcaatcagtgtttatagttatgtaattgtgcttgtattctgtaattttgcaaggtttaattccctcntatgctcgagatgaaattttaaaaggtcctgaaaggatanagaaggacantgaagtgggaaaatcccatggggaaacaataaagatatccnggccaacattgttgaagcacccantgacataattgaagggccaacaaaaagntggatcantaataaccgttanccaaatctacagcctcaaataggtgcatgacncatganaattgtgccaaataaa

SEQ ID NO: 95443 - DNA, 203 bp, Triticum aestivum
  unsure (1)..(203): unsure at all n locations
  Clone ID: PAT_TA_95443
ntatcccccgtccgtccgtccgtctaggtctggagaagcggcnatggcggcgcccgtgacggtcnacgggccggagatntcgccngcngtggcccgcgtggcggcgtgcctgctggaaaaggacntggccttccanctcgangcggtggacatntccaanggcgatcacaatccccctccttcctcaanctccancccttcgg

SEQ ID NO: 95444 - DNA, 401 bp, Triticum aestivum
  unsure (1)..(401): unsure at all n locations
  Clone ID: PAT_TA_95444
cgcggccgtgctggaggccgcggcagtctacctgcagctcagcggcgccggtgacgatgatgacgacgggggcagcccgctcccagggatcatcctggtcgtcgtcgacgtgctggcgcaggcgctgctctactcgtccacgggcgccgcgtacggcgcggtggtcggcgtcgacgtctgcgtggcggtccggcgcgcaagtggggccgggccaagctgctnccctttggcgccagcgtctcccttcngctcgccgccgttcgtcaagactctccgctgccgttcaatttctggcccggtccttccgacttagatgccngacggcagcccaaaaacgttttccttttaatgtgtntncgttcatgnacaatncagatatttgcaactgtaacancctgtac

SEQ ID NO: 95445 - DNA, 647 bp, Triticum aestivum
  unsure (1)..(647): unsure at all n locations
  Clone ID: PAT_TA_95445
acgcttcgcacttaaatgccattacgggttacatcaatcccctcatctggtgttgccacccgaccagtggctcgggggctactgcattgacgattcaacgcagataatttagaaagtgtaaaacagttttcgagggaattacgatcctcaggcgcatgttgaatttttgggccaacacacaccttaagggctcctgggctatatatctcatcagagaataaattgcactgattggataaaaacatatccggcataaagcacggatgcaantatccggtataaactcaagatgcaantatccggcataaagcttgggtacaantatcggttccatagagggatttcccggtactaactcggtgaancccttancctttcaaacaagngattatgacaccttggtacatccggttttggacccggtacatccnacattgaactcaaataagtccggcttgggactcngancatccggcgtnggactccgancatctaacttggggtcngatcanaagacacaacgcacgggaacgacttaaccgaatgtgngtaaatanaancttgtaaggcaaaaattaangggnccgggtaaccgagttaaacctcaattncttngattccanntnagtaaaatttcgaaaagnggg

SEQ ID NO: 95446 - DNA, 640 bp, Triticum aestivum
  unsure (1)..(640): unsure at all n locations
  Clone ID: PAT_TA_95446
cccctagagatgtataagaacacgcccacgcccccgacggaccctagcttccccctttctccccacacgcgccgctgctctcttccccatccacacccgacgccaccgtcgccgtgccgtcgtcgttcgcgcgcaccggaagctccccgcgccacctgggggacatccaaggaggaccgccactctctccttccgtccgtcccgggggccagtcaagctaggacaccgcatagctcgccatcgcctcttcttcccggccacggtccgtcgcgcgtccccgcatcgatttccaacaccgggctccccggcatctcgantccgtctaatgactccccgactatgaactgacgccgctgctgcccgattngatacttgttgacaccctttcttggccaaganaaccaaattcccggngccaagagcaaacccacgttnacgacatcctatacatggagggcctacaaggctncatccgctgacacgacaaganaattangaggttcaagcaggagggctgcgcccttcatttgttccannttgtgaaacctcttaggaatctgttactaggtcgtaccaaattgtgtttcgcgaccctcatattanncttgttnagccttagcctgtttttaaaaaaaaaaaa

SEQ ID NO: 95447 - DNA, 562 bp, Triticum aestivum
  unsure (1)..(562): unsure at all n locations
  Clone ID: PAT_TA_95447
gaacacttgatcttgttcggacgtcaagtttttactgacgtttttcttggttttccaagcttatggcacttttaaactatttgtgtgttttcagcacaagtcttgcagtgcaacgccaaacacctttagagattcggcaaaatcattctcggatattgctatatatgcatcggttttgaatagtgtcttcagtcaatagttgggttgcccggctcctgtgcttgcctcctatgttccgctttgttcggctangtgtgcaaagggagaaccgctacgattgtgcttccagctcacatggttaagcactcaagtggagaaacccgaaaactgactaacacaataagcgtaaactgattaacatcctgacacagtgtttaaacgatgggcattcataacaatggcgaatgtttaacgnttgactctacgtcgccgaacactaccggggctatnacggccccnaacaaacccccaatttgccctacattggacgagntcagatnagctaacatgcaaccaaagaaggacnatacggacaattcttgaanaantctcgtaacatata

SEQ ID NO: 95448 - DNA, 322 bp, Triticum aestivum
  unsure (1)..(322): unsure at all n locations
  Clone ID: PAT_TA_95448
tttttttttgttgtttcaatacaaacatatataaaatcatttcatgtccttgcaaattacattacaaatagatgcaacaaaatcaaactacagtttatgtaaacaagattctattcctattttcctgtcccgcgcaggatacagccatcggtagaaccaccctgcaaacaaaaacaacagtagcaaaaaaaagcaaaaacagaagaaacaagcattgggttattaaaaaaaantgaagtgatcatcaagtacctcaagaccgtcctattcaaaagtgtcctcattggtacagacaatctagttgcctgttctgccggggggg

SEQ ID NO: 95449 - DNA, 623 bp, Triticum aestivum
  unsure (1)..(623): unsure at all n locations
  Clone ID: PAT_TA_95449
ttaattttggggcggctagctctatgacaccagcgtcccgtagcatgtgcttgcagtcccctgtaggggtgtgcgtcatgtatatcatgattactgtcttatggggggggggggattgcttctgacccctgatgttcggttggcgagtctcttcgtcatcactgtcactgggtggccccttcaccttgtgttcggcattaagcttgtcgacttgtttaaaaacccaacaaccttgttagtgtgattggctggtttaatgggggtgccatgaatctggcaagaccgattcaatatcntgtccaaattggatattcgtctcngtccgccttgaatggttttttcctttgaccgggtatggacattgaacctggnattaccgttgtaccttgcgtncttcattttaatggtaccctgtgttaatgtgncctggttgccgttgcanctccaacttggaataccngttancatgtgttnatccaacaacaacaactactttccaaaaaaaaancaccgatggaaggnacaggtctggtttctnacnagtgtggcaacaccatccaagaagttaaggcctaggctcggcgaaacaaattgtcctttangacnacaactccgaaccctgg

SEQ ID NO: 95450 - DNA, 305 bp, Triticum aestivum
  unsure (1)..(305): unsure at all n locations
  Clone ID: PAT_TA_95450
cacaancacacggtcccaagctgcgatcgctcaaccaaatcganacgctagcccgatttcatccgcccancttgatgggcgccacttcgccggactccggagacctcatcctggacnanccggngaggccggggtccaaggtctccgtggtgaccatcaaccgccccgatgcnctnaacgcgctgacgcgctcnatgatgatntccctggcctcnganttccggcngctggacnccgacnancgcgtggncncngtggtgcccgccggtcgcngncgcccttctgcncaggggtggncctcaccg

SEQ ID NO: 95451 - DNA, 378 bp, Triticum aestivum
  unsure (1)..(378): unsure at all n locations
  Clone ID: PAT_TA_95451
gttgcctgttcttgcaagttctctgcagcttgcgataagcaggaggcttggtattgaagaacctcaactgatgaagatagtcaggacaacacttcacacacacaccgaatggtttaagcttcagatgtgcaaggaccgttttgatcattttttgaagattgattctctaaaagagattgatccacctgtgagtcgcactatgtccaaggttcttacagatgaatgtggaaatggntcttctcaaatnacacatgcccaantggnaagggctgattaaaggtatanccccagganncaacggaatttncgccaataaagcgctatacccaaagttangatncctgcntttccaaagggcnacccatccantatcaccca

SEQ ID NO: 95452 - DNA, 307 bp, Triticum aestivum
  unsure (1)..(307): unsure at all n locations
  Clone ID: PAT_TA_95452
cctcgccgccgccgccactccgccgctgccgccgccgagatgggtcgcgtgatccgcgctcagcgtaagggtgcgggctccgtcttcaagtcccacacccaccaccgcaagggccccgcccggttcaggtcgctcgacttcggngagcgcaacggggtacctcaagggcgtcctcaccgatgtcatccacgacccgggcgttggtgcgccgcttggcaaggtgactttccgcaaccgttcaagtacaaacacaagaagnntcttccttcccgcccaaggtatgtaaaccggcaatttcntcnaatgg

SEQ ID NO: 95453 - DNA, 179 bp, Triticum aestivum
  Clone ID: PAT_TA_95453
cctacattggcattgctcctgagttagccaaagagatcgcggaagaagtggatgttatcgtaaactctgcagcaaataccacttttgatgagaggttcgtgaagctatactagtcttgcaccaaggattgcttccattactaaatgtgtaagttcacattccatagcaaaaaaaaaaaa

SEQ ID NO: 95454 - DNA, 254 bp, Triticum aestivum
  unsure (1)..(254): unsure at all n locations
  Clone ID: PAT_TA_95454
cggatcagctgttttgcgctttttatacatatcctttgctcttttttatttatttattgaataaacatcatgatctaaataattactccctccgtccaagtggagctgcttctgctggttgtacaccacttgtatacgttgcacgaaagaaaaggatgtacaatgtcccgtagccatcgcatcaaaacccgtggatcttgtttgattttgagtaagacaaatctantcattcttgaactnccnccaaggggggg

SEQ ID NO: 95455 - DNA, 534 bp, Triticum aestivum
  unsure (1)..(534): unsure at all n locations
  Clone ID: PAT_TA_95455
tttttttgtatcatatcccaaatctttaggccattgcaatacttttgtacatttacaatacatacagtggttgaagcacttgtacagacagaagaagagcaaacactgcagttgccctgcctgtgtttgacacagtactatttcacatccatcagtgctttatgacattgtttatcttctttggtgtaattgtaatttgcaagtaccttggcgtgctctggttgcagatttacctagttgggtccatgcatgcgatgcaggtgcggttcatttcagccattcttcagctgcagccgccggccgcgaagccgatcctggactgcgcgacgtcgtanacgacgccgaacgtctgctgcncgtgttcccgatgatcgctgtnctgtcngtggccgccnaacncgaggcacgtcntggactctcacgtccatnagcacattgcccggcgcaacttcacctcncnccgccggcannccattccacgccggnaccccaaccttgaaacctgncctnaacncttccannatgntaccccgg

SEQ ID NO: 95456 - DNA, 461 bp, Triticum aestivum
  unsure (1)..(461): unsure at all n locations
  Clone ID: PAT_TA_95456
atcaggcatgtgccgaaaccaatttgacttaatggtatcccctgaaacaacttttcagtttcatcgaaattcatccgatgacctctctctgcggaaccttttccgctgtccgaaattttttccggtgttcgaaactttttcggtgattttctctcaagactccttgtctaagtattcaagaagatagatgacccttaagcgtgtgaccctatagntcggtgaactatagacatgacccggaacccttccgatnaatgatcaacatccggagccgtggacaccatattgaccctataccacacgaataaatatccagtgaacccctaattgcaatgagcatcaggtgcttcccnaaagtcacaaacaccnaagngaaatgggttgnaccaagggacaacattntccacaatcaantacncntacnggtttgtcccttcccttccgtgttccggatccatgat

SEQ ID NO: 95457 - DNA, 631 bp, Triticum aestivum
  unsure (1)..(631): unsure at all n locations
  Clone ID: PAT_TA_95457
ggttaagggaacggaacccaccggagccgtagcgaaagcgagtcttaatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactccgaacccagagctagctggtctcccccgaaatgcgttgaggcgcagcattgactgggacatctaggggtaaagcactgtttcngtgcgggctgcgccgagcggtaccaaatccaagcaaactctgaatactanatatgacccaaaaataacaagggtcaagtccgccagttagacgatgggggataacttcatcgtccaaaaggaaacacccggttaacaactaagnccctaaagacgtcaattataaaggagtgggggtgcaaanacaacaagaagttncctaaaacaacaccttaaagatgcgtatacnactgatcancgccntcgctaaaataacggctaacattccaactgtggattcaaatcancgtagggacntccnctaaggaacaacncaancgggtcacaacgaacaaaattcgttatacaaaaatng

SEQ ID NO: 95458 - DNA, 602 bp, Triticum aestivum
  unsure (1)..(602): unsure at all n locations
  Clone ID: PAT_TA_95458
ggaagagagatttcacatataaatatactatcttggacatcttctatgattgtgagccccattaattattttcaaacctgagcaaattagtagaaattggacaaggaagacaacataatgagttatgtttgggtatatttgtatagaagtaatattgttatggatcttctaacatgtggtgcttgctatttagaatcctttgctagccaaaatatttgtactaagcgggaatactgcttatgcatccaaaaccttggaaccaantccttccatgagtgtccaccatatctacctatatgcggtatttacctgccgttcccaagtaaattgcatgtgccaaaccctaaaccttccaaataataaccnttttgtatgctccgaaccctcaagttagcgactaaggctgtcatactccaagctaggtagttatcctcacgatgatggacccgccacatcaacgagaagaggcgggaacgggagccgtccaagtcaaagtnaaacaatcgcaataataaacaaatcccaggaagtgaaattgncggactgtgttcgcaaacgtgatgtatgttgtgaangagtaaanttacttcgatgaaccccaa

SEQ ID NO: 95459 - DNA, 356 bp, Triticum aestivum
  unsure (1)..(356): unsure at all n locations
  Clone ID: PAT_TA_95459
cgggcgggccatccggcgcagacgacctggcgaagctgaagccgctgcattgggacaaggtcaacgtggcggccaccgaccactccatggtgtgggacaagctcaccggcggctcattcaacttggatgaaggcaccatcgaggcgctgttcggcaccgcggcggtgaaccgcaagacgaaatccgcggacgccaangacgccttccaacggcttcnggcgctncgacctncggaaaagcaaatattcctnanttgaccaacccaatttcanaaatatccataanactccngtgnctcaaacgtttggngngacaaaatntatntaaaccttcgttatttgaanaacactctggac

SEQ ID NO: 95460 - DNA, 300 bp, Triticum aestivum
  unsure (1)..(300): unsure at all n locations
  Clone ID: PAT_TA_95460
gttctagtatcaagttgtaatattgagttgtaagtaaataaaagtgtgatgatcatcattatagagcattgccccatgaaaaaaagaaaaaaaagaaaaaaaaagaaaaaaaaggaaaggccaaagaagcctaaataaaaaagggggccaaagaagcccacccaaaaaaaggaaaaagaaaaaaaagaaaaaaaagaaaagaaaaggggcaatgttacnatccaatttccaaaacttgtgcttcaaaattacaacnanttcttcaaaatggtttgcccccaaantggtncctttcaaaat

SEQ ID NO: 95461 - DNA, 638 bp, Triticum aestivum
  unsure (1)..(638): unsure at all n locations
  Clone ID: PAT_TA_95461
ggaaggaaggagctagcagcagcaaagccaaagccaaagccaaagcaaattgtacagaggaagcgcgcggcggaggcacacgcgcttctcgtgctgccttggcgtgggtggggagaggtggggaagcttcgagaaggttccgaggcgggagagggctgctggtgggggcagcgggcgccggaagagttttggggagggaacgagctgctgcggcggagcctccgtgacgctggcggcggccgtcgtggtgaccgggtttggcaaacggcgtccgtncggaaaggcgctgggcacgtacatcttccggatccctggccatcgccggcntnctgctcccggactgggattctttcgaccgcgantctccaannggtcaaccccatcccgcctcccgccgcacnccgccgccgccgccgccgaacccaacacacatttggaattaaacgtatcaatcaaggatacctnctcacnacatttacgntttggacttacaatggtggacttctattaataacagaaagccaagactctccccgtncctctatatcaaagattcagatatacatacatcataaatncttgctgctcatntagcattatantctgatntnaaantcggggatanccgccatttattt

SEQ ID NO: 95462 - DNA, 230 bp, Triticum aestivum
  unsure (1)..(230): unsure at all n locations
  Clone ID: PAT_TA_95462
ccctcctcccgcgacccttgcctgccgccgccaccctcctcccaatttctctctctctctctctcctcgccgctcccggaggctgctgctagacaaggccacggtgcccatgatggggcggcgtggatctgatccccagtggtctcataggccaccgatggtgtatcctccctagggattttggtggtggncattggnccaacgacnacaatggcnaagggggtttccct

SEQ ID NO: 95463 - DNA, 622 bp, Triticum aestivum
  unsure (1)..(622): unsure at all n locations
  Clone ID: PAT_TA_95463
gcacagagatcagatcagagcctacctagctactcactcaccttcgtcgagaacttcaccatggttgtcccggtgatcgacttctccaagctcgacggcgccgagagggcggagaccatggcgcagatcgccgacggctgcgagaactggggcttcttccagctgggtgaaccacggtatcccactggagcttcttgaccgcgtcaagaaggtgtgctcccgagagtaccgctccgaagaggcggcntccggtcctccgagccggtgcagacctggagagntggtggagacggagccgcgcggcgagcngtngngcccgtnggacacattgactgggaagaatcttctactccaacgacgacaacaatgggcgttccgaccgccggcttcaaaggagacatccggattacgcgccnactcaaaaactccccggacgggcatggaggcatggacnaaaactcggcnnacaaaggcccatgaagnggcttaacggnacggctcaacgccgtctcggacaagtagcataccgcgtgcgcgccgacctatacgatccggcgaaacaactgggggtatctntgtcagcaaagtcggccttaggnaagagnatgtngntacccccccc

SEQ ID NO: 95464 - DNA, 634 bp, Triticum aestivum
  unsure (1)..(634): unsure at all n locations
  Clone ID: PAT_TA_95464
tcccaagataccgcttttaatgagctaaagaattttcttactcatgctcatgtgcttgcattacccaactttgacaaaccttttgaaattcattgtgatgctagtggtaatggcataggaggtgtgttaacgcaagagaagcgccccatagcatactttagcgaagaaacttctgggagcgcaactcaatcatctcatctatgataacgactatatgctttaatgcaantttgccgttaatggggaacatacttcaacctccatgaatttacatccataccgatnaatgaacacccaantaactaaagggtcaaactaagtttaacaagcgtcatgctaagtggagtgaattcattggancatttccttaanncaacaaantcatcaaaggtnaggaaatgttnttggcgangnccttccccgcaaaagcatgcttgncacaaantngatgtatgtcatggctttngcacataaaanatgtatgccatgntcactttgcatcctaagcaatgttgagcanaaacnttgaagcnttaatcaggtnttactttnagcaanaaaatgatcccanttnngtcctggcctttnaggccaggggggcaanggancnttggccaaaaatnccccccccaaa

SEQ ID NO: 95465 - DNA, 619 bp, Triticum aestivum
  unsure (1)..(619): unsure at all n locations
  Clone ID: PAT_TA_95465
aagctcgagcatagcaacagcactaaagctaactagagcttccagcaatggcgacctccccggtgctcttcctcctcctcgctgttttcgccgccggtgccagcgcggccaccttcaacatcaagaacaactgtggcttcacaatttggccggcgggcacccggttgggtggggaggcttccncgctgnggctcaagggcagacgtccagcatcaacgttccccgccgggcacccaagccgggaaggatatgggccgcaccggggctcctttcaatggcggttancgggagctgccaaaccggcgactgcngcggcactatcctgctccctcttccgggcggcaaccaacaacgctggccgattacacatccggnggggganacccagattttacacatctcgtgatttnacgttnaactttccatgattctcctgcacaccgggaccctccatncaaggacccactcccgcgccgaagctacaaaccaacantttcaaanaaccncangggaataataatacanttacttcgtcataanctctatagtccacgcaatcataaaggtncttattacgcattaataaagggtcggctaaaaacaattntattaaacccgt

SEQ ID NO: 95466 - DNA, 637 bp, Triticum aestivum
  unsure (1)..(637): unsure at all n locations
  Clone ID: PAT_TA_95466
gtcaaaactggctcggtcagaatgtttccctttagaacatgcataatgttagacatgaacaagctgatgagaattatgatttacattgtttctcttaactatatcatgatcaataaatattgttaattatattgttaaggcgaaattgcgtgatatggtttatcggctaggactttagcttttaatagttaagatatatagctggatattatcactttaaccaccatcaaagtggatactggcttcctaacaatcatagccgtttgacacaagtgacaaaactttcccttgccaaattttaagacatcctaaacacantcccagtaatccaacngttcactaacaatgggtccnanattggtaaattngnaccaagatcaataatttccccaaaatcccaaaagggttganacccaanntccggaattgtccaattttcaaaccnaaaccattcaaaaaagttattaaaaagnggtggnttgccaaaagatncataacantccttcgtcaantccaatgtgttccnaaggcanancacccatattcccaccnnagttgttttagnatttacaagggcccngaatccttggcaaatctttccgnatatcccaatataaaagcntttnnggtctaagca

SEQ ID NO: 95467 - DNA, 533 bp, Triticum aestivum
  unsure (1)..(533): unsure at all n locations
  Clone ID: PAT_TA_95467
gttaggacgtctacccgcgacatttgcccttcttcatagaacatccctgttttcgaggacctccttcatgattatttgggcaagtacacgttggatatgatagaactcagctcgaagtcgatgatcctggatatctcctaggttctttgcccattggcaagaatatggggcatcatccggatgttaggtgacatgcgaagnccctgctggatcctgtctatactcccagcatgtnggtgttagggcattagaaccaccactaaganaccacccnntttccngggatgcaagcaaaanccgncctttatggacnaaaggcggcctgcggtccttgtctcccgggcttgantccccatccccgtgtgtttgntnnataaaaatacatttgtcaaaaataactttatgtggggtggnacctttttggtcaatgtccttccnacnattaaattaaaaccntgggaaaaccgggnnaaggatatagaacgggcccccttggtgncaaanaattacccaaattaccccanatgcaatga

SEQ ID NO: 95468 - DNA, 410 bp, Triticum aestivum
  unsure (1)..(410): unsure at all n locations
  Clone ID: PAT_TA_95468
ctacagtcaagcctgttacattggaacttggtggcaaaagtcctattgtagtatttgatgatgtcgacattgacaaagctgttgagtggactctatttgggtgcttttggaccaacggtcagatttgcaagtgcgacatctccgtcttcttatccataaaaatatcgctaaagaatcctccgacaggatggttgcatggnccaaaaatacaaggtgtccagaccctcctcccaagganggatgcaagcttntggcattnttaantgaaagacattatgagaaattcaagaattttttnccgaatgcctaaaattaaagtgccacattctgactggggtgtntaaggcccaacatctggagaaaggttcttcaatttaaccacancaacactgacatcaacacatcatatg

SEQ ID NO: 95469 - DNA, 650 bp, Triticum aestivum
  unsure (1)..(650): unsure at all n locations
  Clone ID: PAT_TA_95469
cccagagacgaggaagggcgtagcaagcgacgaaatgcttcggggagttgaaaataagcatagatccggagattcccaaataggtcaaccttttaaactgcctgctgaatccatgagcaggcaagagacaacctgggcgaactgaaacatcttaagtagccaagaggaaaagaaagcaaaagcgatccccgttagtagcggcgagcgaaatggggagcagcctaaaccgtngaaaacgggtttttgggaaaagcatacaagctttttgctgctaggcaaaccggttnaatgccgcaccctaaatggtaaatccaatttncccgaaacatcnacaacttaacctcttaccccaatnacaatggggcacttgaatcccntttnaatcaacaaggncaccttttcaagntaanacccctggggtgaccnatacaaattttaccntttgggaaagntnaaaaaaccccatggtattnaataaacgttaaccttctgactcccaacantggganggaaatnattcngacgctncctgttaaaatnaccgngancatagcaatgcttgtaaggaacgaaccacggaccntacaaacaatctatagggatttcanctttggccaacctggttttanatncanataactggtaanaan

SEQ ID NO: 95470 - DNA, 581 bp, Triticum aestivum
  unsure (1)..(581): unsure at all n locations
  Clone ID: PAT_TA_95470
ctctagtgcatttgttcaatgcttattacatgtcgctggtgcatttgttcaaaaatataacatgagatacctaaagcatggagattcaatctgatgtaccaaaagtaggccataatagtggtaggcccagaaaacttacttatactgcctttatactttatacggcatagtaataaactacagttgactattagatcgatagctttgtctaacggccttgtcatccaatttgcttgggtgttgcaatgtatggatatgctgcagtgttgagaaaagtcatcggctgacatcaccaaaagaaggagctcggatgggcgttggaacttccccggagtcactgtggaatcctgggagcactccgagcaatgtgtcantcctggccttttaccctgcaagcacatcaacacccctcctcnctnaggagctgcaaaatgagaaccaccatgcccagtncatatatantaatgtaattcttttgaacaaaagtacatacncataatgccctcctaggaaatctcacttacanggtcnacctttagnannctacacantncanccaaggtaanaatnctcccaaattt

SEQ ID NO: 95471 - DNA, 614 bp, Triticum aestivum
  unsure (1)..(614): unsure at all n locations
  Clone ID: PAT_TA_95471
atgagaatcccgtgataaggggacacgatctctacttcgacaaggcgtgcctattaaaccgcctcgcaagatgtgcagtagcaggttgagaaaaatggttcgaataatgaccgggccgcggcgtgatgtcacactatgaaaagttgtcagcaagattagacttgtgggaacattgtgctctctacggtgggcatgtgggaaattgttttgcaagagccggacacgatccttgtgttcaagaacttcctttgggagtattccngagaaagaacccccttngcaatgctgaaagcaatatgcacctgggatcatcctcattgaacctggttcaaagggtatttaaggatccaaagattaggggcctccggaaactggacatatcttatgccggcntttggctaatgaaaatcangtnnaaattcgnccctntccggtgggatcccttncctgnaggcaacttggattcaaatagtaattcctcncgtacaacttgtgtaacctacccctcggtgtcaaataaaccgaggntaancgtggaaacacatcatatcaagcnactcaggttacccaaanccnggaataacctgaaaccattncagttataacaganttgg

SEQ ID NO: 95472 - DNA, 543 bp, Triticum aestivum
  unsure (1)..(543): unsure at all n locations
  Clone ID: PAT_TA_95472
gctcccagctttttccccttccgtccgtcgccgccgccgctctagggtttcctcttcccgatccccgatccggatccagcagcagcagcgagcgagcgatggcggccgcgggagacgccggcgagaagaagatgatcacgctcaagagctcggacggcgaggagttcgaggtggaggaggcggtggccatggagtcgcagacgatnccgccacatgatcgaggacgactgcgccgacaacggcatccccgtccccaacgtcaactccaaagattctctccaaagtcatccaagtactgcaacaagcacttcaagccaacccgccgacggggccgcngccgccgccgggagctcngacccgccgccccgccgcccccgcggaggactcaagaacnggacccnattcntcaagncgacaagcaactcttnactcaacctggtgcaatactgaaanaagggtgctgactaacttcaaacgttccgacanattaaaggnaanacccggggaattcaagactcaanaanaanaattttttcccccccg

SEQ ID NO: 95473 - DNA, 313 bp, Triticum aestivum
  Clone ID: PAT_TA_95473
tccaagacgccgcactggtcctcgaaaggcatctcggagcactcggccttcaccttcttcctcgccaggaagccgatcctaacccagtcctcgacgaagttgctgatagacaccaaccaagcagctccggtcagaaacagatggaagaaaagtttattcaagattcaacccatttttttcctgatgtacaaactgtggtttggcgccgcctcctccgcagcgccgctcttcttcctctcctctcaatcccctcccaaggggggggccggtacccaaatcgccctatagtgagtccgttattaacgcgcgctca

SEQ ID NO: 95474 - DNA, 604 bp, Triticum aestivum
  unsure (1)..(604): unsure at all n locations
  Clone ID: PAT_TA_95474
acaacaatcttgcctatctattaaaaagaagtgaattagcgccagcagatttagtaatgtgccaggaaaaattggtacaagaagccgtggatacacttcttgatagtgggtcccgcgggcaaccgacgagggatggtcacaataaagtatacaaatcactttcaagatgtaatttgaaggtaaagagggaangttccgcgagaccctgcttggggaaacggnccgattacccngggcntctgtcatgttgtgggccttcgcttcaattacacaatgtggattactcctaagagataacaataaactttttcaacatttggtatccgcgattttanccaccaaacgcgcacttccnaagttnaggattgcctaaaaanggaatttttnggaaaaaganccatttttttgggaaatacttccaagaatttttgccgggaatcctgtacggttnaatananactacccgcataattaagcatacangctttcaaccactttantaaagggggtacaatcnttannccattangtgtagggttaaancggcnttgatggnataaangggtcaccaccttancctggaaccaggaaaaccnttattttt

SEQ ID NO: 95475 - DNA, 479 bp, Triticum aestivum
  unsure (1)..(479): unsure at all n locations
  Clone ID: PAT_TA_95475
cgcgctcgccgcagctccaggtctccaaggccatcgaccggtctgacctgttctttaatttttattgatcgccatggcatggaggaagaagaacggcggcgagtcgtcttcgcccggcgcctcaccgtgccgcgacgacgagcgggagaaggtccccagagggcacgtcccgatggtcaccggctgcggcgcgcgcgtggtgggtgccggtggaggctgctccgggaccccgtgcatccgcggagctgctttgacatggcggcgcagcaattacgggtacggccagcccgggccttctgcggttccatgcgaccccgaactttccgccggtccgtccaacggngcgctgcacaaagccgactaagngcccgggttcatttanacatgtgttgnatacatatgcagcaattccactggtnnaanatataatttggtatacaatccgttctttgattgatnattctttgttcatgaatcnc

SEQ ID NO: 95476 - DNA, 289 bp, Triticum aestivum
  Clone ID: PAT_TA_95476
ctgcccccagcatgggtccgtggcacgattggcaagccaatggcagcccatcctccatcattgggggccgctcgatggcgcacgtcttcatcctggacgcaggcgtaaaagggggaagagggaagccaggtggagtcctcaattgccaaggcctggccacctctcacccacgctcacatcatgagggaggcggagtcgcttcttcggtgggagtggttcaggcccctccctaggggccttccccttttcggccgccaaagaacctcctgatcggcaccatggaaaattg

SEQ ID NO: 95477 - DNA, 329 bp, Triticum aestivum
  unsure (1)..(329): unsure at all n locations
  Clone ID: PAT_TA_95477
gtcggtgccagcaaggtcgggaatagtagtattggacggtttctgtgttttgaggtgtgcttgccaggtgtcaacacgctagaggaacggacaacgaaggaatgagggtgtaggccacacctacgtgagattgaggttaaggccccaccccatatggtccggccgtgcccattttagataaacggatacaaatccgcggcacaacgcgcaaggagcaaacagacaaacgtctacttttggtcctgctttcaacaaatcccactcaaattnnggccgattttgcgtcaaaaatagacaacgcgccggacggcagcctccttggnctcccc

SEQ ID NO: 95478 - DNA, 630 bp, Triticum aestivum
  unsure (1)..(630): unsure at all n locations
  Clone ID: PAT_TA_95478
tggaaagccagcacggtttgggtgaaagtcacatttcgcatacacgcatagtctccatctacacattatttcagtaaggggcgctctattgatacatacatcaacgcgctataaaatgggtctgatctctgcaacaaacacgacgtcaagtggacgatgagatacatatatggtgcacacaatgtcacaaccaaccctataaacatccgtggcaaacatgtttccggcttccgttttcacattccngaccttccatggagcttaaatttaccacgcgactattttatccatccgaanattcccgtggaattaatngtgctacttccnatatatatgcacggngctaanaggcaaactactaaactgggnctaatcctaagataaatggcgtactaancaacaattttttacatttaaaccaaangtccttaanattgtttcccggaaggcgtattggcctngttgtttaaaagnggacnggcgatcnttcccttaattggtgggcatggacatccaanctacgttaaggagctaacncaagttgggtactgcagcattgcacatacataagtggctgcggatcggaaactatgtgcctcaattgctctgccccgtnanaaccgggtgatt

SEQ ID NO: 95479 - DNA, 478 bp, Triticum aestivum
  unsure (1)..(478): unsure at all n locations
  Clone ID: PAT_TA_95479
gctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaangcgagtccggcggatggaatggcggcgggagaacggcgctgcgctgcaccaattcaantccggaacaacttgcggtggncctgctgcaactgcaaattnatttatcgacaatatcatgaaccnngcctttcgtgaacaatcantnaaaancantttaacnacnacaatncaatnttaacccaaccnatttaaggctttaacnatgaacctaactgcatcaacatcaagtgcatgcaatattttnaaaggcccccctaaanaatttcccccngattaantttannaaaaaaa

SEQ ID NO: 95480 - DNA, 589 bp, Triticum aestivum
  unsure (1)..(589): unsure at all n locations
  Clone ID: PAT_TA_95480
cgaggacggcccacctcccggcccctgcggcgatgtaggcaagcctattgatgtcacatatcacagcggccaataagtcgttagtggtggggttgggtgcaaagaccatcttggagacgaagcgcctatcgtagatttancgggggcangaggatttcaaccggcaatacaaaagaggttgagcaaactatgaccgtcctcctaatgcaaacaaagaaggnaagcatcccncccaatntacaaaacaagtgccaaacacaaggganttntgtgnactttatgnnttaggnccaaggtacattngtacnacctttatttcgagnggggcaaccttnccggggtcctccctnttggccaatacaacgacnaaatggtgnattacncnaaccctntcaggaattnccccccaaccccttcattttagggtnaatccttngggatcggaaaaaacccggngaagttgccaacccnggnaaaaaaatggggggnaaaatttgcaagttnggaantntaatnaaaaanangggtttcccnnaagggaaaatataataacaaaanttattccntgccagangaaacntttaactta

SEQ ID NO: 95481 - DNA, 473 bp, Triticum aestivum
  unsure (1)..(473): unsure at all n locations
  Clone ID: PAT_TA_95481
cggcggcggccaaggagggcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaaagctcgccggcgaggccgctaagctggcgaggtacaacaagaacccaccatcactcccgggagattcaaactccgtccgctcctcctcccccggcgantcgccaagcacgccgtctcccgaaggaccaagtgtcacaanttaactcctccctgatctccttattactgnttgggtgtgttttttgccttnttaccgtgttaaaacccatcctatttttcnggttntcccaaaaatatnacggngcctgcctcaanttcaatacatctccctgttatttgttcnggctcattcttnatccccaatcaa

SEQ ID NO: 95482 - DNA, 430 bp, Triticum aestivum
  unsure (1)..(430): unsure at all n locations
  Clone ID: PAT_TA_95482
cgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctccggcccgctctccggcgacccccgagtacctcaccggtgattcccccggcgactacgggtgggacacgccggcttttncgggcgaccccganactttcgccaagaaacggganctgaggtgattcaacnccggttggcatgctgggcgtctccgtgcgtcttccccnacttgtcccccnaacgntnaattttggnaagcttttgttnaangccgncccaantttnaaacaagggggcttnaatacttnggaaccaactctttaaac

SEQ ID NO: 95483 - DNA, 335 bp, Triticum aestivum
  unsure (1)..(335): unsure at all n locations
  Clone ID: PAT_TA_95483
gatttctattccaccatcaccagggccaggtttgaggagctcaacatggacctcttcaggaagtgcatggagccagtggagaagtgcctgagggatgccaagatggacaagagcactatccatgatgttgtgcttgttgggtggttccaccanaatccccaagagttcagcagctgctgcagacttcttcaaccgggaaggactctgcaannagnatcaaccctgaatgaagctnttgccnacggtgctgccgtcnaaggctgnaacctcaancngttgaggnggaacganaangtgcaagacctctccncctgggattccccacaagtgtctct

SEQ ID NO: 95484 - DNA, 475 bp, Triticum aestivum
  unsure (1)..(475): unsure at all n locations
  Clone ID: PAT_TA_95484
aaaaaccaatcgggagcccattccagcactccgtcggagggggaaatcatcaccggtggccatcttcatcatcccggcagccaccatgatgaggagggagtagtccaccctcagggccgagggtttgtaccagtagctatgtgtttaatctctctctgtctctctctctctctctcgtgttcttgagatggcacaatcttgatgtatcacgggctttgttaatatagttggatcatttggtgtttccccctctctatcttgttgtgaattgagttttgcctttgagatttctttttatcggattgaatacttttatggatttgagagcagttgatgtatgtcttgctatgaatacccgtggtgacaatgggtatcatantgattcacttgatatgtgttttggnactcatctcncggatttgcgaggtgacattgggtaaacctancacaagggttgatgcacgntctctntttt

SEQ ID NO: 95485 - DNA, 423 bp, Triticum aestivum
  unsure (1)..(423): unsure at all n locations
  Clone ID: PAT_TA_95485
tggcggcactccgcctctttctccggcgcatggcggcactccgcctccttctccgcctgcgccggcgctcccgagcagccagcagcatcctccttctccgcctcgccagcaagggcggaagagacccgccgccgccccagctgctccggcacgtcgtactccttctcctccgcctcgtaagcaagcacgaaagaagatagacgtcgcagccgctccgtctgctccggcgtctagcagcacaaccagaggcgggaggcaataagaatacggtccatcatctctcaagcctctagagaaattaccgtacgagangtccaaggagaaaaacgatacattgtccgaggtgaaagcaaagagacatcaactccgggnggaaaagtattncgggngaaancaangccaatatngatccctgnggaaaca

SEQ ID NO: 95486 - DNA, 395 bp, Triticum aestivum
  unsure (1)..(395): unsure at all n locations
  Clone ID: PAT_TA_95486
ctcgacatccatctcgccgccacctcctgctccgccccgccgtgcgccgcccgccgccaccgtgcatgcgccgccgtccttcctatcgactccgctgtccgaatcccgccgccgccccgcctgcgtccctccccaaactttgcatcatcctccgcgatctagntagaatcaagcatcccacgcccaccccgccccatggggggctgccacgccaagccgcncacccgccacgctgacggngcctcccgccgccgcacgcgtcggcnacgccgactccaccctcntccacnncgaccgccacgttngncttcaaagaaagactgaacgacgtccccttcttccctctcnaagctcagnccaaaccggcgaacacttctntcntatctnngggctcc

SEQ ID NO: 95487 - DNA, 499 bp, Triticum aestivum
  unsure (1)..(499): unsure at all n locations
  Clone ID: PAT_TA_95487
gacgaagtcttctatcttgtatcttcatggcccaatagtccggcatacgcgtatagtccggctattcgaggaccccttaatccaggactcccttagtagcccctgaaccaggcttcaatgacgatcagtttggcttacagattgtcttcagcattgcaaggtgggttccttctccgaataatccaaactagatctcaaacaaaataatccgtgtccggctctacaaaaaaaatccacataccactgtagagagtataatatcccacgagccaattgctgacaaccatagtgtgacatcacgccatgaccagtctttattccaactggttttggtcctgcccttcctatttccagcgttggtttcctgggacgtctaaccgaacaaaatngtgcccctttatcatngattctcatccaatgcngganggggtacctaaccgtgcatcaanacanactttgggaaacagcgagttttaggcgacggggaagccatgatttt

SEQ ID NO: 95488 - DNA, 321 bp, Triticum aestivum
  unsure (1)..(321): unsure at all n locations
  Clone ID: PAT_TA_95488
ggggttggcttctcctccccttccggttcgggttctggttcggttcgggttcggttcgagaganaggccgagtagctagcctagtctagggtttcggtanagaggaagtgagatccatggcggagacggagtaccgctgcttcgtgggcggcctcgcctgggccaccgacganaacaacctccancaggccttcagccagtacggcganatcctcgacgccaacgatcatcaacnaccgcnganatcgggangtcccntgngttcngcttcntnacgttcngnatccnacggagtcnatnacgncaacgccanccnaacga

SEQ ID NO: 95489 - DNA, 477 bp, Triticum aestivum
  unsure (1)..(477): unsure at all n locations
  Clone ID: PAT_TA_95489
ctctcgccttttgcagtacgtacaagctcagctgccatcacattgctcactccaggagatatccctgcagttatgagagctgggacgccggaagcttttgcttgttcatggaaagattttgccctccatgaatagtccactccatcgcagatatcagtgtaccttgtcttggtaaatgttgctgcctgcaggactgtgcatttgtcatccctctgggaatggccaagcggcatgaaccaccaaatccacaccctccaacacctctttcagcctgcttgaattgcgaatatcaacgtggatgaactcagtngctgtccaagctttagataccagcggatacttctcccggtcccttccgccgatgagatgttgaaggtccggccgggactgggagacgggtggcgttnaccgccgacacggcatcccgccgacacgacagcgggcccgaagacccggagcggagcgcatcatcctaca

SEQ ID NO: 95490 - DNA, 433 bp, Triticum aestivum
  unsure (1)..(433): unsure at all n locations
  Clone ID: PAT_TA_95490
gtaggggtgcgccaaaatcttctttccgcggatctgtgtcccatcgcttcgtcgcatccatggcagacgctcgacgagcccgcgccgagcgtcgggctgctcttgccgcccgcaatgcccagacggcttccatcggcgggcctcctcgtcattctccgttgcctaccgccaacgacgccacccgcccggcggggaacgagcagcaagcatcttcgctgcacccctcggtgcggcgggaactccgcaccgccactccgtcgctaaccccagctggttcgtcgtctcatgtcatcgcgcccccacggacgcacaagccgcgttgctcctggcacgttaagcttctgcactactcccgtcgacgatntctacaaggagtggtcgcttcatcatcaactcgtnagaacgcaagggggcctnangcgccgtccnctcg

SEQ ID NO: 95491 - DNA, 463 bp, Triticum aestivum
  unsure (1)..(463): unsure at all n locations
  Clone ID: PAT_TA_95491
ctcgattacttgcaactacattgtcatccatctaaccattgatatacgcaagaagagctatcactatgaataagagcggaactatgtagtacatgagttcgtatccctctctcgcgttagcatgaatctaaactaactactggctgtccctcggaaaccgaaaaccggtacacctggggcctgacactccggccactcgtcgtatactcccgacgttgcacttcttcgtcatcgatgatctatgcacctgcatcatcacattagtcgatgatatataacatacatagttgagcaacagaaagagacagacctggccaaaatagaagcaacatattataagcataactaacanagttcatcgtacccaaaatgccctaacanagtgatcttcgctagttgangaaggacgtttaattacatcacaaataaagnttcgntgtggatanctcaaagttcgtcattn

SEQ ID NO: 95492 - DNA, 502 bp, Triticum aestivum
  unsure (1)..(502): unsure at all n locations
  Clone ID: PAT_TA_95492
cacacatgtgtgttatgcctccatatatatacatatatatatatatatatatgtaatgttttccagatttttttgaattgtaaaaatatgaattttcatgaattttgtgtttttcaaaaaccggcctccatggaggccgagctccaaaaggcatttttgaagtttgagtgactttatctccttcctcgcactcccaaaagtgtcattgttccatttttttgagaaacaaaaaaagatgaaacaatgacattttgttccatcttggagagatatgtgatgtaaatgcccctggtcctatacaatcctantattaaaatggagtcggccatggagccggcacattggttgcccgctccccgtattggtaccattgggcaacaagtcctggttccggccaaagcgagacagccattccatcccggatatttcattggagcatttaatggaagggggacccncgtnggaagaataaaacattatgtggngacanttgacacatgtc

SEQ ID NO: 95493 - DNA, 442 bp, Triticum aestivum
  unsure (1)..(442): unsure at all n locations
  Clone ID: PAT_TA_95493
caggcccgtggaggctggttgaactgaagtcggtggatgctggattaacagtgtgtggtggaggctggagatggtggatgaacagtagcaggtggaggctagaggaagtcgatggtggatgaacagtagtccgtggagtcctgttttgcggtacgccacaccctctcaatgaacaggacccccatttcgaccgtaggaggtcgaggagaagtctgtttcctccgttttgcggtacgccacacccctcctgatcaacangaccctatttcgaccgtaggagctcaaacagaanttcgtttccatagttngcggtacgccaaancttccaatgaacataacccgtttcgacatacgcggtcaaaatanggccatttcntccnntctgtggnanacataccttgntcgnngttcatccaagccnttggctctcatnaaagnacac

SEQ ID NO: 95494 - DNA, 512 bp, Triticum aestivum
  unsure (1)..(512): unsure at all n locations
  Clone ID: PAT_TA_95494
atttctccatcgttctcttgtatgtcgctcacacacaccctctctccctagagatatcttgcgttccctcgtatgtctctctagctatcactctcgttgtgaaatatctttatctctcacagacacaaaactccgtctctgtggatctcatttctctctgatatctgtttgtatgtgactcacacgcaccctcctctatctctctcacacccacacacataacctagcttctgatccactccgactcctatctctaacgcacactaagctagcatctttatctttctatttatctgtttctccatcaacttctttctcgcctcatccttggattcctaccacgcacactacatagtttctctcctaacatgcaatcaaagtgcctctcaaacacatatatacttcaacctttggacaactnaaggcatctccaacaccaaactacggagtccctctaagctacatctccaccttgggaccancngtattcctcgtcaaattcttcncgcnng

SEQ ID NO: 95495 - DNA, 456 bp, Triticum aestivum
  unsure (1)..(456): unsure at all n locations
  Clone ID: PAT_TA_95495
ctacgatggaattactcacgcacggcggtgagcatcatgaaattggtgatggaggatggttgatgatgacgactgcgatgaatccccctctctggagcccgaagagactccagatcagccctcacgagaggttttagggcttgccggcggctccgtatcgtaaaacgcgatgatttcttctctctgttttttatctccgaaagcaaatatatagttggagttggcgtcggagggcatccagggggccaagagggnggggncgccccctagggggngcngnccccccacctcgtgagaatggtgtggcccccctggtcttcactttggcaagattttttataattttccaagatgttccacggatttcaagtcattcccgagaaatttgtttctgcacatanaacaacacaatggaattctgctgaaaaancgtcatccgggtnattcatcnaacat

SEQ ID NO: 95496 - DNA, 463 bp, Triticum aestivum
  unsure (1)..(463): unsure at all n locations
  Clone ID: PAT_TA_95496
ctgctgcgcgcagcgcaacgcagacgccccaaaaccccaatccggcctcacctggtcggcgatggccgcgatgaccgccatccgccgcgccgccgtcgcctgccgtgtctcgcgtcgcctcctctcccactcgcgcgcctctcccaccctcctcggccacttctaccaccccatgtgcccgcaggacccgcaggccttccagctgccgcctgccgccgcgccggctttccagcccctcaccgcctcctccccgcgcctctctctcgacttcctccccgacatctttgactacaccctctacgactcccaccgcggcctgctgctcctccgccggaaagccccagttcgacacccgcggcttctcgtctgcgaaccccgtctcangccgcnagcgccgcttcccngccgcanatctccttcggaacggcggcgangtgttggnccgcgctcctcngcccccgcn

SEQ ID NO: 95497 - DNA, 497 bp, Triticum aestivum
  unsure (1)..(497): unsure at all n locations
  Clone ID: PAT_TA_95497
tcgagttttttttttttttttttgaaatgatctgataccaaatcatttatattttcaaagtacagggttatataggaatggatgatgcatggatgttacatgtccaaacttaaattattttacagacaatggaaaccctactaattaagagagtcattgatcttgaatataacttaaggatggagtagatatgtgatactcttccaaattacagcagtggagagactagaccggccactgcgacaattgggactacgcacgacatgtttgctggacacccagctggatacttccctccaagagactttccctgccattgccgatgcctgctcaccgtcatgctgtaagtacctttccccaaccttgggagaaatcatgtccctgggtagaccccacgtgagaactngggaactccactcaatgtgtatatggattccgggccacattntcacattctgtcacgggaaggtttcctgagtggacgttatggagtagtt

SEQ ID NO: 95498 - DNA, 713 bp, Triticum aestivum
  unsure (1)..(713): unsure at all n locations
  Clone ID: PAT_TA_95498
ctcgtgccgaattcggcacgaggttccctctcttgccgccgcacccagaccctaactccactcctcttccctctcttccccgattcagatgcactcctcgcagccaccacccgttcctcctcgccttccagatcgcgccgccacccggcaactccaacctctcacccaccaccgtcgcccctcccctcaccttctccaccggcgacctcgcctccctccgccgccgcccacacccacttaacctctgcttcacctcaccgtctccccctaccctaggtcccagatncagcaggtcagccgggcggccatggcgctccccgattgaccacggatccaagaccacgtccgcctccttcctgctcgaccaagaccaagacaacgcacgccactgcttcctttctcgggcggggctgtccggtgggtggctttgacgccgctcttcttcgagccatggaaggaagcgaacgaacaagtcagctttaaagcgtacactctctctcatcgtctgtcttcttggcggctgaagggatggcgggcgctgagtcctgagngaatgtnanaggagtgtgcggacgnanacgactttaaacgaggtcagacaagtaactaagtcagggggccgtacaatngccanatantgataccnctangcnttttaagttanngaaactggtacattacctggaatccttcatgnatnaagccacgtcctt

SEQ ID NO: 95499 - DNA, 606 bp, Triticum aestivum
  unsure (1)..(606): unsure at all n locations
  Clone ID: PAT_TA_95499
ctccgggatccatccgtccacccaggccgtcgtcgacctagggttttgtgcagaccatggcgcggaagatgctcaaggacggggaggcgcccgccgtcgccgacgccgacggcggcgggggcgaggggagctacgactacgacctcttcgtcatcggcgccggcagcggcggcgtccgcggctcccgcaccgccgcgggattcggggccaaggttgcgatctgcganctcccgttccaccccatcagctccgagtggctgggaggacacggcggaacgtgcgtcatacgtggctgtgtcccgaagaagatctcgtcnacggggcatctttccggggggaatcgatgacccaagcaattcgggtgggagatnancggggacatcaactacaactgggaaaaattnctggaaaacaagatcangaaattgtgagattaacggntgtncnatanaaccttggngtttgggtnacatgtnnaagggcaggaattnattgagccanacgttngannaccaacaaatgttaacaatgnacacacaagcaatntatgaanngtacgggnaatcggcanatcggaaggntggntctcaanagnttattgggaca

SEQ ID NO: 95500 - DNA, 700 bp, Triticum aestivum
  unsure (1)..(700): unsure at all n locations
  Clone ID: PAT_TA_95500
aaggaatgttgagcacggttgatcacctcaaacgcctctgcattgaccactatttccaggatgaaatcgataacataatggagtcgtctgtggatcttctccatagtgatgatctacttgacgcaaccctttccttaaggctgatgagagaagttggatattatatttcggcagacgatgttcttcagaagttcacaaacgataatggtgatttcaaccttaggcatagcaaagaccttagagggttgctgagcttgcatgacatgtcacacctcaacatgggagaacttcactctacaaggcaaaggaatctcaaagcaagcacctgaaatttcacttaagtatttgggacctaaccttgccgagatatgtgatgaatcactagaccatccctaccatgtgagcctgaacaatacaaggctagcatcattgattacctcaagaacttgcctaccatgcacacgcaattggagaactggcactgtagaatcagatgaagaattgcaacacaaatgaaatgaggagtaagaatgtggtggattggantgcncaagaaatcactnaaggacaattcgaatggaaagtgtcatgcancccaggttccctccaggacgttagcaaagtannatgcaatgtgtaanttatttcaaagccnccctaagacaagtgttccgcggccgcnttagacagtagcctacaa

SEQ ID NO: 95501 - DNA, 666 bp, Triticum aestivum
  unsure (1)..(666): unsure at all n locations
  Clone ID: PAT_TA_95501
ctcgtgccgaattcggcacgagggcctatccagttcggtggcctcngcgttcacgatctcgagcgcactggccttgcccttcgcatgaggtggcaatggctcagccgagtcgatgatagcagggcctggaacggccttgacctgcaattcgcgcccgaggagcgcacgctcttcctcgcctccactaccatgactattggcaatggccaacgcgccctattctgggaggacagatggatcaacgggcgtgcactccgcgtgatcgcncctctcctttttgctcacatcnccaaacggngtcgcaatccagaaccgtaagcggacggcttcatgcaaaccaatgggcaacggacatccatggcgcgattggcgtcccggagatcgganaatactgcgcctctggcacatgctcaacganntgcctcactgacctccaagntgcattcgctggaagtggaccgcnanggcaatatccgccaatccgcatactcgccactttcagggtcaaaaatgcagcttgnaactactgaantgtggcacgctcggtgnctctcacngcttcaacccatngtctgacgcgacgctccanacaactgcgacaaaggtgcctcttcatagttcganatnaantcccngggccttcaccngtgaaaaattcaggggcct

SEQ ID NO: 95502 - DNA, 670 bp, Triticum aestivum
  unsure (1)..(670): unsure at all n locations
  Clone ID: PAT_TA_95502
ttttttttttttttttgcggtttccagccaaaatcatccgtattgatacgattattatggtgatccgggccatatgacgactctgctagagttggtctaacactacacataagagccgccgtcgcagaaatcctagaaccaggaaggcttattttgctcaactagtagaacatattttacagagcaagttcagcagacgaatgcgaggagcaggatctcaaagtgtttccgaaaatagggtcagttgccccctcctgggcctccgagcgtgagcacaacatggtgaaggtcactgccgctcctctccggctcggacttgacaactctggccgggaaccacgccgagcatggtgactgtagtcaggccgtacaaagcctgtggcctgcggnaacggtcgggcgtgctggtgctggggangaatcnccgactattganaactgatgctgcattaaggtcttggggctttacccagtccangngcgaacaaaaccctcgaaaactgccacngagacgntgtacanatacccganncnaagctcataacgtccananctactcaaaagagngnccgatgcttgcgcgctagncacnttagaannattcttttgcgcganatcngaaaatgcntntganccgcggctcaaaatgntaanacangtttggaaaaac

SEQ ID NO: 95503 - DNA, 636 bp, Triticum aestivum
  unsure (1)..(636): unsure at all n locations
  Clone ID: PAT_TA_95503
cgatgaatgatttgtgataggatggcaacctcgttgataaactggtcaatctcaacttgctccaccaacttagatttttttatggccactacacgttgatcggatagaatccctttgtaaactgtgccatgtcctccacgaccaagaatacgactgacatcaaagttgttcgttgctttatctaattcctccaaggagaatatctttgttttatctgtggcactttcgtctaatattagttgttccaagagtagcccttgatttttcttgaagtatgctcttcgtattctcttcngtatgcctctcttccacttgctgacgaatgccattatacctagtgcaagtattatcgcaccaaggccacaaccaattccaattccaatacctaagagaagacgctcnctttgctgatgtgacaatcnccgttcaattggtnaaaccttttccatgagtgcaggttccaactataccccaggataattggatgtgcattgcaatatcacaaaaacaccgttgaatctgtattggaggattacatgatgngcaaaaaatngtagnaattgaacanctngtccctancacattnncaaaaattganntnccaaaanatggccccaangtgaggcatntgttcag

SEQ ID NO: 95504 - DNA, 342 bp, Triticum aestivum
  unsure (1)..(342): unsure at all n locations
  Clone ID: PAT_TA_95504
ggatacaagctgctcacatccaggacaaattgtgaacaataatggaggtccaggtttggagaggattgacagttgtcatggggtttctaactccgcccatcctatcgttataggctctgctctaaatactttggttgattctacaccatcattaaaaactgatgggtctaaggcggagagtgagattcgaaaaaatggagagagcgtcaataagatgacagacaaggaacgcgaagatctatccttcgagaactcgtcttatagaggtgatctcaagagacttgtgaacgatctccatgtaatatatctttanaaaggaggagaaagggcattgggattttt

SEQ ID NO: 95505 - DNA, 560 bp, Triticum aestivum
  unsure (1)..(560): unsure at all n locations
  Clone ID: PAT_TA_95505
aattaacgcaagacatgccatacttacacaattgcaagaggcaattacaattacactgcgcgccatggtaaatactggaatccgtaaatactagcaaggagtatccaatgcgcgcatgcagctctggcatcgatcactcggagcttggaggcccaggagggaagccagctgaccaccaatgcccccccgtgaaccttgcccttcctccgccgaactcccggcaccctgnccacncccgccccgccttgctgccacgcagntcccaccccggaacatgccaagccggcacatcgtgcccgccggtgccccatccggcggtagtatacgcanccanccgcggggccccaccggcgcacaaccctccggcggaaaccnaaggtnnctccggtcctccttgntctcgcgcggaattcnacnagaatcgaaactggtgcccnatggacgcactgttcgctcatgtcgggctgtcctcgggtgnacaagacgatgtaactcagataaaactccagcttgcaaaacaggcgctcncgaattatcnagtcncncgcttagatttctaa

SEQ ID NO: 95506 - DNA, 563 bp, Triticum aestivum
  unsure (1)..(563): unsure at all n locations
  Clone ID: PAT_TA_95506
gttttgggattttagcctccagcgccgccgccgccgccccccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaacccagcgccgattcccgaacgctgcccgctgggtatgacaccgtcgccgcggctgttgcttcaaggtccctggccatcctctggggtgagtgcacatcggtcctgctgcactgtcctgccgcttccaaggatgaagacgacgatgatgacatggtctgtttggcgatgaagaccgaggaggacaagaaactgcaactgagcgtgaggtgccaacctgcaaagaagaaaaaatggaaaccctgtctcatggatanaaaccatgggacatgagatgacataagaattgagagntgtcgantgttaaatggagggtcnactgggtcatcaanctagcctggtatgataaaa

SEQ ID NO: 95507 - DNA, 381 bp, Triticum aestivum
  unsure (1)..(381): unsure at all n locations
  Clone ID: PAT_TA_95507
gttggcttctcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggngacgtcatcgactccaagatcatcactganaggganacgggccgttcccgcgggttcgggttcgtcaccttcgcgtcggacgaggcgatgcgccaggcgatcgangccatgaacggccaggacctggacggacgcaacatcancgtcaacgaggaccantcccgccgctccggcggaggcnganggcngttcngaggagg

SEQ ID NO: 95508 - DNA, 572 bp, Triticum aestivum
  unsure (1)..(572): unsure at all n locations
  Clone ID: PAT_TA_95508
gcagatttttgtgaagaccctcaccggcaagaccatcacccttgaggtcgagtcctcggacaccatcgacaacgtcaaggctaagatccaggacaaggagggcatccctccggaccagcagcgtctcatctttgctggcaagcagcttgaggatggccgcaccctcgctgactacaacatccagaaggagtccaccctccacctgggtgctcaggctccgtggtggcatgcagatttttggtgaagaccctcactgggcaagaccatcaccctgngaggtttgatcctccggacaccattggacaacgtgaaggcgaagatccaaggacaaggagggatccccccgggacagcagcgtctcatcttccgctgggtaagcacttngaggatggccncaccctggcggactataacaccaagaagganccaccttcacctgggtgctcaagtcaaggggtgggatgcanattttgtggaagacctcacggcaagacatcaccttgaggtcgaatctcggacacatcgacaacgtcaaggtaagtcaagacaaggaggnatcctcggacaacagg

SEQ ID NO: 95509 - DNA, 372 bp, Triticum aestivum
  unsure (1)..(372): unsure at all n locations
  Clone ID: PAT_TA_95509
caacaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaaagtgccccaaagggctgctcggcgtgccgcgtgggtgtcnacnanccccgaaatgtgggcgctgcgcggatatgaatccaccgtcnaagggacctgngggngggcctgnaaaaaatactgatnggtcangcaaanatgattgtcc

SEQ ID NO: 95510 - DNA, 206 bp, Triticum aestivum
  unsure (1)..(206): unsure at all n locations
  Clone ID: PAT_TA_95510
ctcgtgccgaattcggcacgagctcgtcgccccatcccatcctccctccccccgaccgattttgacgactcctttgacctctcgcgctgtccctccccgccccgcctgcgtcgccgcgccgagctccaggngccccccctcnggtcggattcnatggccaaanagaaacctcncccgncggaataataanggaaaacaaaagnggt

SEQ ID NO: 95511 - DNA, 187 bp, Triticum aestivum
  unsure (1)..(187): unsure at all n locations
  Clone ID: PAT_TA_95511
ttttttttttttttttttttcacaacataacataattttatttcttctttgcatggatcaattttggatttcagttctgtgaaatgacaaattacaataagttgcccttcacgaaagcaaccattcctgatttcaganngcccacnancaccctcnacttgaaggggtcacatnacaatccagaaac

SEQ ID NO: 95512 - DNA, 184 bp, Triticum aestivum
  unsure (1)..(184): unsure at all n locations
  Clone ID: PAT_TA_95512
ttcaaatccaaaagttcagtaccttcctacaaattagtgaattaggaggggggctcttttgtgtanaaaaataaaaagnagggnaatctttnaaanttgcatcngaagngtgaaatatttatacaaagagggagagatgaagacaatgnancagggttggntanctaattggcnacncaaacat

SEQ ID NO: 95513 - DNA, 268 bp, Triticum aestivum
  unsure (1)..(268): unsure at all n locations
  Clone ID: PAT_TA_95513
ggctaaggtagcgctaggagaactactgcgattgtgccccggttctgctgggttcagcacctcagtagagaaagctaaaactgactgtcatgataaggcgagagactggtcgctgttcggcgaggttttcgagtccctaaagacttatgtcgcttagagcaaggagccggccctgtccggnttaaaggcgttttancgcncccaaanttcgggcttcccnaaanaaaggggttncnccaatttttaaaanttaaaanntccccgggga

SEQ ID NO: 95514 - DNA, 239 bp, Triticum aestivum
  Clone ID: PAT_TA_95514
ccgggccggatgcagcataaggaccttgatatgacagaagtgtttggaatgacgatacaccggaaggagaagctgcttcttgtgccaacaacacgagatgttagtcatgaataatctttgtcatagtctccatgtactttttttggcgaataatagtttccatgcacttgtaagggtatactttatcagagtacttaagagtgttattttatatacccataacatttaaaaaaaaaaaa

SEQ ID NO: 95515 - DNA, 325 bp, Triticum aestivum
  unsure (1)..(325): unsure at all n locations
  Clone ID: PAT_TA_95515
ctcgtgccgaattcggcacgaggaggatgccaagaatggcgcgggatcttatcagtccacacctgcactcgtcacctcccacttcctcctccacttgcactcgcgctacgtccgctcgttccgccgtctccggccacccgcgtgctccatgggcggctacacgccggagggcggcggcggccgtgccgcccgccccggacggtaccctcccctcgcctccctcgtcgtctccaccatcgncgccttctccgccggtcaatcgtcatcgccgtcctcnactcggttngtcgtcnccgccgttgattccttgcatttgatcanccac

SEQ ID NO: 95516 - DNA, 223 bp, Triticum aestivum
  unsure (1)..(223): unsure at all n locations
  Clone ID: PAT_TA_95516
tccggcggcagcctcaggctccgtttcccancgactctcatcgncgggatcncttcgacgccggcnangcanaggtcccaccccttgntcaactcccccaagcccancatgatggtcagcggcctcccncggcngtanctgctgtcnaacacngtgcngtcctcnagnatcccccggtagtgcgccntgatgagctgncctttgacgntctcggagcnggtgc

SEQ ID NO: 95517 - DNA, 388 bp, Triticum aestivum
  unsure (1)..(388): unsure at all n locations
  Clone ID: PAT_TA_95517
ctcgtgccgtttttttttttttaagctaatcataatgaatgagcccgggagaggacaaatggagccatcaacatcaaattaacaactcatctgacagcaaattatttaaccagggagacatctagctctacattcatagccaggctgccaaactccaagaaaacatgtgatgttgtttagtggatttactgnttctcacttggagatagaatatacagaggtaatttaaccacggttggataatttataaccaaatgacanctattgngcacacaagccctaccaagaaatttcttacagattgaaatgaangaaatgtagctgtacangcaagcacatangctgtccaaaacccnacttgnttcttcntcangntcattatgcatct

SEQ ID NO: 95518 - DNA, 492 bp, Triticum aestivum
  unsure (1)..(492): unsure at all n locations
  Clone ID: PAT_TA_95518
tctagatcgatctgctatgctgaatttgcaacaatggcatcgccggcgtgcttggcatgaagctccacgccccggagctcgcgaagatgctgcaggatctcctggagaaggtgcatgcccttgtcccctttcttgagggacttgatgcagtgcctcaggaactccttgtccgcctccagtgcttgcagcctctcgtacacatgatccacctcctcgattatcgccagcctctcctgctctttgggcgaacacggcgacggccggtttcgtcgaaccatcggtggctgctgggtggtgcacggtcgacgttctcgtcaccgaccgcgtcaaagagaggtaggaggctctttcctcctggaaacagaagctctgccttcaaacctgggccttgttgccggcgaggcattctccggcgaatggggaccgtgatcgtctgaggaaaggcaacagccgcattgctgccgttgatatcgtcgtcttcancgtgaagag

SEQ ID NO: 95519 - DNA, 524 bp, Triticum aestivum
  unsure (1)..(524): unsure at all n locations
  Clone ID: PAT_TA_95519
accacttgcgcatgctcaagaaggcgagtctgtctggtttgtgggcttgtcgcaatgtcctcctactcgtccctcctctccgtgagccccggngagcagatcggtgggtatgcggacggaggtgaccacgacgacatggcggccgccgccaactacctatcatcattctgctttgatttcggcgaggagtattattccctggcggaggcagcaacagcctcctaccccttgcacgcacagcagcagcagaagccgcaaaccnanggccganagccaccacaggggnaangcagcantactactagtagtcacanggactcngacaatatcaacacgagcttgaccagcaagcgacgcgaggagcaaaggnacanatcgcntanaaaacgaggcngnaggtggaggtgtgggacnacgggtacgctgggaggaagtanggcaagatatggcaaagacaaccaaacccaaggaatactaccgttctcaangagggtgcccgnnaaaaanggtggacgnatccnata

SEQ ID NO: 95520 - DNA, 243 bp, Triticum aestivum
  Clone ID: PAT_TA_95520
atcgcttcttccgccgctccgcttcccttccacgcgcaccaaccgcctcctgctcttcgattcccccgaggccccagcagcagcccaacccagccccttcttctgcttcttgttgttgtttttggtgcggtgcgtgagcatggccatcgaccacgagtcgcccttcaaggagctccgcctcaaagaacaggaggatcatgggaggcggcgccctggagccggacgaagaggaggcggagcgag

SEQ ID NO: 95521 - DNA, 544 bp, Triticum aestivum
  unsure (1)..(544): unsure at all n locations
  Clone ID: PAT_TA_95521
ctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctgggtgcatgcgcagagcatccttgccatctgggcctgccaggtggtgctgatgggcgccgttggagggctaccgcgtggccggcggccgctgggcgagatcgtggacccgctctacccggnggcagcttcgacccctgggcctcgccgaggacccgaggcttcgcggagtcaaggtgaaggagataagaacggccgctcgcatgttctcatgttcggctcttcgcaangcaatcgtaacggnaagggccctcnaggggggccggtaccaatt

SEQ ID NO: 95522 - DNA, 538 bp, Triticum aestivum
  unsure (1)..(538): unsure at all n locations
  Clone ID: PAT_TA_95522
gtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttggaaggggatgacctagatgctttcaagaagaatgttgagtccgccacaaagtatcttcttagcaagctcaaggacttcaagttctttggtgggcgagagcatgcatgatgatggcggcgtggtgttcgcctactacaaggagggagctgctgatccaactttcctgtactttgcacatgggctgaaagaggcaagtgctaacgcactgtatgctaaatccaagctgcctcatatttgccctaaccatggttgcaatcgacctcaatgtnggg

SEQ ID NO: 95523 - DNA, 489 bp, Triticum aestivum
  unsure (1)..(489): unsure at all n locations
  Clone ID: PAT_TA_95523
cagaagccccgacgctcaagcccccagacgccgcagcgccgccactccacccgcagcggcaaccatggcggtcggcaagaacaagcgcatctcaaagggaaaggaagggtagcaaaaagaaggccgtcgatccgttcaccaagaagcagtggtatgacatcaaggcgccgctgctgttcaccagccgcaacgtcggcaagaccctcgtgtccaggacacagggtaccaagattgcctcaagagggtctgaagcacagggtgttcgaagtatctctagctgatcttcagaacgatgaggaccaggcctacaggaagatcagactccgtgctgaggatgtgcaagggatgaatgtcctcacaaacttctggggcatggacttcaccactgacaagctcaagtctcttgtgaaggaagtggaagacactcaattgaggtcatgtggatgtnaanacaatgacaactacatgtccgcatgttcacattggttc

SEQ ID NO: 95524 - DNA, 381 bp, Triticum aestivum
  unsure (1)..(381): unsure at all n locations
  Clone ID: PAT_TA_95524
gagaaagaaagtctcgttgaagagaggcagaggaagctcccacccacccagagggggctaagaggcagcatggagtgtgcaggggaagatgatggcacagggagtggaagcaggaggaggagcaggagcatgagcatgggcggatcagatgcaacgtcgaccatgagcgacggcggcacgacggcggtcaagcagcaccaggctctggaggctccgtggaggactctccctcccttcgggtgcaggtggtggtgatgagcgccaacatgggctgctcccactgcccgacagcggncaccaaggcgtcaccaagatgaacggntgctggntacatggtggtttccggnaagaaaggaggtgacggtgaggggcacggtatca

SEQ ID NO: 95525 - DNA, 533 bp, Triticum aestivum
  unsure (1)..(533): unsure at all n locations
  Clone ID: PAT_TA_95525
cctagccgaagcagcgccacggatccgagcgcgcccagcgccgccgccactgcggctgccgggatggagccggaggtcgacagcaccaaagccgccgccggcaaccgcaagcacctggccatgctcgagcgcctctccaagcgcaccgccgcctcctccgcggcctcccccgaggcgtcccccgtcgccgccttcctctctcgcttcgccgcagccaaggccgccgcggagtccgccctctccgcctgccgctcctcccccgacggcgccgccgcctccctcgccgcggcctcctccgccgtcgacgacctcgagcgcctcgtcgcggaggctcccactccctcccgccgtacgagtccgctccgcgctcgccgccgtctccgactccgtgccgcccacaagctcgccgcctccgagattcggccaagaagcantctccttcaggaacaaganaaagcacaagacccccgcaagatctccggcctgccaancgctcggagaacaaagctaacccgatggatctgcaaggttgg

SEQ ID NO: 95526 - DNA, 485 bp, Triticum aestivum
  unsure (1)..(485): unsure at all n locations
  Clone ID: PAT_TA_95526
aagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggcccgagaacggcggctgcggctgcacccaagtgcaagtgcggcaccagctgcggctgctccctgctgcagtgctagttccatcatcgatcatgcatgcaccgtgccgtgcgtgcacatcgatcgtatcgttctactactaccataccatgtaaccgcacctgatcnagggctttatgttacgcacctgacctgcatcagnatcaaggtgcatgccatgattgtaaaaagcccccctaaataaaactcccttgattaactaaaa

SEQ ID NO: 95527 - DNA, 523 bp, Triticum aestivum
  unsure (1)..(523): unsure at all n locations
  Clone ID: PAT_TA_95527
ctcgtgccgaattcggcacgaggtctggtccactgtgtgtgagcttctcccatcttctgatcgtgtgtgcgtgtgtgtgttagagagcctgggtggttgcacgtacgaggtacgtgcgtgtcggtcgggcggtcgatcatggcgatggcgcaggggcagggggcggcaacgtcgctgccgccggggttccggttccaccccgacggacgaggagtcatcctgcactacctccgcaaccgcgccgccgccgcgccgtgccccgtccccatcatcgccgacgtcgacatctacaattccgntccatgggactcccttccnaaggcggtgtacggcgactgcgatgggattctnnaacccggcgggaccgcaanaccnaaacggaaccgccccaacggcgccgccggtccgggtattggaaggcaccgggaccgacaacccaccacnanccgcaacgggcangctcgggtaaaaagngtcgtcttctaaaggccccgccaagggacaaaacgctgntatcacaatc

SEQ ID NO: 95528 - DNA, 268 bp, Triticum aestivum
  Clone ID: PAT_TA_95528
ccagcagcctcctcccatggcgaccatcacctgccacctcccccctctcctccctggcccagcctccgggcaccatcgccacctcaagccctccccgccccccttcaatcggcacctccgcgccccgcctccgacccgtctcctccgcgccgcccgccgccgccatcccgacgccgtccgtcgtccgtcccagacgcgcgccctgggtccggcgacctgtcaaggagcgcctcctatgaaacgggaaagggaggaagatggaagagag

SEQ ID NO: 95529 - DNA, 574 bp, Triticum aestivum
  unsure (1)..(574): unsure at all n locations
  Clone ID: PAT_TA_95529
gtcaccttctccaagcgccgccggggcctcttcaagaaggccgaggagctctccgtcctctgcgacgccgacgtcgcgctcatcgtcttctcctccaccggcaagctttcccagttcgccagctccaggtgcatacgtccctcctccgcgccgctcgctcgcctcggttcctcccctcccgtcccttctcgtctcgtcttctcgcgacggcatgtagatctgcccgcctctcttcccctcccgcctttccgggcgcaggatccggctcgtctagggttcatgctgcgccttctcgcgggtcccgtgtcagtttcgcgtgctcttccgcgtctcgcgcgcccggcggggatcatgcgacgtgctggcggggcggatcgcgttgcttggcaccgcccgcagcggattttctggttacgttcccggatgtcgtctttcttgccgaaatggggatttaantattctgttactgtagtatcaactctggtgctggttgacatttctgttgattccttttctttccgatcancgggtgttacancatggcgctcgcaatgtgcgggtctgttaaattgcg

SEQ ID NO: 95530 - DNA, 576 bp, Triticum aestivum
  unsure (1)..(576): unsure at all n locations
  Clone ID: PAT_TA_95530
tttttttttttttttttttgatacatgacgttttgttttagttatggatgtgaagatgcgaaaacatgtcgtttggttgctcccggcctaatattgtggacactcattctcaatagtggtgatattaccacacattacatgtcatagacggtgtcagataaacatcatccaatacgaaaataacatcgtttcactcactactaaacaaatggttctttgtcctggctactaacaaatggcaatacaaatgaacggtcatatggctgcaggggggagattcatcaatggcgatgaatggggaagttcaccgtgttatttttcttcttcctcttctggttcttcttttgagccttgtgttgctttgttagcccacattgcctcagctcactctaacctttgngtctttcaagtttcaagtgtcatgtggcatcacaccacggtcagatcaggtcgtcaactgtcaatcttctccccancatgtctcatgaagnnnccactatggatcaatatgaagangcacaagcagaaaagttactgagcggaaaaggngagatgctttgtaaggtgtgaaccntn

SEQ ID NO: 95531 - DNA, 566 bp, Triticum aestivum
  unsure (1)..(566): unsure at all n locations
  Clone ID: PAT_TA_95531
gatacattattttcctgtggtacgattcagatcatcaaatagcaagaaaaattgcaaattatgcagtacaattaggggagaactaggccctaaatctcagcagagaagtgctagaacatcttttctgaagctgtactagaacaccgcacgggtgtttgtttctgaagtactgtatgcacagtctcgaatctcgatagcttctactgaatgctaataatccggcagcttccgcaggatcgcggcggcgagcgcgtccgtgaacttcnggtcgccggtgagcncccgggcaatctgntcaacaanagccgcccggaactcnggngacgcgacttcccggaacaccttattnaggtccggtcgcgcctcccctgcctcnacnacctgcacgcctcccncgttcttggggaggtccaacgtgaaggtcgggccggaggattggtggaatggacaaggcaccgagcgccgcctgngttgcannctcggaactcncctccnctgggcgcgggggtgtntcccctcgnactccctcacaaaaagtgtctcggnctttcnaactctcttaangg

SEQ ID NO: 95532 - DNA, 576 bp, Triticum aestivum
  unsure (1)..(576): unsure at all n locations
  Clone ID: PAT_TA_95532
cccgtgtcctatttggcgttcgttccgtttcgttctgctgccgcgttcctctctccctccccagtccccaccctttcctccctcccaccaccaaattcccaggcgatttgatcctcccccgcgcggcgccaatccgctaatgcgcttgggcccgccccgtcggcgagatcggcgccggcgtccccgtcccatttgccgcgccgacctcaccgccggcgaggcgaggcggggcgggccccccttgctcggccgccggcgcgctcgctcggcggcgaggcggtcccgcgctgattgaaccctcagctacgctttgctcgagaaggagcggagccagggtctacattaggggaaaccactgcttttgtcttaaagagaagagatgaatgaatagtcggtgtttcaaggatatagcaantagctcagtcctgcactgttcaaggacaaggaggaggagttcaagaaaacacaatgctccgtgttgctcagatacagcaagttgggccataacaaaagaactgaatgtggccataagattacangatctggcctggaggttgacncggaacctacgcagtt

SEQ ID NO: 95533 - DNA, 453 bp, Triticum aestivum
  unsure (1)..(453): unsure at all n locations
  Clone ID: PAT_TA_95533
gaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacaacccccnaaatgtggcgctgcccgggatatgatntccaccgtcganggcacctgcggtgngacctgcaagaagtactgatcggttcatgccggcatatgatatgttccgcctaaaattaaataaaagtcggacgaaatgagcaacgtcatcgtgctaagnntgtgtntgngccaacaaatntttanacaatatgnggngtcctcntcngggnttttccccccaaaaaaaantgggttcttngt

SEQ ID NO: 95534 - DNA, 302 bp, Triticum aestivum
  unsure (1)..(302): unsure at all n locations
  Clone ID: PAT_TA_95534
gtcaccacagccgccgcctaccccaccaacctgccccgacccgctcccgacctccgaggcaatcagcgtccgccgcggccgccatggcgttcgagaagatcaaggtcgccaaccctatcgtcnagatggacggcgatgagatgaccagagtattctgggnagtctatcaaggncaagcttatcttccaatttttgnccttnggaaattangtnntttgacttgggaagttcaaaacnntgttgaatttgntaaaagggttaaantggggggttgaaagggttacccccaantaaaatggggg

SEQ ID NO: 95535 - DNA, 583 bp, Triticum aestivum
  unsure (1)..(583): unsure at all n locations
  Clone ID: PAT_TA_95535
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcggggtgcaccgacgccacacaggtgatcaacgaggtggaggaggtcaagaaggagtaccctgacgcgtantcggatcatcggttcgaaacatcgnangtgcagtgcgtcagttcattgcttcaagcacggttgcaagatccggaaggctaanantactcacangggcaatataaaggcatngattttgcactcganatgnttgtg

SEQ ID NO: 95536 - DNA, 551 bp, Triticum aestivum
  unsure (1)..(551): unsure at all n locations
  Clone ID: PAT_TA_95536
agtacagctgttctgggcaagatgcgcaaaattctcagcagcagcacccaccgggtatcactgaagcaaggaagccgctgcaaaagcatggtgtggtcgtccttgtcgcgcggcgtgaagatgaacagactgaatgcccaaaccccaaaactgctactctgcacttcgtcttcccctgttcggccagataataaatacatatctctgcaaccctganagctcacagcgcgaggagttccgactccttttcntcttctacnaacgatnaaccggtggaatgggccgagccgttctcaacctggggctcccngggtgttanacttcgagccanganatggaanacgggatccgtcatgttggacgaagcaagcanagccgcnccgttnnaaggatcnaatggccgcctggaacttttcaantgggactcnaggaaatgatccccccttgtccaatttgggtaagggaccatcaaanaagggtncatngaaaaggngtcaaatttgngatggagcccctgtgacgngtttccatttcccncaaaaaaaaagngg

SEQ ID NO: 95537 - DNA, 458 bp, Triticum aestivum
  unsure (1)..(458): unsure at all n locations
  Clone ID: PAT_TA_95537
ccgccgcgtcttcgactccatcgcctcctcctccccctcgttgtctccggccagccaggtagtcctccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagaggggtatcaccattggatatcgctctgtgggaattcgagaccaccaagtactccgtgcactgtcattgatgctccctgggtcaccgtgatttcatcaagaacatgatcactgggaccncccaggttgactgtgctgncttaacatngacccaccacnggggntttgagggggtccccangggagc

SEQ ID NO: 95538 - DNA, 380 bp, Triticum aestivum
  unsure (1)..(380): unsure at all n locations
  Clone ID: PAT_TA_95538
cgccgccgccgacgactccccctccggcacccgaaatggcgtgatccccgccctcgattcccctcgccccccgccgttcaaatacctccccgtccaccgcgacccctcacccccccatccctgaatcgcggagatccccgcatcccggngcccccgaaccctaaccctanccaccccctcccccancatganaggcctccatcaagttccgcgacgacgaccggccgctgctgcgcgccaaggtgcccatcgnngtgcttgggctgccgttcctctccggagtctcggccggtggcgantccaaggacctccgcttcnacctctcaaacgccttcccctccggcccggggctccgcctgtctanngcccaacnaccgctc

SEQ ID NO: 95539 - DNA, 547 bp, Triticum aestivum
  unsure (1)..(547): unsure at all n locations
  Clone ID: PAT_TA_95539
cgggagtatagcagagttattgcatcgattaccaaactgttcacagaataaactacaggacttgtctctatcggacaacaatctgactggaagcctaccaactacactagtagagcccttgagaaacctgagctggctgaatcttgatgggaacaaactcactgggtcatgtcccggtgtggataggagagtcacacagctaacaaatctgggagcttagttctaacaacctgggacggggtcatacatggaaggcatttatcaaggtctaggtatgttgggaggaattgacattatcaagacaactccataccatcactgtggagcccaacttggggtcctccctttcaagtcctaagaacaattgaacttccggccctgtcaactaaggctaaatccccatgtggcttaanaagnaaacacactttatggatccttggatatatcaaacacaagcataaatgacatggtacaaagttggtttgggtaacaactcccaatanagtactaaatatcgaaatatcagatacaggatcctacatcatca

SEQ ID NO: 95540 - DNA, 233 bp, Triticum aestivum
  unsure (1)..(233): unsure at all n locations
  Clone ID: PAT_TA_95540
ctgtgtggcactttttttttgtgaatgggctggaattggccaactttatatttggttaaatgtcaattgnaattttnaaaaggnttcaaanantcccaaggnaatttcanantttcctgggttccaaaaatgcttttttttttcaacttacagtgcactattatttatatggnaangttatncacntgggaancgggggaaacaaananaatttnctngggantttaatttgg

SEQ ID NO: 95541 - DNA, 395 bp, Triticum aestivum
  Clone ID: PAT_TA_95541
ctcaaacccaaaccatgtctacgagcatagcatggcaatttaagcataacgtagaagtaactcccaagggtttgataataaaagggtaataggttctacctcatcaactacatcccaaaacccacatgttaagagatcctactcatgcaatgtgtgaggattgttactaatgcataaaaactgggtaataaagggggtatgatcaatgtgttacttgtgctgctgacgatctgcaaatcctaaagactcgtagtagcacgcttcgcactccgggaattcaatcgcaacaaacaatagcatacataagcaatcaatcaaagatcatgggtacactcaaataagaagatataaccagaaagttcaactgaagaactccgggttccaaaaaaaaaaaa

SEQ ID NO: 95542 - DNA, 516 bp, Triticum aestivum
  unsure (1)..(516): unsure at all n locations
  Clone ID: PAT_TA_95542
cactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctccgattcagcaaggagtgctgctcccggcgtgcaggggctgaacggcatggcccgcagcantccggacgcaaagatagcgtgcaagtcctcaaagacctcgccaccaagcatcaanccatcaacatgggcaagnctccggcgtgccccggcaanncngctcagtgtcccttccccancaacattccacaaactgcgacactgtcaactaattcaatatatacctcctaactgcatcatggacccctngtgtggacttaagtcnatgttgatggatgccatacatacgatganc

SEQ ID NO: 95543 - DNA, 523 bp, Triticum aestivum
  unsure (1)..(523): unsure at all n locations
  Clone ID: PAT_TA_95543
cgcaaaggctgttggcaaggtgctcccagagcttaacggaaagttgactggaatggccttccgtgttcctactgttgatgtttctgttgttgatctgactgttagacttgcgaagccagcaacctatgatcagattaaggctgctatcaaggaggagtctgagggaaacctcaagggcattttgggttacgtggatgaggaccttgtttccactgacttccagggtgacaacaggtccagcatctttgatgccaaggccgggattgctctgaacgacaactttgtcaagcttgtctcctgggtacgacaacgagtgggggatacagcacccgtgtggtcgacctcatccgtcacatgcacactccaaagtaaatgagagcatgaattactggggagagtggttgccccagaggagtgttcaaaccttcctcctgagaataaattttgtatggattattcagctaaaaacttttaatggatgtatcctgatggntggtgggctaaaaccacatttggtggnata

SEQ ID NO: 95544 - DNA, 368 bp, Triticum aestivum
  unsure (1)..(368): unsure at all n locations
  Clone ID: PAT_TA_95544
cgtgtattanctaaagcattgcntntgtctgggggagatcatatccactccggtncagtcntangtaaattatcacngggaacgcgaaggtgactttaggttttgttgaattantgcncgatgattttactnaanaanatcgngntcacggtatctttttcactcangactggntatccatgccagntgttatnccggtanctttangtggtatntcatgtttggcatangccagntctgaccaatatctttggggacnattctgtactacaatttgnnggacggaantttanggacatccttgagggaaangcacctgnagcatcaggctaanctactggctttanaaacntgngtcaaagcccgaa

SEQ ID NO: 95545 - DNA, 527 bp, Triticum aestivum
  unsure (1)..(527): unsure at all n locations
  Clone ID: PAT_TA_95545
gcaccatccgctgagccgtggtggaggcgcctccctccctctcctgcctttcttcctacatctccggccacacaggaaagaggtcactagctatgggatctagggagatatgcacaccgagagattcgtggcgtgtacgcagtgatggcgggctaacccgcgctcgcctgccactccggcctctcccgcttcagatccaaactgtgtttctccccctaccgagctagtcagggctccttcctccggcatgtgatccatggtgagaagggtatcgtactgttcgattgggttcctcngactgcgtgagaaaccgtcgagcagtgtcctttttctctttcttttcaaccaatttcctaagtgggttacactcccgtgaaattttggcatttaccaagcttgcatttggcaaataacaaaaaaagntttccgcccccgctttataaatagagcaaacaacaagagcacaacgggaaacaaaggtcacacggcacatcaacaagtacaaaanaagtacgaaaaaaaaaaaa

SEQ ID NO: 95546 - DNA, 417 bp, Triticum aestivum
  unsure (1)..(417): unsure at all n locations
  Clone ID: PAT_TA_95546
gttcactaattagaaaatgttcatgantttagaaaaaatgttcacgattcaaaataatgttccctaattcaaaaantgttcatgaatttggaaaaatgttcaaaattcaaaaaaatattcgctaattcnaaaaatgttcacgaattcgataagaaatatgatttaaaaaaattgtctttaattttaaaatgttaattatttcaaaacaaatgttcatgagttgaaaaacatgttcatgacttaagagaatgttcacaaatttctaaaaaatgttcacaaatttaagaaaatgatcacgatttcnagaaaatgctcgtgagttttaaaaaatgttcacagtttcaaaaaanatgtacatgatttaagagtaacgaattagtaaaaataaaacacgattttgggggaaaaaagtcatca

SEQ ID NO: 95547 - DNA, 362 bp, Triticum aestivum
  unsure (1)..(362): unsure at all n locations
  Clone ID: PAT_TA_95547
ctcgtgccgaattcggcacgagatcagcattcagcagcaccagccttctacctcctctgctttgcattccgncttccagttccaantcnaaccgnantcaatggntgccatgaagatcgccctccttgccgtggccgcgatggacgtcttgctacagcaccgcgtcannggtaacctacaacgtcggcgatcanggcggttggnccctcagnaccgactacantagctgggtgtccggcatgaaattcaacgtgggtgatgacatngncttcacgtnctcnaccntaacgcacganntggncgatgtcaccangngccgngctacnactcctgcagcatntangggnccaanaaaaaccntg

SEQ ID NO: 95548 - DNA, 252 bp, Triticum aestivum
  unsure (1)..(252): unsure at all n locations
  Clone ID: PAT_TA_95548
gcgtagccattccccactttctcaggctagagcggcagcaccagctcgatctcgcacgcgaccaacgccggagcgcatggaggcggccgcgacgtcctacccggtggcgcgggacccgccgccgcggtcggngccgnanacggcgcatctgggcggcggcccggttgcgccgcancgcggngggtgggcgcgctgggngctgtgnaccgtcgtctccctcgtccncnccgncagnttcacntggggngtgta

SEQ ID NO: 95549 - DNA, 212 bp, Triticum aestivum
  unsure (1)..(212): unsure at all n locations
  Clone ID: PAT_TA_95549
ctaagatccaaaggctctatatcttggttcaaattccananggtatatttcttggaggggccgtgcatgggccttccccgcgcgtanagctcgtcgaagggcgaggcggaggcggncgcnaccccgaccccggcgagcctcctccgccagctcncaatcgccanccccnccgggtacagctgcgccgggggaggnngtggatggaacccgat

SEQ ID NO: 95550 - DNA, 535 bp, Triticum aestivum
  unsure (1)..(535): unsure at all n locations
  Clone ID: PAT_TA_95550
aacggttgcccctcctctcctgcgtcacccgctctctatccggccaccccgcccaaacccaccgccacgccgcgcgcctacccagcccccacccctcctccgctctaccgcagtggagtggagctccactcggaagccccatgcccccacgctagctgattgctttgctgccggccgggaacccagctgagatggggctggatttggtccggcttcagtctccgggtgctgccaaccagcgtcgggtacgccgcggaccggcgccacgcccgtntgcggagcgccgcatcccacggttcctccgcctggaggancatccgagggcantctgaaaggacggcgcggttntcttcngagggcggcggcggcggcgggcggatccacctgtgcgttccgtccgtctgaagatccaccgcaccggtggaccgnacggtnttgggcgggacncncggacggacacgcanccaagcaantcgccgggaagangaaatgggaagtatgangaggcgcgggcggagnaaccgcaaggctcang

SEQ ID NO: 95551 - DNA, 538 bp, Triticum aestivum
  unsure (1)..(538): unsure at all n locations
  Clone ID: PAT_TA_95551
ctcgtgccgaattcggcacgaggtggacgtccatggacgccacggcggatcccctgctgccccagccggcagccgccgtggaccacctcggccgcccagtatcccgcctcacctccggccggtggcccgccgcgttcttcatcatcggcgtggagatctccgagcggttcgcctacaccggcatctcagggaacctcatcgcctacctcaccggaccgctagggcagtccacggcgtcggccgccgcgaccatcaacgcctggaacggcgtcgcgcttctgctgccgctgctcggcgtggccgccgtcgccgattcctgggctcggccgttaccggaccgtagtctgtgcctctctgctctacatcctgggcctgggcatgctcacgctatcatcaattcttgccacacanctacaaaatcaatttggagaccgcatggattctgctctatactcgacttcgacngctcatttacctttcttcaaatctcctgtatatggtggccttgctcaangtggnaaaaaccttgnttgaanna

SEQ ID NO: 95552 - DNA, 527 bp, Triticum aestivum
  Clone ID: PAT_TA_95552
gatctccctcgcgtcgtcgccctctcaagtgcatcacgatagtctaagtctagacatgaagccgatatcgagcgccgccatcctcctcgccgccgtcgtggcgctgctcttggtggccgccgtgcggggcgatgacgactgcgggtcgccggagtcggcggcgcaggaccgcgcgcgggcaaagcctctcaaaatcgcggccttcttctccatcctggtctgcggggcgctgggctgctccctgcccgtgctggggcggcgggtgcccgcgctccggcccgagggcgacgtcttcttcctggtcaaggcgttcgcggcgggggtcatcctggcgacggggttcatccacatccttcccgacgcgttcgagaacctcacgtcggactgcctgccttccgacggggccgtggaaggactccgttcgccggttaggagccatggtcggcgcatcggacgctcgtcgtcgacactgtcccacgggtactcaagcgcgccaactgaacaaggacggaacggacggcaacggg

SEQ ID NO: 95553 - DNA, 520 bp, Triticum aestivum
  unsure (1)..(520): unsure at all n locations
  Clone ID: PAT_TA_95553
ctcatctgatcacccactagctagccagctagcagcttaaggaactagcttgcagctagctatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctcccggcgtgcccggcaanncgggcgtcagcgttgcccttccccatcagcatgtcaaccaactgcaacaatgtcaactaggttaatatataancctcctacgtgcatcatggacccctngnntgaacttaanttcnncttgatgnatgccaaacatgtnagcta

SEQ ID NO: 95554 - DNA, 177 bp, Triticum aestivum
  unsure (1)..(177): unsure at all n locations
  Clone ID: PAT_TA_95554
cagtggatgcaactctcaagctcgcgaccatggcngcagccggaggcaagcctgccgtcctgctgctccgccccgtggacgcgcccttcgccgccgcnctgcgcgaccgcttccgcgtcctcganctgtacgcgccggggnaggccctcccggncctggncttcgtcnccgcggccg

SEQ ID NO: 95555 - DNA, 380 bp, Triticum aestivum
  Clone ID: PAT_TA_95555
ttagtcgggactgtcaacaacttgctgaatttctagctgtacaaggtcagtgttttacttaccttccccgaagggaagtcgtgagtgtgtaggaagccttgcatgaaaggtctaattacggtaaaagggtagcagatgcaagcaagtggggatggttcacagagttccctgataatttcagttacagtaaactagcaggtacgtttgcgtgactggtcctgatattgcacttggatggtagtggtaatcatagcagtgattcaggagttgggaaatacgagtacattattacaagttgagttaatgaggttagcggaggaatttttgtaatctgtaaaagcaattcagggcgtgttcgggaaatacgtaaaaaaaaaaaa

SEQ ID NO: 95556 - DNA, 344 bp, Triticum aestivum
  Clone ID: PAT_TA_95556
ctcgtgccgaattcggcacgagagatgagaaggaggttgaaagctctgcgttaagaaaaaataaggttcaacacgcgtggtcgtggataagatatccacacatgacagtatcagcaatgttcttcaaccctgaggcagtgaagccgatttcaagactgcttgacaatgtcatagtgcctgacaagactataactgaagcggacattcggaagaggccgatgtggcacacgtacccgggtccaaggccaagacggccgcatgtcacccacaaaccagacacccattggaaggcgagctcgccggcgacgccgagagaagagcacaagctcgccggagaggggttg

SEQ ID NO: 95557 - DNA, 529 bp, Triticum aestivum
  unsure (1)..(529): unsure at all n locations
  Clone ID: PAT_TA_95557
cagacgccggagacgagacgtcgaggaaagagaacggccgcgccaaagccgcgggtttctgtggagttcatgtgacgcgcgcgacgatcgagcatggcgagcggcggcgcgggaggctactaccacggcgaccggtacggctacggctactcgtactcgcggcaacagcccgcgccgtcggcgacgtcgttccacatgtgcctgttcctggccacggcgtgcctcctcggcggcgcgtcgctctactcgcactgcgagtccgcgatggagagcctcgtcgaccagctccgggtcgccgtcgtcctgtccccgttcgtcctcctcctcgcggcgcagtactggtccgcgaccgggcgccgctggcggtcgtcgcactcgtactcgtcgtcgtcatcgctgctcgcggntccgccgtcggtgatgtcgtgggaacagcaaccgcctggtacgacagcggcacganacgcggggctctcccgtggggnttgcctggcgctgggctcgtctgctatatctctacaatcggctn

SEQ ID NO: 95558 - DNA, 256 bp, Triticum aestivum
  unsure (1)..(256): unsure at all n locations
  Clone ID: PAT_TA_95558
accgtgccctagctctaccgccgtccggcccttcaccgccgaccgccgaccgccgacgtcccaatcccgcgcgagttggcttcagccagcggctaagttaatcccaccagcgtgccgcacgccctgtagatccgccctgaggattaggttaggtttgagtggcggcctggtcgccatggggttnccngggngggagaaggtgagtcttgacnagagaaagcttcaatcgactacagcctccagggnaagnaggata

SEQ ID NO: 95559 - DNA, 177 bp, Triticum aestivum
  Clone ID: PAT_TA_95559
ccttcccttactgcttacgccctaggtctggtagggtacaagctcctaccacaattgtaatgacttttaagttttccacaacaattcatgttctaacttgtgatttccacccgttgtaatagaaacatgcactgaagcgaaagggggacaactatgagatttcctaaaaaaaaaaaa

SEQ ID NO: 95560 - DNA, 519 bp, Triticum aestivum
  unsure (1)..(519): unsure at all n locations
  Clone ID: PAT_TA_95560
ttgaaacgtgattctgatataagaagttttaacttgccgtctcgctctggcgaaggtgagcagtctgatgataatcgtctaattcgtgaggaactgtcttatgatgcatgtgctctgtctaaacagtccttggttatgtttgatagtttaaatgaggaccaattggttgcttataagacgattgtagagtgtgtgcaggcggggagaccgggcttttttttgtctcctgggatatggtgggtactggggaaagacatacctggtggagtgcaatatgtgctttccttaaggggcgagaggaagatagtgcttactgttgcgtcctccgggcattgcgtcgctgttgttgcctgggtggggaagactgctcatcctcgctttaaagatacctatcctccntggaagataatacacaatgccgatattaaaagagtcctaagnttgtaattgttgatatacctcccttgttatttgggacgagggctgatgacacacangaaagcttngaggtgtanaana

SEQ ID NO: 95561 - DNA, 284 bp, Triticum aestivum
  unsure (1)..(284): unsure at all n locations
  Clone ID: PAT_TA_95561
gaangatccaatctaacaactgttnaacncagcaagaanagaagcctaannatcctctaaaaatagataggaggcaagcggnagtgatcggnaagtgtttctgcacaagagttgaacttgctacagtatgtantatatgcatcctttgattgggaagatgcgatgcccgatgngaacaanttaatatgntacatgaattantccttttttcntaaccaaaatcgggcacacantgngggtttgtgcatacannntgatcgatcnatcgatctcatcccgccaga

SEQ ID NO: 95562 - DNA, 499 bp, Triticum aestivum
  unsure (1)..(499): unsure at all n locations
  Clone ID: PAT_TA_95562
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgcnaccgctcagcacggaggccctcctcaagcaggtcgactacctgatccgctcnaagtgggtgccttgcctcnagttnagcaaggttgggttcatcttccgtgagcacaacgcatcccctgggtacnatgatggccggtactggacantgtggaagctgcctatttcggggtgcaccnacccacacaaagtgataacnaggtggnggaggtaaaaaggagtacctgacgcgtatgtcncataatcggnttcnanaacatccncaagtgnatgctca

SEQ ID NO: 95563 - DNA, 340 bp, Triticum aestivum
  unsure (1)..(340): unsure at all n locations
  Clone ID: PAT_TA_95563
cgcctccgcctcgccggccgcgaccgaccatggcggcctccgcctccgcctccacgtccctcttcgggccctgcgccctcaccgncaggctcggggcggggcggccgtccggggggncacgccggcgcgatcgacgcgcgcggccgcggtcgcctctcggtggtggccgtgcagacgggcccgcagaanccgtcgccgtcgccctcgctctcgtcnccggcggaaggacgaggnngaggcgctgcagaanctgcncaagcgggagtanaaatacngnttcgtctcngacttcnntgnccttctccatccncaanggnctctcnggaggncanngtccgcc

SEQ ID NO: 95564 - DNA, 541 bp, Triticum aestivum
  unsure (1)..(541): unsure at all n locations
  Clone ID: PAT_TA_95564
ctcgtgccgaattcggcacgaggtcgaccagacgccatggcccgtaccaagcagaccgcccgcaagtccaccggcggcaaggcgccccgcaagcagctcgccaccaaggcggccaggaagtcggcgccgaccaccggcggagtgaagaagccccaccgctacaggcccgggaccgtcgccctccgggagatccgcaagtaccagaagagcacggagctgctgatccgcaagctgcccttcnagcgcctggtgagggagatcgcccaggacttcaagaccgacctccgcttcnanagccacgccgtgctggccctcnagnaggcggccgaggcgtacctggtgggactcttcgaggacaccaacctgtgcgccatccacgccaagcgcgtcaccatcatgcccaaggacatcaactcgcccgccgcatccgcgggganagggcctangccaaggaggcantcaacccntgccgcgtctcctgcatcggattctggggcgatcaacgtgcncaacattggacnatagtgataccncctggcaa

SEQ ID NO: 95565 - DNA, 556 bp, Triticum aestivum
  unsure (1)..(556): unsure at all n locations
  Clone ID: PAT_TA_95565
cgcncacccgcncgcccgctccatgcaagccccgccgcncgccgcgctcgccggaagcgnctgggccncccatcgacctgccatattagcngcgccggcnatcctcctccgtcctaggngcggcgccctccggttgcncgcgtgganagnggccggaggcggcngggccccgcngctcccggncaagggcaccgtgctcgcctccgacacgggggcgnacgaggangtcaccgggccatcgcccctgntcgacgtgcgcanngagcaagatttcgttctaccngtcaggaaggaagtggatagagggaagttgcntccggatgttgctganaantttgaaaacctgtncaacaattncannaatgcggtcntacaaaatggggatcaanatgcatatcanntcatgctttccaacatgatggatttatttgancncnttctgctgnntgaanaaaatcatttangtttaagcttataaanggcatcanagaaangtttgacnaatanatttcggncanaanaaattangcacnggnaatttannactctaatcggt

SEQ ID NO: 95566 - DNA, 248 bp, Triticum aestivum
  unsure (1)..(248): unsure at all n locations
  Clone ID: PAT_TA_95566
ctccangcccnccgncgcaacgccanccaaaccctcntcgtcntnccggatcacgccatntccncngtcgcctnanacacgcngttcatcccggaaccctacnccggcagtagcaccctcgcttcgcggcnanggtctctgcggtcgacgtcggcgtcgtctagggatccancatctntctggcatccatcaatatggattcaagaccatcgaaggacagcaagcanctcatcactgntgaacattgt

SEQ ID NO: 95567 - DNA, 167 bp, Triticum aestivum
  unsure (1)..(167): unsure at all n locations
  Clone ID: PAT_TA_95567
cgctgtcatcgngggctacatccagcgtggnngangtcgcctcgactgggccggggattcgcttcttccanctctacgtgtacaaggacaggaaggtggtggagcanctggtgacgaagggcggagaangccggnttcaaggccatcncncttacngtctacacccc

SEQ ID NO: 95568 - DNA, 672 bp, Triticum aestivum
  unsure (1)..(672): unsure at all n locations
  Clone ID: PAT_TA_95568
cccgccccctcgccgatcgatgaccacacctcccaccacatccgactaactccggccggggacgcatcgccttggctgtatatataggaagctagcggacgacccgcacgccccatcaaacgccatggctgtggacctgcaacgcctgcgccacaagttactcaccaccggcgccggcggcggccaccaccaactcgcctccgccgctgctgtgccagcgagtgggccttcttatggcgctgcggtgccgagccagcgggggcaccagccgtacgcggacctcttcacgctgccgccgccgccgccgatgtcgtcgtcggccccgtatcattgttcggagttttgggaatggcccggntgttctggcaanaaggggtcagcccgccggtgctcangaaatgattaccaacaagcggaagcgcgacgagcggtctcggttcttggcgcgctgacgttctcccgccangcacacaggagntatcgccgtcactgntctgctaaacatgcaaaanatgtgatacttggcggagaaggcaggcaacaaggatctctcggcgtgaggcaggcgggaacggtaaggcaagncagagttacgttagacatgatggatcacannctagacttgatgngtaantggcactcgatcacagcagcaaatntcgggantanngg

SEQ ID NO: 95569 - DNA, 567 bp, Triticum aestivum
  unsure (1)..(567): unsure at all n locations
  Clone ID: PAT_TA_95569
catcgacgagcgccccccttctccccccatctgccgcacgcccccgagggcgcccctggcgccgccgctccgaccacctcgccatcgccccgcgccgcccggcgaccctaccgcggtggacgagccacctgccggcgatgaacccctctccctcgcgccgtgccacggcctcttcctcacggaccccgctatcgtcgcagtcacctcgtcgccggacgccatcgccggcctgcttcctccccgtcgcccggtcgtccccgacttcttctcgtcacccactgccgcttccctaccgggccctactacaagaccgacgctgatgtcaccgagtacgactacgtcaccgacgaccctccttgtctgagcaacaagatgctggagccctggagccagacccaccgttgacgatgacccctacttcactggaggtgcctactactacgtgancctgctgangacgacctggagtantaaggaggatccaagcaggaggctgcgcctcttcgatcgnatccagtttgtncagcatctangaatttgttactantcgtcnanaatgtgcttcgc

SEQ ID NO: 95570 - DNA, 679 bp, Triticum aestivum
  unsure (1)..(679): unsure at all n locations
  Clone ID: PAT_TA_95570
cggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaggccgtgtggttcaaggccggctcccagatcttcagcgagggcggctcgactacctcggcaaccccagcctcgtcaacgcgcagagcatccttgcatctgggcctgcaagtcgtgctcatgggcgccgtcgagggtaccgcgtcgccggcggccgctcggcagatctcaaccgtctacccggggnanttcaaccctgggctcgcgatgacccgagnatcgcggactaagngaaggagttagaacggcgctccatgtttcangtcggttctctcagcatctcacggaaggccctcagactncgacacngcgaccgtaaaaaactggctccacactttgcgataatcagtcntnactattaaatntag

SEQ ID NO: 95571 - DNA, 642 bp, Triticum aestivum
  unsure (1)..(642): unsure at all n locations
  Clone ID: PAT_TA_95571
gtggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtacccgaangcatcactancttacgctctgaccgagtacatggggcacgtggatcccgtgtgaatcagcaaggacaccttgcaaggctaaatactcctgggtgaccgatagcgaagtagtaccgtgagggaaaggtgaaaagaacccagtggtagtgaaatagaantgaaacgtgctgactccaagcagtggaggggaaattgttctgacgcngctttaaaatgancggnatcatagcatgcttgntaggaacgaccacgganctnacaagcatctaaaggcatgcanctaagnccgactgngtnacagcagatac

SEQ ID NO: 95572 - DNA, 661 bp, Triticum aestivum
  unsure (1)..(661): unsure at all n locations
  Clone ID: PAT_TA_95572
gcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctanaagcagccaccctttaaagaggctaatantcactgatcgagcgcccttgcgctgaagatgaacggggctaagcgatctgccgaagctgtgggattcaaaatgcatcggtagggnaggttccgcttaagggaacancgcgaaacnggggtcgacaagcggagcnaaantcgcttgatacgaancattggngagatcaagcccgaaacccangttccncgaaggtctcacgggggatcaggcnatatagccaagggtancatgaaaaggcatatcgnacaccctgtgacggggacnggagtttnncaagtgtaagttagaaaaggnctnttang

SEQ ID NO: 95573 - DNA, 406 bp, Triticum aestivum
  Clone ID: PAT_TA_95573
tttcgatgttcttctgactgaaaagctgagctacattggtgattcaatttcggcagttagatctgttcgatatgccgtgtttgagtacgaccctttgcagcgtaaacgccaggtgctagcaactgttgtagccactgttcaacaagtagtatttatcattctattgtgccctctggcgactgtctacgtgtttgtttgggttgttatttctccgcggggatttctgtgtggcgtctgaggcaacacgattacgggagtgatgctgacggacttggaaacctgaagccggcgctggacatcttgtattccattgctctactccagggcgtgatttctgctacaaaactgtatttggtttgcaaaggatctgtagcgaaatgcagtactcaaaagaagagggttgggg

SEQ ID NO: 95574 - DNA, 227 bp, Triticum aestivum
  unsure (1)..(227): unsure at all n locations
  Clone ID: PAT_TA_95574
ctccgctcctctccccatctcctctctcgccaagaaccaccgagcttggagcgccaccgccatggccatggccacgcaagcctcggcggngacgcgccacctcatcaccgcggcctggtcgccctccgncaagccccgccccgncaccctcgccatgcgatcctccgctcgcggtccngacccgctctgcgccncngncccggacacccccggcnccngccgcgccg

SEQ ID NO: 95575 - DNA, 329 bp, Triticum aestivum
  unsure (1)..(329): unsure at all n locations
  Clone ID: PAT_TA_95575
gagaactagtctcgagttttttttttttttttttgaagttgaatacaaattttaaaactttaagctcagacgcaacattttaggagatttaccttgtcatcctaacataaacttgtcacccggttgcaattccacgggtactcgaaaggntttctggtcgatggngcatgtgcatatcatactgacacactctactatacancccactangattcacantttcacgtcntatgtatggggcgacgaaccgcgcnctgatgatanctagtancacttgccgttggtcngtggngccatcngcccanagtcgncgtcatccancttgacgg

SEQ ID NO: 95576 - DNA, 642 bp, Triticum aestivum
  unsure (1)..(642): unsure at all n locations
  Clone ID: PAT_TA_95576
tcccacccgggctcagcgccgtcctcctcgactcgccgagattcctctcgttcttgcacggacccggcgatgccttggccatggacgccgctgtgatttaccagtctgatccggcggcgatactgtactcctccggcaccaccgggagcgccaaagcggtggtgctgacgcaccgcaacctcatgacgacacgcgtcttgcctggtccggcgccgccagacgaggttctgatgctgaccgtgccgctcttccacgtctacggattcgtgttctgcctcaggcctgtaatggcggngcaaacacttgtgttgcacacggcgaggaggtttgacaccagggcggtgctggnancggtggggaggttccgggtgacgcggctaacccttgcgccgccggcgctgttggnattgtgcaagaactgaggacgacaaagtgtggntgcnaggcaanaagctgcagggggtgctctcggggngnaccctctcacaaagttatcggggttctcnaaaaattccnaagtcttgttcanaggatatgacgacgaaacanacggntttgccttcaatgggtaaanaatcacaattgntaatggngcnccacggngctngggaaatttgtctgaaagggattcgcncgtttcag

SEQ ID NO: 95577 - DNA, 498 bp, Triticum aestivum
  unsure (1)..(498): unsure at all n locations
  Clone ID: PAT_TA_95577
tcccgatccaatcgggatcgaggcaaaaactccccccccccccgatccaatctggatcgggacgagacccccgctcccctcgctccttcccctcctctgcccgatgggattggggaacggngccccgtccccatctccctgtcgcgtcgaccacgccccacggcgccccacgccggtgccaccgccacggngccgcccggtcatcgacgcccggaacgccccgccgcctcgacgcagcgcccctgcctcgggtcgtcatccacccgtcgcctcgcnggcgccgcccgtcatcaccgccacctcgtcgcgcgtcncnatcctcatcctcgcggggaccacttcaccggagcaagcgccgcctcgccggantccccagcggtctctcncagccancgatgtccccntcctccncatgatcccgctgcccgtccntactcntcganactacgagncgangctgctgctggcagttcaatacggngttgacgancctctctc

SEQ ID NO: 95578 - DNA, 198 bp, Triticum aestivum
  unsure (1)..(198): unsure at all n locations
  Clone ID: PAT_TA_95578
nggatttcnacccagtcccttggtctggntccgtcacnggctacggtttcgccgtctctccagcgntgcgggtcggggcggcgaacatggcagggaagggcgccaaggcgacngtcgccaaggcggcnganaaggaaanggggaaganggcccccgnctcccgctcctcncgtgcctgntctcaccaggagccagttc

SEQ ID NO: 95579 - DNA, 539 bp, Triticum aestivum
  unsure (1)..(539): unsure at all n locations
  Clone ID: PAT_TA_95579
aaaagaaaaaaaaaccttccctatcctcccccgatcccatctggccgccggctccctcaccgccccgcaccgccgccgcctcctgaccttccccgcgccgccgccgcctcctgacctgccccgcgccgcctcccgaccttcctccctgtcccgcgccgccgcctcccgacctccctccctgccccgcgccgccgcctcccgacctgtcccgcaccgccaaccgcgccgccgccctcccataagtaaccacccccgtcggcgctgaccctgacaccggtgacgtgtgtcgtcgcncgacctgcatcctgcgccaccgccgcncgcctctcntgcttcaaccgcgacaacggatcncctgcttcaanangcaagccacacngcacanggatcatccgtcgacgtccccgatccggncgccgcatggctgtcttccaaaggcgccgtcgcccgtctctnaattcgaaccgccgcggacgatagaacaccacaggaggngggnnacaantaaggctncgttcctcataacaanggaacagctg

SEQ ID NO: 95580 - DNA, 566 bp, Triticum aestivum
  unsure (1)..(566): unsure at all n locations
  Clone ID: PAT_TA_95580
cggagctcaactgacataccaaagccacagcctctcctgagtcccaactgctccacctccctcctctaatctctcaatggcgacggcgtctgcgagtcggcccagcggccatgtccttttgagtccctttcccaactaccaatccgcctcgctcacccgtgtcaagctctccgccggcggctcgccggtgaagtttgtcagcgtctcgtctcctccatcctctcccgtgggcggcgccgccaagatccgtcggtcctgtatgtgctccccgacgaaccacccgggctcgttccgttgcagctccacaaggagcgcaaggagggtcccccgccgccggcagctgcagcaagccgtctccccgccttcgccgccgcccatccggcagcggctgctctangcgcatggtaaacgtgctagcgcaacgcgtcccaatggggagcgggactgggnanggangcgctcgcgccgtccangcgctgcagaacttcagcagangaaggcgccgaccggttcnancgggcaaccggttcgcgnncatggcggaggcgcgaagnggagaacagtaa

SEQ ID NO: 95581 - DNA, 656 bp, Triticum aestivum
  unsure (1)..(656): unsure at all n locations
  Clone ID: PAT_TA_95581
ctcgtgccgaattcggcacgagctcgaccgtgggctcttccctctcaaagaagaggcgcagttgagcaatggatacttggacacgaccatcgactggataccggcgatgcccaaggacatgcggctacgtgacctcccgaccttcttgcgtgccacggaccccgatgatatcatgttcaacttcttcgtccatgagacggcggccatgtcacaggcctcggcggtggtcatcaacacatgggacgagctcgaatcacccctgctcgacgccatgtccaaactcctgccgcctatctacacagtggggccgctccatctcacgggtccgcaacaacgtaccgggaggagancccctcgccggcattgggtccaacctgtggcaggagcaggacgcgccccttcgggtggntcgacngccggccgccgtgctcagtgggctaactcaatttcgggagcatcacggtgatgtcnaangacattggtggagtcgcgtgggggtgggcaacaagntacacttcctgggtggaactcggctgactctcaaggtgacgacaggcgactcngcnggagtctcnncggcattangggcgagatgtccacgtggggcaaagaaagngtgananagttaggggttccaaatcggtgnacacgtaggg

SEQ ID NO: 95582 - DNA, 616 bp, Triticum aestivum
  unsure (1)..(616): unsure at all n locations
  Clone ID: PAT_TA_95582
ccaaggcggagaagaagccggcggcaaagaagcccgcggaggaggagcccgcggcggagaaggccccggcggcgaagaagcccaaggctgagaagcggctgccggcggggaagtccgccgctggcaaggacggcgacaagaagggcaagaagaaggcgaagaagagcgtggagacgtacaagatctacatcttcaaggtgctgaagcaggtgcacccgggacatcggcatctcctccaaaggccatgtccatcatgaatccttcatcaaacgacatcttcngagaagtccccnggcgaggccgccaagtccgcccgctacaacaaagaacccaccatcactccccgggaaatccaaacgtcctccggctcgtcctccccnnggcgantcgccaaacanccgtctccgaaggaacaaggcgtcacaaatnnactcctcctagtccggctctctcggagantcctcncgccgattcgacaaggggngggccggtaccnatcgcctatanganntattagcgcgtcatggcgtcgttacaagcctgatgggaaacctgcttncaactaacgctncagaaanccttccagtgggtanacaaaggccgacgntgcctccaa

SEQ ID NO: 95583 - DNA, 645 bp, Triticum aestivum
  unsure (1)..(645): unsure at all n locations
  Clone ID: PAT_TA_95583
caacgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtgggtacggctccgaccgcgtgctctacctccggccgtctccggcgaccccccggagtacctcaccggcgagtccccgggcgactacggctggggacaccgcggnctctccgccgaccccggagacttcgccaaagaaccgggagctggagtgatccactgccgctggggccatgctgggcgcgtcggtgctcttcccgggactgtcgcccgcaacgctcaattccgcgaggcgtgtggtcaaaggcggtccaantctcantgagggcggctcgatactcggnacccaacctgtgacgcgcaganactcgccancgggctgcaagtggtgtatggcgctggagggtacgcgcnccggcggccctcgggaatgtgaccgtcaaccggngaanttnaccctggctcccaggaccagnntccgnctagggaggatanacgcgcnccagtcca

SEQ ID NO: 95584 - DNA, 502 bp, Triticum aestivum
  unsure (1)..(502): unsure at all n locations
  Clone ID: PAT_TA_95584
gccccgtttattattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcggacggcaacggcaccatcgacttcccccgagttcctggaacctggatggcgaggaagatgaaggacacggactccggaggaggagtcaaggaggcgttcccgcgtgtttgacaaggaccagaacggttcatctcgggnggcgggactgcgccacgtgatgacaactccgngganaacttgacggacgagaagtggacgaatgatccgggaggcggactggacgggacgggcagttnactanaggatc

SEQ ID NO: 95585 - DNA, 627 bp, Triticum aestivum
  unsure (1)..(627): unsure at all n locations
  Clone ID: PAT_TA_95585
tttttttttttttttttttaaaacaaaaggaattaaccaactataacaattttacaatcttacaacagggtgaggtctccaggttcctggtcttcaccggctgtctttacttgcccaatttgcaggtgtcttctatccaattgtcagataacttccagcgaatgactaagtaaacgcagcactctacaatagttacataactgcaaataatggtacagacgcatgaaatgcatgcgtgatctccgggcatccactattttggaggctaaaaagaccaaacaagcaacacggacagcagcagttgtcgttaggcttccctacaangaccaaatttncagacggcaacattgaatcntgtcggcaaatacatgccaagaactttgggtgaacttacangttatcacatcttccgtcctgacgttaaaatctggcctatagagttacatttgggtgactgtgcacatcagtcaacngnggagaactatcngaaccntaccacggaggagnccgatnantgctaggtccaaaactactgttacgaatgncccttccgatctcaaanancagtgatgtgaccaanncnccatgcaccgcgaattctaggggtanctcanatngggtncacac

SEQ ID NO: 95586 - DNA, 452 bp, Triticum aestivum
  unsure (1)..(452): unsure at all n locations
  Clone ID: PAT_TA_95586
acaaaacaaaaactttttatatatgcaatatcaaatacgtaacagtatgaaactacatgttatgatgagtccaatgatacatgtttggcatttcaaacgtaaatgtttttcctgcaaatttgatcaatgcccgtgaggtttgactttttcaaaaatctatatccaccgtattttttttttgcgaggaaacttctgatctattcatcaactgtcaaggtagtacaaagaacattagaagtaaaatttacatccaggtccgcaagaccacctagcgacgactacaagcactggagcgcgccccgccgtcatcgccccccccccctctcgtcggangccgggcaaacattattgtactagacagtcggggaagtcgtctgctaaggcctataagaccagcgcaccaggacagnaaccgtcgccgttgaggagaaagcntaaaccgganggtccaa

SEQ ID NO: 95587 - DNA, 283 bp, Triticum aestivum
  unsure (1)..(283): unsure at all n locations
  Clone ID: PAT_TA_95587
ctttctcctcctcgagtggtccatgacattgcaacgcaccatggtgccctttgaaagcttcangtggnccgatttgaggaacacaccaggcttcagggtcttctccatacgtgccggtcggaaaaggattacctgccannngccaaatttatatagcagnagcttgnatttatcatttctatacttctacattataattcctaatatanacctgtttgctacatactgtncacagcantaggagcaggattctaatanattcattacaggcttgccangtaaa

SEQ ID NO: 95588 - DNA, 307 bp, Triticum aestivum
  unsure (1)..(307): unsure at all n locations
  Clone ID: PAT_TA_95588
ctcgtgccgaattcggcacgagcgttaacatacagcagtatcatcatcaaattaccatgtacatataacctgatgcatcattatcaccgntcgaatccatcattcagnctcganaattaaaattacaggacgtccatcatcatcggccacccgccantaactaccggtcgatgnactatcacgtacncatatactacgtacgagnattaggntgtcganngagttcttgccggtgnctttgncctcgatggggctgangttcttnctnatgntgcggnagntctgncccaccccctgcgtgcaggcg

SEQ ID NO: 95589 - DNA, 663 bp, Triticum aestivum
  unsure (1)..(663): unsure at all n locations
  Clone ID: PAT_TA_95589
ccaggatgaagcttggatgaaactaagcagaggtccgaaccgactgatgttgaagaatcagcggatgagttgtggttaggggtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgagagggaaacagcccggatcaccagctaaggcccctaaatgaccgctcagtgataaaggaggtgggggtgcaaagacagccaggangtttgcctanaagcagcaccctttaaagagtgcgtaatagctcactgatcgagcgcccttgcgctgaagatgaacggggctaagcgatctgccgaagctgtgggatgtcaaaatcatcgtangggagcgttcgccttagaggaacaacgcnaagcggggcnacaacggagcanattcgctgagaacaaacattgngagatcaancccgaaaccaggttctcgangtctcacgaggtatcaggctagntagcaagggtacatgnaagtattccgncacctttgng

SEQ ID NO: 95590 - DNA, 665 bp, Triticum aestivum
  unsure (1)..(665): unsure at all n locations
  Clone ID: PAT_TA_95590
cgccgctgaactctaattcgatttggtttttcctgggcggtgggagaggatgcagtgggtgggcctgagctcgccgccggcggcgccgacggcggtatggatgcggcgccgtccaagaacaacgagatggccgcagaggagctcgtccgccgcacggagggcggtcgtggcggccgcgtcctcgtccccaccgtcatccgatgccaactcgagctccaactcgccgggtagtgacgaggaggcggaggaggccgcggggaaggcggagggtgacaagacggcggcggccttcttgttgaggagccagaagtacgctatgctcaagcagcaactcgccgtanccgcccaactcgaggattacaaggaggcggcgaggctganggaccgttgaggtgttcgaggaagaaaagcccgtctccgcctccgccgctcgctgaagaaaggtcgagaagganaagnttgcggatgctgcaagtacagagatgaactgatgatttgntccgaatcctcccaaaatgtcnatgatgctacaatctgganaaggtnaatcagatgtcatattaaanccgggcaacctaaagggaantcttttgctaaaacagattaaataatccantgntaanttcancaacnggttgncgatcaatgaggaaaaagttggtttg

SEQ ID NO: 95591 - DNA, 371 bp, Triticum aestivum
  unsure (1)..(371): unsure at all n locations
  Clone ID: PAT_TA_95591
cgtctgaagccaatgtggaatctgaagctaatatgatgcttgaagctcaagtacaacctgaagccactgtgcatgctgaagccattgttccatctccaaggcctcacgcaattgaacaagcatttgatcatggacagctggtcactgtgaaatggcccgtcatggtgcctcccactgctcccggacctcaatatgactatcatgtggagcagaggccacanattcagaaggcaaagcccaggctgccaaggcttccaggtgttgcaacctccccaggatcgttcagccgtgaacagcttcagggcacacaatactttctttgacagtgccaagaatccatactcgaagccaaagatctcttctgatcgctt

SEQ ID NO: 95592 - DNA, 659 bp, Triticum aestivum
  unsure (1)..(659): unsure at all n locations
  Clone ID: PAT_TA_95592
cgccgcctcccctcccttcgttcttcttcttcgagttgggtagtttacctctacccaccagccatgggtaaggagaagactcacatcaacatcgtggtcattggccatgtcgactctggcaagtcgacgaccactgggccacctggatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctcctggaattcgagaccaccaaagtactactgcaccgtcattgatgcccctgggtcaccgtgacttcatcaaagaacatgatcaccgggtactcccaagctgactgtgctgttctcacatcgatccacaacnggtggtttnaagntgggatctccaaggatggcaaacactgagcaccctccttgctttnatctggagtgaacaaatgatcgctgcgcaacaagatggcgcacacccaagtaccaangngctttgaaaaatgcaagaggcctccaccnaaaaggcggtaaacctgnangtccttgnccatccnggttgggggnaaannttaaggcacacctangnaaggcanctctgggcttcaa

SEQ ID NO: 95593 - DNA, 630 bp, Triticum aestivum
  unsure (1)..(630): unsure at all n locations
  Clone ID: PAT_TA_95593
gagaactagtctcagtttttttttttgaaataacaaaccagcatctctcaaataaaagtatacaaaaatggaaagcgactaatatgttccgttttggtcagaagatgagaaagctagtaagattcaagattttcgtccaaattaaacaaccatttttataggagccttccactgtcggtttggagtagcgaacttgaacagcaacttgctactctggccatccgggagaccgattttctcgacactctgcattcaaatcattctaaagctgctctgaaagagggcctagtttagccgcgtcggcatatttggaggcacgagaacaccacctgtcccaaccaagttgctgttttaaacgaagaanggaccgagaaaacgtgaggaggcacatgaggtgcctgcgtaggtaacatgcacgtcaacttagcccctaaataaaccagctaatgatgcaaaatcgtacnatgcgcggagtcaatgcaagatctgcaaacanattttttaccagcactgatcaaatctcggaantataccaagcattggccaccangatcagcancacgngnctgatgattagcacggntncnaacgtcaaattttgtcttgagccgttnantccgggangggngg

SEQ ID NO: 95594 - DNA, 337 bp, Triticum aestivum
  unsure (1)..(337): unsure at all n locations
  Clone ID: PAT_TA_95594
acttgatcttatcggtgggtagtantacnagcgagtgacacaagttcttgcaccgatcagatccaacttctgcgcaagatgctggacaagctgtgggacgacgtggnggccgggcctcgcccggagacgggcctcgacaagctccgcagggcggccgccacncaacctctcgccatcaacacagctgcaggggaggcgattaagcagtcgccgtcgatgccgacgnccccgacnacgccggttacnccgtcgtcgtcgacgccccgcncggnngcagngtgtggcgnagcgttttcancccggngngcacctggnnacanaaagnntcggggaaaac

SEQ ID NO: 95595 - DNA, 613 bp, Triticum aestivum
  unsure (1)..(613): unsure at all n locations
  Clone ID: PAT_TA_95595
cgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatcaactgccgctgggcatgctgggcgcgctcggtgcgtcttcccggagctgctcgcccgcaacgggtcaagttcggcgaggcctgtgggtcaagggcggtccaaatcttcagnaaggnggctcactactcgnaaccagctgtgnagcgcaaanatctcgcattgggctgcaagtggtntatggcnctggaggntacgctcncggnggcgctcgnaaatntggaccgtcaaccgggggaagtngaccctggctcccangacccagggtcncggtaag

SEQ ID NO: 95596 - DNA, 506 bp, Triticum aestivum
  unsure (1)..(506): unsure at all n locations
  Clone ID: PAT_TA_95596
gaaatttatggtatacaagtagtacttgtgctgccatgagctgaaaccatctctgcaaccatggctcctactctttcacttctgcttgccaccacttccatggctctgctcttattttcaagagctgtagcacatgacactctgccgttgggatcctctctagccgtcgaagccttccaaaccgacgtgctgcagtcaccggatggcaccttctcctgcggcttctacagcatctacaccgacgccttcacattttcgatatggcactccaaggctgcagacaaaaccgtcgtctggagtgcaaatcgcggccgccctgtcnatgtcaaaagggcagccttcaccttgcanagggatggcaatatggnctcgtaaattatatggcncggttgtgtggnagctggcggaacttcacgaatgttaacangctcactgttggaacnggaatccanttgaggaacgatggnaagacatatggcaaatttgttcaccacggaacatatgcg

SEQ ID NO: 95597 - DNA, 617 bp, Triticum aestivum
  unsure (1)..(617): unsure at all n locations
  Clone ID: PAT_TA_95597
ctcgtgccgaattcggcacgagagaaaacacaccagcaatacgcaccacaagatgagcacggccatggcaccactcctgttcgcagtgctcgtgttgccgtttgcagcacctgccgcggtgacgatggctagaagaaactgctccagctactgtggttatccgtcgaacccgccgccgccttatccgtttggagtagggccttcgtgctccatgcctggtttcaatctcacctgtgatgcagataacggcacttacctcctgctgggcagcccaaccatgaaggtgtctttttattccaacgaattcaatcacaacctccgcaccagtatctcgtacttcgtgggagatgattgccggcgtccgcgactactccctcaactgggaagctcctgcaagcccttcgtcatatctggggtcgtcagacatgtcnttggttgttgttgggctgtggtgtgaaggctcctgttcaatggcactcggccttgagnccggaactgcttcccgtctgccggaactcnaatctggnnaagnaccccggtactgcatggctcggtgcgtccaatgcatanagtgacctaggggtcactaaaatcccgtanacattcggcctcgaggg

SEQ ID NO: 95598 - DNA, 633 bp, Triticum aestivum
  unsure (1)..(633): unsure at all n locations
  Clone ID: PAT_TA_95598
gcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactgggacaatgtggaagctgcctatgttcggatgcaccgacgccacgcaggtgatcaacgaggtggaggagtcaagaaggagtaccctgacgcctatgtccgcatcatcggattcgacaacatgcgtcaggtgcagtgcgtcagcttcatcgccttcanccaccgggctgcaangatccggnaaggcctaaanagtcactcacgacaggccatatataaagtgccattgcattttgtaactctganttgctttggtttccttcccaattaccttcnaattgtnccaaaaatattgtattcattcatttcgaaatggctcanaaacatcnctttaatgcnacgnggnattaatcacggcncatatntaacattncacnanaacntttagggnacanggaattcccaaaaaaaaaaaa

SEQ ID NO: 95599 - DNA, 584 bp, Triticum aestivum
  unsure (1)..(584): unsure at all n locations
  Clone ID: PAT_TA_95599
aattcttaacgcacgaagcgtgcaagagctctggaaagaccatgtccccgagactgagcacttgccgtgtaccaacccagctgctcgggatccaactcattctgctggttttcttcatcaacggcagcctcctcgtcctccccgccgcgtcagcctactacaatgcatctgcgcctgcggctgcgagagtatacctcccctttggtaaatcgggaatatacctcccccctggtaaatcgggaaacttaaacgtgttcggtggaccacgaaccgctactccacatcctcacgctaaccaaccggaggggattcctcggcgcagagagcgcaaacactaggcgcctgagaggtgcacgtgcagcgagacaacgggggatgacacatgtatagctttgatagggaatcaaataaccttgcttggttgggcaatgggcgcttacttgnattgggatgcatatgcanctngtaaanagttgngtgaacttgcattccgttccttgccttcagggaccncaaanttaactaccatnaaattgaacccttgacccatttgaacgccnttgaagtatganaattgtcatngc

SEQ ID NO: 95600 - DNA, 512 bp, Triticum aestivum
  unsure (1)..(512): unsure at all n locations
  Clone ID: PAT_TA_95600
cccttccgtgtgcaccgccgcctctcctcgccccctcccatgctctccagtctccaccaccacgccgccccttgcttcgcttctatcctcctctcgatccggcgcccatgcacgcagtggttacggatgggagagcatgggagggcagggccacacagcgtgggtgtgtaggagcaggaagaggtgaggaggatgacagcgtggggaaaaggaagccagatcgaagttctcggcagcgctcgcgtcgccctgcagtcgagggacgtcgcaaacaagcgaggaggangacaacgcctggattcagccccggcccgggcccgggcctcgtggatctggcgatggtatcgtgagaaggntgggctccttcccgganaaggcggtgctgctcntgctaggcnacggttaaaggcctaccaggtgataatggcccccaaggatcctgccttaggaggacccgaccgtanatggcaccgaaggtanaactttttggttcctcaaacggcccatngaaa

SEQ ID NO: 95601 - DNA, 650 bp, Triticum aestivum
  unsure (1)..(650): unsure at all n locations
  Clone ID: PAT_TA_95601
ctcgtgccgaattcggcacgaggctcaacctgtgtgactcggatgctgctcgtgcccgcgcgtccaagatcctcgcggggctggggtttgatcaggcgatgcaggcaaggtccacaaagtcattcagcggtggctggaggatgcgcatctcgcttgcccgtgctctcttcatgcagccaacgttgctgctccttgatgagcctaccaaccatttggacctccgagctgtgctttggttggagcagtacctgtgctcgcagtggaagaagaccctaattgtagtctcccatgaccgcgacttcttgaacacggtgtgcaatgatatcatacatttgcacgataagagtctgcatgtttaccgtggtaattttgatgactttgagagtgggtatgagcagaagangaaggagatgaacaagaatttgaggtgtacgaaaagcagatgaaagcacaaggaagactgggaacaagctgcacaagataaggtaaaggcaagcatgtcaaaggccataaagaattgcaagggaaggcaaggaaagaattggnactgatgatataagtgaancacgggttgcaaaaatggctgacataaatgagtcantcanaccacttgctaacaacctctanccataggnggntagtaccanagn

SEQ ID NO: 95602 - DNA, 590 bp, Triticum aestivum
  unsure (1)..(590): unsure at all n locations
  Clone ID: PAT_TA_95602
ccagaacggaacgaacgaaaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctgggcaagcagcttgaggatggcaggacccttgctgactacaacatccagaaggagtccacccttcancttgtcctccgccttcgtggaggcatgcagatcttcgtcaagacttgactggcaagacatcacccttgaggtggatcgtctgacacatcgacaactcaaggcaantcagacaaggagggattctccggacaacacgctcatcttnccgggaagnactggaggangccgcaccntgctgactaaaatccanaggagtcaaccngaactngnctcnccttagggaggatgnaatttcgnaanacctcacggcaagacacaannttgggnggatcnccgancattgaaantnanggaagt

SEQ ID NO: 95603 - DNA, 638 bp, Triticum aestivum
  unsure (1)..(638): unsure at all n locations
  Clone ID: PAT_TA_95603
ctcattttcttggcacctttctctcttctcccgctctcccgtttgagagtcggccggtttaccccgcctgccacggcggcggcgccgcccgcagtggggatgggatgggagatcgggtcgctcttgtatataatcggtttaggtctgtacttgcgttagtggcgtctggcctcgtgctgtttgggagtttctcaccggatcaggcgagcggcttccagtggccggccttctcctcctcatactgcctccgtcgacaagctcggaacccaaaggtgcctcgtcatcctagtcaactccagtcaaccgcagttccctttttcctttcatcnatctctaatcgccaataagttgcctggatctacaatgcacgtactggtggctgctgactggtgagtaaatcgggccgcgcaagctatcctttcagtttggttgcctcccgaacnatgantcggaanatgatgatggcnacagtggaaaggataagganattccngatatgggaacccganactatcgnngtgatctggacacaacgttnnngtactcgagttcaaatcacgacaangaattatatcagacncantctcagganatacacggcatggggtataagnggcccaanaatgttaattnttang

SEQ ID NO: 95604 - DNA, 290 bp, Triticum aestivum
  unsure (1)..(290): unsure at all n locations
  Clone ID: PAT_TA_95604
ctcgcatcacccacaccacgcgggcanccggcttcaatttttccatccgctcgccgtgctcttaatgggctttccctcnctccgacatggncggcgacccccgcacccgcgccgccggtganccctcctcctcccccgcgcgtcggnccctccaggctcttcctctacntgctcctcctcnactcgctcttataaccccgngcccacctgngcccatggcngccgtcttctaccaccaggtcgtctgcnattcaccgtcggcaagcccganntcgctgtagctcagcgac

SEQ ID NO: 95605 - DNA, 537 bp, Triticum aestivum
  unsure (1)..(537): unsure at all n locations
  Clone ID: PAT_TA_95605
aatccatttgagcttcacaaaactcgtactccaacgtgttctcctctctcaagtgtgtgtccgtgtggctgaagctgctggtgccacggagcggcgtgagcatatacgccatccgcgtccagatggcgcttgccatcaagggtctgccctacgactacctccccgaggaccccgggtgcaagagcgacctactcctcgcgtccaatcccgtgcacaagacgctgcccgtcctcatccacgggggcaggcccgtctgcgaatcgctcatcatcgtggagtaccttgacgacacattccccggcaacggcgcctccatcctccccaccgacccccaccgccgcgccgtcgcccgcttctgggccgactatatcgacancaagatgttccttcgngcatcggcattccnatntggcaaacagcaggaganagcngtacagggaggaaacttggcgggttcgggccctaaaggcagcttggcggangcccaanattggtgggggggcgccttatgggggngtnccctcggntgctcnaatc

SEQ ID NO: 95606 - DNA, 292 bp, Triticum aestivum
  unsure (1)..(292): unsure at all n locations
  Clone ID: PAT_TA_95606
tcgcctccaagctgccggcggncgacanggaanaagatcgaggatgccatcgatgctgccatccantggntggacacnaaccanctcgctgaggcggncgagttcgaggacaanatgaaggagctggangccctgtgcaaccccatcatcgccaannatgtaccanggtgctggtgctgacatggagggcggcatggacgacnacaccccangctgcgtccggcggccccggccccaagattgangangtggactaancagtcgatgtnatgtngtngnagcacaaancctg

SEQ ID NO: 95607 - DNA, 668 bp, Triticum aestivum
  unsure (1)..(668): unsure at all n locations
  Clone ID: PAT_TA_95607
ctcgtgccgaattcggcacgagctcgcccgccgccgccgcctcctcctcctcctctcggctccttctccttccttccagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtccttcaagtacgcctgggtgcttgacaagctgaaggccgagcgcgagaggggtatcaccattggatattgccctgtgggaatttggagaccaccaagtactactgcaccgtcattggatgcccctggncaccgtgacttcaatcaaagaacatgatcaccgggtacctcccaagctgactgtgctgtgctcancatcgatccaacacggggggtttgaagntgggtactccaangacggcaaaccgttaanagcctccttgcttcaacctggngtgaacanatatctgcgctgaacaagatggtgcacacccaagtatcaaggcgttataggatctcaggaatcctcgactaagaaggcgtnnacctgagaggtcctctcacccggttgggnaaaatantaagggcacacttangnaggccacc

SEQ ID NO: 95608 - DNA, 633 bp, Triticum aestivum
  unsure (1)..(633): unsure at all n locations
  Clone ID: PAT_TA_95608
aaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccgggaggcgagtccatctacggcgagaattcgccgncgagaatncgtccacaagcacaccaacccgggatctctcnatgggccaacgccggccaacaccaacggtcccattcttaatctggacgtccctgcaattgggtccacgggaacacgtgncttcggaaagcctcnaggnatggactctcaagaaatcaaaaggnggtccgnanggactgtcaaaaagtctatcgcgatgnggcantcaaatngccgccgcgtcgcgcgtctatccccgtntcctgtctgcgcntnaaaaaaatcntgcntctcctgcctcnaanntcc

SEQ ID NO: 95609 - DNA, 614 bp, Triticum aestivum
  unsure (1)..(614): unsure at all n locations
  Clone ID: PAT_TA_95609
ctcgtgccgaattcggcacgagccgaattcctcgcgattcctctcccctcgcctcctcgtcctccccctcctaggggatcgccggagaggaatcgcgacgagggcttcctcctatcagttaaatcaaagccatggagcacaaggagaccggctgccagtctcgggagggccccatcctttgcgtcaataattgtggcttcttcggcagcgcggcgaccatgaacatgtgctccaagtgccacaaggagatggcgatgaagcaggagcaggcaaagctggccgcctcctctttcgacagcatcgtcaacggtggcgatgccgcgaaagaacatcttgctgctggcagcacggcggtggcagttgctcacttgaggcgangagcttattancgcacagctgctgatatcgctggtccaagcnaggggcatggcaacccnnaggccagcggtgcacactgagnnagagggccggctgacgganaatgncggtgtggaactgtntgccaagcacgtnctcggaaagacaatgaatnnntacggccgcggcatggcgcatccangnaaccgtgnaagcgnaagttaanatcaggaggnccctaatcgagnnataggcca

SEQ ID NO: 95610 - DNA, 315 bp, Triticum aestivum
  unsure (1)..(315): unsure at all n locations
  Clone ID: PAT_TA_95610
ctagtctcgagtttttttttttttttttttttcacaaacgcacacgtcggngcaaaattagccaataagtagacattaattcagagagatacatacattcatacatcgacggccaagctagcccncgtcggngcaaggagggccggngantgatcagtttgatatggagatcaggaacntgacngcggcnacccggtcgctggacggtgacatgncagtggacgacgttcaaggagtggctccggnggttcgangttnaaccgcgacggcngcatnanacgcgannanctgcggtgcncanancggaccatccgg

SEQ ID NO: 95611 - DNA, 500 bp, Triticum aestivum
  unsure (1)..(500): unsure at all n locations
  Clone ID: PAT_TA_95611
cgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcggtaatnncgagcccactgtgattgatgaagtgaggactggcgcttaacgccagtcttcaacctggagnatttatcnttggaaaggaggatncagccaacaatttggccgtggcattcacattggnaaggaattgttgatcncgnccaaatngaanaggaacttcaaacaatgactggtctgaggatccttgtctaaacc

SEQ ID NO: 95612 - DNA, 671 bp, Triticum aestivum
  unsure (1)..(671): unsure at all n locations
  Clone ID: PAT_TA_95612
cgactgccccgctgtctccgacatggacccggtgaaattgaattctccgtgaagatgcggagtaccaacggctagacggtaagaccccgtgcaccttgactatagcttcgcagtgacaaccttgatcgaatgtgtaggataggtgggaggtggtgacacacaacgaccaatcctgaaagaccactctttcgtctaaggatgcctaaccgccgcaccgatcattccggggggggcgggacactgcgaggtgggtagtttatctgggggcggatgcctcctaaagagtaacggaggtgtgcgaaggtaggctcaagcgttgattctgctcgtgagctaatggtataaacctgcctgactgtgaagaccgactgggtcgaacagagacnaaatcggcatatgattcgggaatcccgtgtggaanggctctcgctcaacggataaaagtacccggggataacagctgatgaccccaagagctctaacgacgngtccttggactcatgtcgatcataaatctgggttnanaagnccaaaggttcgttgtcccnatgaaatggactnagtgggtaaaactntgaaaattcgtcnacacttgggttaaggaantgcagnncacccatncaaggcggnggggancaagntcgnttttcaaanaccgcncaantgttgaa

SEQ ID NO: 95613 - DNA, 170 bp, Triticum aestivum
  unsure (1)..(170): unsure at all n locations
  Clone ID: PAT_TA_95613
accacccttctcccgccgccgcnccgcgangcaaagcaggaggagaangatgccggcgggccacggtctgcngtcgcggacgcgngnnctgttcgngcgcccgttccggnagnagggttacatcccgctcaccatnctacctgcgcacctacaaggtcggngagtacntc

SEQ ID NO: 95614 - DNA, 457 bp, Triticum aestivum
  unsure (1)..(457): unsure at all n locations
  Clone ID: PAT_TA_95614
gttttgggactttagcctcctgcgccgccgccgccgccgcccagcgaattcgacaagcccccgagctcgccggatccgatggccgtcacgttctccgacctccacaccgccgacgggctcaaggccctccgaggcgcacctccgccggcaagacctacatctcccggcgatgggattcaccaaaggacgacgtcaaggtgttccgcggcggtgccccgttgaagccagcgccgattccccgaacgctgcccgctgggtacacaccgtcgccgcggctgttcttcaaggttccctggcaatcctctgggggtgattgatcatcgtcctgctgnactgtccttgccgcttccaagatnaagatacaatataatggttcngtttggcaatanacnaggaggacaagaactgcactgacnttagntgcaacctgcaaagaagaagaaangganctcnctct

SEQ ID NO: 95615 - DNA, 392 bp, Triticum aestivum
  unsure (1)..(392): unsure at all n locations
  Clone ID: PAT_TA_95615
gcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgttgaactaccatggcaagagtccaaggccaacaggttcacggtcatggcagcggaaaacatcgacgagaagaggaacaccgacaagtggaagggcttgccttacgatatctcccgacgaccaagcaggcatcacccaanagggaaaaggnatcgttggctccctctttcaaagcgcccaactggcgaacggacccacnangccgtcctcaactcatacaatacttcanccaagggatccaagaatac

SEQ ID NO: 95616 - DNA, 295 bp, Triticum aestivum
  unsure (1)..(295): unsure at all n locations
  Clone ID: PAT_TA_95616
cgagtcagtcatggaggcgagggttgcagcaggggtgcccgctgacgaggagtccggcctcctcccccgcgcgcgcccgccgccggcagcagccgccggacggaggccttcctcctcctccgcggcnggccccgcgcnttgcntcccccgccggnggtctgggcgacggtggacnggcccctggggatgccgctggaggangcggagggccacgcgcngcgcttcttcctctggggcttcncgtgcctcaccttcntctgggccatcaactgctgctactnctngnccgtctcgg

SEQ ID NO: 95617 - DNA, 609 bp, Triticum aestivum
  unsure (1)..(609): unsure at all n locations
  Clone ID: PAT_TA_95617
aatgaatgaaactcaacacaaatgatggtaataaaataaaattgtgaatatttttatttacgcacttcatccggagggctagaaaaaagaacaaagacgagaaacatcgagagagcatcacttccttctgcgattatgtccctcaaacaacgcttcttggtgcttccgtctccggggggtgtccatagttctacaaatattttacaacatgggcatttattattccaaacatgacaagatatgggatatattaagtgacaaacgttagaactagctagataaccacattaagganccatattaagtggctccnacgctgcttcccctagggtttggggtggctccgacaccttcaagggttagggggtggctcccagaaccttcaagctaggagggggtatatcnacccccccccccaacgtgttnaactatccgagggtccgtgttnaacatannccnagtccaaaangacntggancaacntggcacnacccaaaacattggtcctcaatantggcactanggacccgacctgaacttgaccttgccctaanacctgncccaccnattccacccggcccangtctgaacnctttcaagccactcttc

SEQ ID NO: 95618 - DNA, 580 bp, Triticum aestivum
  unsure (1)..(580): unsure at all n locations
  Clone ID: PAT_TA_95618
accagatgtacaaaacctgacattgcaacttggatcgcaacggctagagagccggtggacgttaaatagccctcgggtgttttgtcacctcaggcatgcgcagatacttttgattatacatcgtgaagatagtgacaaaatcctctacttagtttcttttctgagggttgctccattcaattggagaggttgggaagtacatttcatggctttatactttgtggnttgcaaccggatgggaccttccgagacaagaaataccgccgtgtggaaagataaatatgtgaacctgaaggacttgcgtgttacaggattcaaaaggggnaagaggcaactgatccctccagcatgccgtttgaaatgcccctgcaataaaggccttactgtnnatacantccaaaantnactgagcttggatcnaaacgacnaccctaacctaatangcccccttganaggtaanagctcnccttaaaaancccaccgaagcaaattcactaattaactaaacgnattttttgaaaaagtaccccgaanagttaactaattaattccttaatgtaacgaannacgtgattcctt

SEQ ID NO: 95619 - DNA, 529 bp, Triticum aestivum
  unsure (1)..(529): unsure at all n locations
  Clone ID: PAT_TA_95619
ctaatatctacactacttcaccagggtctttcatctaaaatttgtcgttcaatgattcttgactgactttagcatcgaaacatcattttcgattagtagtatgtcacccgtatacacaagcatcttcttcgtccttaatgaaaccgagatcaatggacgacctccatcagaatgaatattccggactcccaagatgcttgccacaaccataatgggttcccttggagcttggaataccatactacttaatgggtncgacaaaacctcngggcggcatacatgtntacacccccaanttaattcccatggaagaaaagcattttgactgattggggaacaggcaaacaacaattttggccctacgatnacaccccccaaggacactatggaagagcatacaagtcngatggaccnttacnactttaantgttntgggacaagantggcccaaatggctgagaanccccnaacgntcaaaaacatccncnattttanacggaagnnacacccccanggtttaagngtaaac

SEQ ID NO: 95620 - DNA, 378 bp, Triticum aestivum
  unsure (1)..(378): unsure at all n locations
  Clone ID: PAT_TA_95620
tgacacagtcacgagctgcagacatccacaccacgaaatgaagcttcaggtagccttcttcctcctggtgaccatggccgcgacggcccgggccgtgactttcgacgcgtcgaacacggcgtcgggcaccgccggcggcaagcgctttcgacaacgccgtcggcctcgccgtactcaaaagcaagcctctcccgacgctccaactttcatctgggagacttnaaaccaacgcgccgctgccgaccgnaanctgtncnacgccgttacctcctccnngggaggaatcnaagggtcccctttaacaatggcnaacggatcaacttaaanggcaataatttngggggtaaacgccgggaagttnaaaaaggggggtaccgg

SEQ ID NO: 95621 - DNA, 630 bp, Triticum aestivum
  unsure (1)..(630): unsure at all n locations
  Clone ID: PAT_TA_95621
ctcgtgccgaattcggcacgagcctcctagcaagctatatacctacatagtacagccatggcccccaccgtgatggcctcgtcggccacctccgtcgctcctttcaaggggctcaaagtcaaccgccggctcccgtcaagccgccgctcaaacgggcgctaacctccggnagcgtcaanaaacggtggaaggattanaggtgcatgcaagtgttggccaacccaagggaacaaagaantntcnaacctttcctaacttgcaacgntcaaacaacggagcctcccttaanaagccgactacttgattccgtccaaatgggngcttgctccnanttaaacaaggtggnttaacttccctntganaaaaagcacccctggggaataacaatggccggnaatggacatttggnactcctaagtttggancacnacgcaccaagtatnacaagtggaggaggcaaaaaggtacctganccattccgataacggtntaaaanatctanggatggtanttacgcttaaccacgggntcaagatcggangcaaaantaacacaangcattaaatgcatgatttgaccgaatgttggttccncaatactnntttcaaaatttncnttattaaaggcnaa

SEQ ID NO: 95622 - DNA, 617 bp, Triticum aestivum
  unsure (1)..(617): unsure at all n locations
  Clone ID: PAT_TA_95622
gggctgcnaactgcgtgctcaaacttggggaaaactggtggcaagggagcgcnacgccgcggctcctgcgggagcaagcttggaggaaggcaaaaggccgagctcgccggcggcgaaattgggcggccggacgttggagctttgagaaaggcacagtcccgagctcgctgcnggcggggagcggagctnggagaaagaccaaagccggactccgccggccggttggaggcggaggttggtgaaagaacgaaaggcccactctccgcgtccctttgtggaggcttagctccncccgcngcaaacaagccggcgggaggccgtnnaagacgaaagccccacgcctnccgcctnggaagaggttgtgnaagaccaaagacactccccccccccggaggcaacttttgcaagccaagccactcaccgcggcnaacccccnccggaaccgcttgtgnaaactnaagcaacttcccccgtnnnagccgacttnaaacnccaaagnggaacnntaacancctggctccangacaatncccaaccccgnagaccctgagggtaaacgtggcaagtataacnccgntgcctctcctatacttcccctaaggccttttgatttanaa

SEQ ID NO: 95623 - DNA, 470 bp, Triticum aestivum
  unsure (1)..(470): unsure at all n locations
  Clone ID: PAT_TA_95623
ctcgtgccgaattcggcacgaggagaaaagcagcgagacgcgaatcaacggcggcgatggctctcccggcgtccagctccaccctctcccgcttcctctcctcccgccgcatccagcccacggacgtcaccgccctcgccacctggggcatcttcgccggcagcgccgccatctacctccgtccagccatttgactggttaaagaaaacttccttcngaagaancccganctggaggcataagtgtccaatggggggtgcacggctacagtttttgatgcnacattttccangatgatctcccggantttgggcaaccaacccaataatatacaaacctccgtgatccttggttgatttccatcccagngtagttccnccttggnttgcatgtacctcaacaatggaagggatgatcatgtattatttccccnccnnaaaggaaaacnngttttgtttaaaaaaaaaaaa

SEQ ID NO: 95624 - DNA, 413 bp, Triticum aestivum
  unsure (1)..(413): unsure at all n locations
  Clone ID: PAT_TA_95624
ctcgtgccgaattcggcacgaggagatcccttctccgatcatccttccccacttgccttgctttcacgcgacgccaatgcaagtccgccgccgccggtcaactcggccagcaccggcagccatggaatgacatcgcacgatccggttcttgggctaacatgttcttgcctgtacacggcggcggcggcggccggggtcaggcggngctgacgtgctggtgcgggaaccgcggggtgggcgcgaccccgaccgcgtcctcaccgtcctccttcatcttgttcagccgctcccctatggggctgtcctcgaanagccgggaacgggggtctcgngagtnacanacttaataacangccaagcacgcctgcgggaagcgcaatccaatccgggtcatcaaggtacccaagttagaa

SEQ ID NO: 95625 - DNA, 443 bp, Triticum aestivum
  unsure (1)..(443): unsure at all n locations
  Clone ID: PAT_TA_95625
ggcatcctcctctcctccagttaatagaataccatggcccccgccgtgatggcttcgtcggctaccaccgttgcacccttccaggggctcaagtccacagccggtctccccgtcagccgccgctccagcgccagcctcggcagcgtcagcaatggcggaaggatcaggtgcatgcaggtgtggccaattngagggcatcaagaattccgagccttgtcttacttgccacccctctccacggaancctccttgaagcaggcgactacctgatccgtccaantgggtngccctgcctcnaattcaagnaaggttggttcgncttcccgtgangnaaaaantcccccngggaacnacaacggtcnaatacnggaaatttggaantgccaantttgggttgaacnaaccaanaagggncaacaaggtgangaagncaanaagnttcc

SEQ ID NO: 95626 - DNA, 553 bp, Triticum aestivum
  unsure (1)..(553): unsure at all n locations
  Clone ID: PAT_TA_95626
ctcgtgccgaaagcatttcggtaccagcaacatagatggtcatgcgggccggcaaatttgttcaggaaaatggtgatggagatcattaaaaataagaaagtgacactttggnagaaaatccatgtggtctacaacttcttctttctgcgcaaggttgtcgcacacattatgacctttgtgttctactgccttgttatcccggccacggtcttagttcccgaggttgaggtaccaaagtggggttgcgtatatattccagctattatcacccttctcagtgttgttggggactccaaggtctgttcacttagttatcttttgggcactatttgagaatgttntgtcattgcatanaacanaggcacttcatcggtcattggggggcacacacngngaatgaatggggtngtgacagaaaacttggtgacactgngaagactanatgccaantaaacttngaaaactgaagaaaggatangagaaagtcantttgganctggngttcaccactctcattgcggngcatacattattggaaaacatactnacctcc

SEQ ID NO: 95627 - DNA, 596 bp, Triticum aestivum
  unsure (1)..(596): unsure at all n locations
  Clone ID: PAT_TA_95627
gtatttttgaggtcaaggccacagctggtgacactcaccttggtggggaggactttgncaaccgtatggtgaaccactttgtccangagttcaagaggaagcacaagaaggatatcagtggaaaccccaggtctttgaggaggctcaggacttcatgtgagagggcgaagaggaccctttcttccactgcccaaaccaccatcgagattgattcactcttcgagggagttgatttctattccaccatcaccagggccaggtttgaggagctcaacatggacctcttcaggaagtgcatggagccagtgcgagaagtgcctgacggatgcnangatggacangagcacatccatgagtcgtgcttgttggtggtccaccagaatccccagagtcaacagctttgcaagactcttcaancggaaggactctgcaagacatcaacctgatgaaccgttgcctacggngcngcgtcaagctcatccccaatgttagggacnagaagggacngcttccctcctgngtcaccacggctctggctnanatgcggaggncangatgtgtaacaccggaacacatccacntaagngagctccact

SEQ ID NO: 95628 - DNA, 431 bp, Triticum aestivum
  unsure (1)..(431): unsure at all n locations
  Clone ID: PAT_TA_95628
cncgtgccgaattcggnacgaggcggaatcttcctcnggcttcnggattgnctttgncaaataagatnaagcngtacnacnacgctganaccnatgaaatgggaaagatcggnatctctcggnagtatgatatatacaaggttgtacatgccatggatgaagtgatcnacggttgggtacatattggtgttttaaactaagtatatatcccttgtgtcggtgtccgtaggcgataactacagcantgcantgcggtgcanacntaccaacaacaaaacccacaanactttaaacgtccttttttggggcanacaagtttagccctggggaaatnacaaagattcccttattattttccntttggnaaangnccgtaaccaaatcctttgcttttgnagagttnnaatcaangnatgcaantttnagcgcca

SEQ ID NO: 95629 - DNA, 444 bp, Triticum aestivum
  unsure (1)..(444): unsure at all n locations
  Clone ID: PAT_TA_95629
ctcgtgccgaattcggcacgaggccttccgttcggccgtcttctgcccctccgatttcgccatggacagcgccgccccgaactcttcctcctccgccgccgcaaccgccgccgtcgtagcggctgcggccgcttccggtaacggtgtacaagggggcgaccgtccggaaggacccgtccgaagcaagaacctggggcaaggtcaacggctccgatnccaagaaggaccctgggcctgctccaccaantcaactcaactctcctccttnaantccgcgtcccaantcccctcctccaacgcctgnaacccctggtggcggactcganacatgaanactccccnaaggggaaatcaagtgccatgagtctcatttgatcnatgacgganaccngatanttacccggactgtaanantcatcncaagacagttacaanggaaacgat

SEQ ID NO: 95630 - DNA, 435 bp, Triticum aestivum
  unsure (1)..(435): unsure at all n locations
  Clone ID: PAT_TA_95630
gtcgagagagatgcagggcggggtgagcgcggcgggcgcggccaaggaggcgggggcgaacctgggcgcgtcggcgtgggcgggcaaggagaagggcatggccgtggtgcaggagacggtggagaaggccaaggcgcacgacgacccggcggcgcaaggcggaggcggaggccaaggaaggaggagcggtcctcgaggtggaggccgccaagcaaggacgcctacccgccgcaacgccgccgtcgccaaaggacggcgcgccgccgccgtcntcaaaggatgagaaaggagcggcccccgacgacgagctgagccttctccgcctgacatcccttncggaacactcctcccatatttcctttgttccattcactgtacttatggtatgtattgtttggatgctgcttcatttggattatcctttntggaaaaaaa

SEQ ID NO: 95631 - DNA, 578 bp, Triticum aestivum
  unsure (1)..(578): unsure at all n locations
  Clone ID: PAT_TA_95631
ctcgtgccgaattcggcacgagctcaagatagaatcatacttaagtgcttgttgacatattatcaacagggaagttacattgccggcttccaaatatgaacaaacataaaaggcctgaaagcaacacggccattaatgccgatncatcctaagcctaacttgggcgaaggacatcccccgaagaacatccttgggctcccccttaatactcctcgggctcccggtgggtccttgatccttgggtgcatggtcnagcccctcccaagggtggcgaaanacttgccggttaaggccttngaggccttcttcccctcccttgggnggccttggaggaaaatgacggcctttaggccctaacgcaaggtaggaggcccttaggcggaggccgttnaatgaacttacggnatgcttccttgtccaataacggtttaggtttnggattccttggccatcccttggccgnacgccgctcccnccggtggaacggtgcaaggtanacggtcttaangggaagccaatcctgcccctcnaatgtcgtccggtctgccaattttcaaaaannggggcgnccatcccaa

SEQ ID NO: 95632 - DNA, 572 bp, Triticum aestivum
  unsure (1)..(572): unsure at all n locations
  Clone ID: PAT_TA_95632
agccaatccaggagcgccgccgagccctccttcctcccgatcgtttctccccaccaccaccaccagccgcaaaaagaaaatgtgcggaaagggccagaacaacgggctcgcgtcgccggcggggacaagcagcacggcgaccgccatcgtcgtcctcgcgtcgctgctcctcggcggcctcggtcgccgctttctttctgtcgccgtcgccgtcgccggcagcggacgagaagccccctgagcctgttggagtcgccatcnggcgtcgccgggaacgagggctgggctggacgcgctcccgggcgttgggcgaactgggttcctcaantccgcccggttcnagccaagtgtnatnctgaagactccggggtccatnaaganggngccaaggcaaacctngcgatgggcaangagccnttggananacgcgtgtccggcgcnaaggcgcccaaggaacaatcggggagacaacnnaaaggtaggaggaggcncgggggnccgttgcctcgggcaanccccaatggaactgnnttgataagtcaccaagccaaaattncancttnccnccccat

SEQ ID NO: 95633 - DNA, 661 bp, Triticum aestivum
  unsure (1)..(661): unsure at all n locations
  Clone ID: PAT_TA_95633
ctcgtgccgaattcggcacgaggtgggacaccataatggtgtacaacgccggatatgaagtctatcactggtctggcttcggcccttttaaccggctttgcccctatccacttagtgaatttatctaccatgactagcagatattttttattatggttccccctttgagaggccaaccatatcaaagccccaaagaccgcaaaaggcaagtaatgggattgttgtaaggcagttangcggatatggttttgattggcgaaaagtggatcccacgcaatgttggacaagtcctatgcatctgtccgggccgttcggccaanaagaaccggtacagaangcttgctttacaagacccaagctgcngcgttgggaaccgcccagacatcaaggattttaaccnaaaactgccgccttcttattcaagaataatccttntaatatccnggaatanctcctggnaaacccctcaanaacttgtagntttcaacgccnacaatgntccagccatctggncccaanggnttccgccnataaggnagcaanaaggnttgncatggggaattatgcaatatagggtggccanggggttnttcgtggnacccccatanancgaattgttcgntctgggaaacggtcgcaagttncgcccncncaanaagtg

SEQ ID NO: 95634 - DNA, 578 bp, Triticum aestivum
  unsure (1)..(578): unsure at all n locations
  Clone ID: PAT_TA_95634
gtttctatccacatcgatcgtagccaagttccaatatgcacactcagaagggtctcttgagcgccttgaaatccagcgtgtcgatgcactcggcgccgtccctgggatccattgaggatcctgagcagctcgctggcccgctccttggtggcgccctccgcagcccacctgcagcagcaggagcagttcctgggaacgccgcccgacctgcagcgcctccggcttgcacccgccgcctcccgccggggagtcttgcacagccgcaacangccgacacngcaatcccntcccatgtcccacacttctgatcttcttcacgattaaccggacggcangcctgcgcgtagcctcctcncgccttgctttttnangagcagcntcaancaaggcaangctttcctncgcccttnttcgggtccacaacantccaggagacccacgccccaagccaacagcaagaccngcancgttnctgacaagtataccgncacaacccccttggtggctgggcaaacggttccaaaantgcaacccctaatncgtgnctnaaanccccccnggggcgacaatcccnaaga

SEQ ID NO: 95635 - DNA, 635 bp, Triticum aestivum
  unsure (1)..(635): unsure at all n locations
  Clone ID: PAT_TA_95635
ctcgtgccgaattcggcacgaggcggtggatacctaggcacccagagacgaggaagggcgtagcaagcgaccaaatgcttcggggagttgaaaataagcatagatccggagattcccaaataggtcaaccttttaaactgcctgctgaatccatgagcaggcaaagagacaacctgggcgaactggaaacatcttaagtaccaagaggaaaagaaagcaaaagcgatccccgttagtagcggcgagcgaaatngggagcanctaaaccctnnaaacggttttgtgggaagagcatacagcgttgtctgctaagcgancggttttattccgcaccctaaatggttaancccatttnccgaagatcactacttaancccttancccnattanatggaactgaacccctttnatcaacaagcactttcnagntaancccctgggtaccgtaccattaacctttaggaaagggaaaaacccatgggtagtgaataaactgaacgtctgacccaacatggagggaatgtcnnacgctgctttaaataccggancatagatngnttgtaggacgnccacgncttcaagntctaagnatnctntttgcccancnggttnacatcananttgaaanaaagccn

SEQ ID NO: 95636 - DNA, 625 bp, Triticum aestivum
  unsure (1)..(625): unsure at all n locations
  Clone ID: PAT_TA_95636
ttctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggccttctccggggtccgacgtctgcgacgacgcccaccccaagtgccccaagggtgctccggcgtgccgcgtggtgtccgacganccccgaatgtggcgctgcgccggatatgaatccaccgttcgacggaccttgcggtgggccctggcaagaantactgatncgtcatccacatatatgttccgcctaaaaatgaataaantcaaacgaatganantcatcgtgcctangcctgtgtgtttgggcaacaatatnttaccatatcctgtcttcctcctgtttttncnccccangggggggccggtaccattcccctaanangancgtatancgcctantggcgtnntttaaactcntganggaaacctgngtaccaactaacgcctgaaaaacccctttccactgngtanacaaagccgaacgttccttcaaattcacctaagnaatgaccccc

SEQ ID NO: 95637 - DNA, 304 bp, Triticum aestivum
  unsure (1)..(304): unsure at all n locations
  Clone ID: PAT_TA_95637
ccgcttcccagcgtccgtgcgtccgtcccgcgaaaggaatactagtcgctcgacctcatcgatggccgtccggtgtcacgccgctgctgccttggtctcgtcccgagcgcgcctgccttcctacctcccgcccctcctcccctccgcgcgaccccgacccggcacgacccgcggnggcggctacaggcggaccgccgttcgcgccatgggcgccgcgccgtcgtcnncttcgccgtccggacaggccncagggaaagnggntaacgcatctctgancgacganngagttgaanaancgctcata

SEQ ID NO: 95638 - DNA, 482 bp, Triticum aestivum
  unsure (1)..(482): unsure at all n locations
  Clone ID: PAT_TA_95638
gaagcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccganaacggcggctgcggctgcacccagtgcaagtgcngcaccagctgcggctgctcctgctgcanctgctagattcatcatcgatcatgcatgcaccgtgcctngcgtgcatcatcgattcttcgatntactactaccatacaatgtaaccgcaactgatcaaggcctttatttagcacctgactgcatcancatcaagtgcatccatgattgtaaaaagccccctaaataaaccnccttgattanttt

SEQ ID NO: 95639 - DNA, 254 bp, Triticum aestivum
  unsure (1)..(254): unsure at all n locations
  Clone ID: PAT_TA_95639
ctcgtgccgaattcggcacgagccccgctctgttctcctctcctctgctctgcttcttcttcctgcaagagacttgaccgatcgttcaagcaagcgccgaggttcgacttgatcgcccgagcagggacgccaatggaccatctgctgcaccacgggcacgagatgaggaggccgtccgtgcccagccacgatgcggcgctgaggtccgtccagaagccgccggccaagccgtggcgcgcggncgccggnttgac

SEQ ID NO: 95640 - DNA, 200 bp, Triticum aestivum
  unsure (1)..(200): unsure at all n locations
  Clone ID: PAT_TA_95640
cccgctttcctcnccctcncgccgnngccgncgccgccacctcntccgnantcantccaccgtnaagcgaggtcgaatcanccatggcggacgccatgaccaccanggctggtcancctccgtanccgcattgttcatgaccaaccgnctgctcacncgtangcagttcgtgctcgnngtcatncatccacggctgctcc

SEQ ID NO: 95641 - DNA, 554 bp, Triticum aestivum
  unsure (1)..(554): unsure at all n locations
  Clone ID: PAT_TA_95641
ctcgtgccgctctcctccgataatacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaagttcgagaccctgtcttacttgccacccctctccacggaagccctcctgaagcaggtcgactacctgatccgctccaagtgggtgccctgcctcgagttcagcaaggttggcttcgtcttccgtgagcacaacagctcccccgggtactacgacgtcgatactggacaatgttgaaactgcctaagttcgggtgcacgacgccacacaagtgctcaacnagtggaggagtcaagaaggagtacctgaccctatgtcgcgtatcggttcacaactgcgcaagtgcatgcgtaactnatcccttaagcacgggtncaaagatccggnaaggctaacanantgaanatggcaac

SEQ ID NO: 95642 - DNA, 635 bp, Triticum aestivum
  unsure (1)..(635): unsure at all n locations
  Clone ID: PAT_TA_95642
gccaatttctgctccggaattatcgcgacgtttgctgtgggcagctctcgtcgctccgctcgccgctgtgctctaccaattcccgatccacgccctgtacacaaaggccgtccccgccaccgccgccatggacgccggcgccgagctggagctggagtacgatatgccgggcgtcctgcgcgtgcacaagagcggccgcgtccgagcgcttccgacggcgtccgaaccgtcccncctccccctcccggggaccctgccaacggcgtcgttccnaagacgtgggccttngacccgcggccaaatctccgcccgctctactccctccgccgtcgccgccgccggagcccgcaagattcccgtctcacttcttccacgggggggcntcttctcnanacgccgctcccgctctacaaaaggacgccggggttcnacgccgtggaggnnctgcagcggatttgggccgacaccttnacaaccggnggncccggagatgnaggaatcggaacgnccttctgtcacacgnggacatgcggttctgacggcnccctaccgagggatagntnggtggacgaanccattcaagcaaggnaggnatttattntcataanccaantcttaggccccagggggttttt

SEQ ID NO: 95643 - DNA, 515 bp, Triticum aestivum
  unsure (1)..(515): unsure at all n locations
  Clone ID: PAT_TA_95643
ccaaaccctagcctcctcctcctctcgccgccgccgccgccgccatgtcagggaggaagaagacccgcgagcccaaggaggagaacgtgacgctcggccccgccgtccgcgagggggagcacgtcttcggcgtcncgcacatcttcgcctccttcaacgacaccttcatccatgtcacggatctgtccgggaggggagacgctccgtccgcatcaccggtgggcatgaaggtcaaagtgattctgatgaacatcccctttatgcaagctatgcttncatctccangatgtttctgtnagatgttaangagcttgggattactgtctggcacattaactcccttctactgggtgggaaacaagacaaaatcccaagtcctggtgtcnaacttgccttaaantccttgcacttccgggatgnaaattggaccatntaggatttacccgggcccaatgananacccccggaagtgaatanagaaangagtgtnatccaagcccntaaaggatggacat

SEQ ID NO: 95644 - DNA, 676 bp, Triticum aestivum
  unsure (1)..(676): unsure at all n locations
  Clone ID: PAT_TA_95644
ttataataaatcaacctaataaatgtagatcgacatgtacatagctagcctttttgtgtggaaaatagacgtagttagcctgatccagtgttggaagggattacatacgacctacattaaacaccggtgaacaacacgtgatggtttgtgattgatgaaaagatatttataaggaattatataatggaggaacaattgcaagtagcataaaaaacgttaagaaactggaggtcacaaagatgatatattgcaaaagttaaattaaggtgcgaattttttccttatttacatgaaccaattttgtgccaccaaaaaagntaccttacctctcctccctttttatgatgagaagcagcaccagatgcatacattttacaacactcctgcatgagttaaaagtccctgggcatggcaaatatatgttaaaaataacccaatgtgttaanggtatactaccaaataacaccncattgacaagcatttacnaagcaancttaaggtccaagaattganatgtgttaaattaaaatnaacccganttcacttancncagtnacattgagtanattcacataacctaagatgtgtggcaatatttgtanccnttganaagntaccganaaagangatgtaaaggatcccatggaagttacccgaggccacttnaaggnggtta

SEQ ID NO: 95645 - DNA, 624 bp, Triticum aestivum
  unsure (1)..(624): unsure at all n locations
  Clone ID: PAT_TA_95645
ctcgtgccgaattcggcacgaggccagcagcaaaagaatcgcgaggagatggcggcggcgacggcgacggtgcaggcgcagccaggactcgacgcgcgcgagtgggacgaggcggcgtaccggcggggcatcctgcgggagcgcgacctctcctgccgcaccctcttccgcgccgtcttctacgaccaagcgcgacgaacccgacccggacgtcctcctccgccgccgcctccagcgacggtccctccgcgtccttctccgctgtcctcctgcatcgcctcctccggcctccgcccacgccgcccccaagcggccgccgccggcgctggtcgacccgtctgcatcgtccaaagcgcatacggcccgtctacacgccaantctacaacattccattcaancggtgtcttcaactgcnggttnacgcaattccggttggagatggacnaatcaaactgcttctgcatctctcngcaagganattttnacaatattatgggtaactaacatgaagctggggtgacgttcaatacaagaatatcattgaattacaaacaggtggttctttcnacaaggtgatcngtctatctggatttgaantgaattaatgccttagganacgcaat

SEQ ID NO: 95646 - DNA, 555 bp, Triticum aestivum
  unsure (1)..(555): unsure at all n locations
  Clone ID: PAT_TA_95646
ctcgtgccgaattcggcacgagaagagcctgaacttcctacgatccccaaagctttggcccccggtatatggccgccgccgcccgccgcctgctccggtgactggattcggtcctctcgtccccgaagccaccgccgacaagccttcaacctactccctccgccgtcccgtctaccgcgtcctcccgccggagcccacggaacgcctcccccgcaccggaagcgccccaaagccccgaccgacggcaagtgttgccgcagcgctgtcctgtacgacattatatatcccgtgggttcaacnaacctcaaaaggaaccgtccngggacatgggcatgaccgttgcgggagggcgtctcccggcaagacaaggtgaanaattccaaatttccnttgaccggcggtcaagcctgacttnttgaacgccatcncccaacgtgatacttgttccaacancaanaatttcttggtntgaanaaagaatcnaaatttngaaaagatggtgtaacaacagcnnccaaggcatctgggnaaangttnatcaagnaaaatgccggc

SEQ ID NO: 95647 - DNA, 278 bp, Triticum aestivum
  unsure (1)..(278): unsure at all n locations
  Clone ID: PAT_TA_95647
gtaaagcaaaaggtcacatatgacacagtttgatgtatggaaatcatgtaagaatcactacggagtacttcacagcagaaagtagtggcatcacgggttcaaaaaagagcacattttcttagtccaaatgaatccattgngtgagataggaagaaagcagaggagcattgcatctaggagacagtgctaacaacccaagtggaaataatcatgtttaatgcacaagcagtactgggtccggctgcatctaccctatgattctgtactatctcataagg

SEQ ID NO: 95648 - DNA, 681 bp, Triticum aestivum
  unsure (1)..(681): unsure at all n locations
  Clone ID: PAT_TA_95648
ctcgtgccgaattcggcacgagatcctcccgcgtaccaagccaccgaccaacatggcagcgtctctccaagccgcggncacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcngagggggcgcccaagaggctgaccttcgatganatccagagcatgacctacatggangtgaagggtaccggcaccgcgaaccantgnccgacatnnacggcggcgtcgatcctccccttcaaggcgncangtanacatgaannagtctgcctggagccactcctnaacgtcaaggcnaaggatcaanataacnancgcggcttcaaaagacaaantaagaccgtctaactaaaccttgacganatgaaggccgctcaagttgnnganggaacctcanttcaggaaangaggacnataccgncgtacgtgantccgaggnattgctgcctctctaagtcagaantgccacggaancgnantacggcntctngcacaaggtntctccacaagnn

SEQ ID NO: 95649 - DNA, 468 bp, Triticum aestivum
  unsure (1)..(468): unsure at all n locations
  Clone ID: PAT_TA_95649
cagggaagttacattgccggcttccaaatatgaacaaacataaaaggcctgaaagcaacacggccattatgcggatccatctagcctagcttggcgaggacatcgccaagaacggtcttggtctctccgtagtacttctcggcctcggtggggctcttgatcttgggctgcatggtcaacccgtccgagggtggcgaaagagttgccggtgaggccttgaggcctcttttcctccttgggtggcctggaggagatgacggcttgaanccctagcgcaagtaggagcctccaagcggagtccttcaatgacttacggcattgcttccttgtccaatnacngtttangtttaggatttccttggccgatccttnggccnggacgcccctccccngtgggaacngtgcaagttaaaccgtctttaaagggcaagtcnaanccttncctctccggatttcccttcccgggga

SEQ ID NO: 95650 - DNA, 225 bp, Triticum aestivum
  unsure (1)..(225): unsure at all n locations
  Clone ID: PAT_TA_95650
ctcgtgccgaattcngcacgaggttcangcaacgaagagattgcacgtgcattgcgcattgctttgcttcttgncaacaagtccatacagtntgtgaancaggtctacacancatctgacgatcttgtactcannaagcaattctcatacatcattgcacgccatggtttgnccanggagattgatgatgngatanctgcatatgaaaatgacaangaaatgttg

SEQ ID NO: 95651 - DNA, 609 bp, Triticum aestivum
  unsure (1)..(609): unsure at all n locations
  Clone ID: PAT_TA_95651
ctgtccgcacctctcgccgctccgcgcctcctcctcctccgtcctcccccctcccccccactcgcggtcgcctctcccgatagatctggtgccagggttcgcggcgccggcggacgggggagcggagacgcgtgcctgtggccnggagggagattggggaaaatccgcgttgggcggcctcgacgagcagattnnagcagtcctgcagtgcaagccctccgtcgancccgattnaaacactgtgttagaaagtaaagaattttgatggagganacatgttcancctgttagaanctgtcaacatattggggatatcaaggcatttaanatcttgnnggaatattnaaatttgtggaaatttcctgananaaatactatttatggaaaatanttgacgnggtaaaatccgttnaaacgtannttcngggaactttaaattcnttanccgnatnaattaaatcttaannggaacaanaaaccggaattaaccaatttanggtttanaanatgccaaggaatttggaatnnaagttgaaactcaggttttttncaattacntgaaaaatgnttatcgaaaatttctaanggggntaaaacanaaanttnaat

SEQ ID NO: 95652 - DNA, 371 bp, Triticum aestivum
  unsure (1)..(371): unsure at all n locations
  Clone ID: PAT_TA_95652
cttctcctccccttccggttcgggttctggttcggttcgggttcggttcgagagagaggccgagtanctagcctantctagggtttcggtaganaggaagtgagatccatggnggagacggagtaccgctgcttcgtgggcggcctcgcctgggccancgacgacaacaacctccancangncttcagccantacggcgagatcctcnacgccaanatcatcaacnaccgcnagacggngaggtcccatgggttcggcttcgtcangttcggnagcgangagtcnatgcgccaggccatncaagagatnancggcaangagctcnancggcgnaanatcagcgtcaacgangggcagcccggcngctccgg

SEQ ID NO: 95653 - DNA, 556 bp, Triticum aestivum
  unsure (1)..(556): unsure at all n locations
  Clone ID: PAT_TA_95653
cttggagccatcggaatcattgtttttcaatgttgctgccccagtgtggctgctgccttgttgcttgccgaagaggaggcacagctttggggagtggctgggactcgagagctttcccttgtgagcgccctagcgcccagggctttggttatctgtagtcctttgttctttttcaaggcacgggtgagtactgtaacctataaaacatatggaatgtgtgtgtgtgtaccaagggttctacccttccctcctcccctaatataatggataatctcccngcttatcccnagaaaaaacaataattacagcttgaacccgtgttatggtaccacaaacaggccaataacttacatccatactccctttaaccatgcaagcaaactaatataatgttaccgatccgttagnaaaaggttccaataacnatgccaaangaattatgggaatccnatgccttgcggatttcaccatntttttgatacctaacctttaannaaccattaaggancgccttttttnaaaggggccgccccgaattactacgtngccaaaacgg

SEQ ID NO: 95654 - DNA, 684 bp, Triticum aestivum
  unsure (1)..(684): unsure at all n locations
  Clone ID: PAT_TA_95654
ctccactcgagtatccagcaaagcaccatgcctagtctggtctggttgtgcctcctcttgatactctctttccatgatggcgttgctgccatcgaccagttcttatacaatgggttcgccggcagcaacctccacctcgacggtgtggcttccgtcacacaggatggcgtccttactctaacgacgagtgcttacaacatgcagggacacgctttccatcccgaagctgttcccctgggtcaattccaatggggagggcgtgagtttctccgaccactttccgtgttccgccatcacgcccggaccactacggccgttctggcgatggggatgggattcgttatctctgtcacccaagactgtccaatgcattccaaagggcatacttggggctcaccaaccattcgagtacaatctacaagcgtttcctcgccgtagantcgacggcgtccaaaacttgantccaaagatacgacagtacaagtccggattgtctcaatanctgacgtctgctactctnaacgcgggagactatgcgtgcaanctcaagggtcaagnttcaatgggaaccgatcagnatgggtgacatgcactcaacaacatctgantaactncgttgtccangtcaaccantncgcaagtctcacncaacccnactgngatttggttgtacgtgaacaatan

SEQ ID NO: 95655 - DNA, 419 bp, Triticum aestivum
  unsure (1)..(419): unsure at all n locations
  Clone ID: PAT_TA_95655
gcaacgcacgggcagtcttttccagtaccaattccaacaacagataatgatgagttctatcttaagctaattaggaggttttattatcacgcgctggcctaactaatttgctgttgccggtcgagctccgtaggaaggtaaccagcggctctgcatatanggaaagggcgtgctcgggtgcacgccaagcgatccatcangccgggagatccttgggcttgtcgggccctccggggcgataaggggcgatggcatgggctcccaagaacaacngcagaactcntcctggatgaattgtaatcccctgcatgcgttccacatttttngcaaggttggagcccctgcatngcccggagancccccttngcnaaaanggcttgccccngnggnacacttgnnatttccgggntcccccaact

SEQ ID NO: 95656 - DNA, 253 bp, Triticum aestivum
  unsure (1)..(253): unsure at all n locations
  Clone ID: PAT_TA_95656
cctatatggaaatgcccgctaaagagaaaatctacttgattgtctcncggacaatatcgatttttanaaagaaantncaanaattttctncnttttttantaacattaagaaaaangaanataacnaaaatggcattggnaatataatttttatacgacntttgaaagaaaanaaaggggtttntttgcaaccactnacttcttacattcttgcctatatcatatcacggcnaanctntcgctttggaacgtg

SEQ ID NO: 95657 - DNA, 208 bp, Triticum aestivum
  unsure (1)..(208): unsure at all n locations
  Clone ID: PAT_TA_95657
ctcgtgccgaattcggcacgagatttattggcataactcgaattcgtctgtacanttcntaaaattctttcttaattcttantgttgatatccaaaattaanagtctcttggntctcttcannctttctcacanacagattaaaagatanatttttanttttgaagtttgnataanccattgcttcgnctggtgtctacantacatat

SEQ ID NO: 95658 - DNA, 536 bp, Triticum aestivum
  unsure (1)..(536): unsure at all n locations
  Clone ID: PAT_TA_95658
cttcatcttcagcattggcggtgagagcagcagcccctggcatctccataggggagcagaaggatggttcggaatggccggcggcaagagctactaggactaggagcgtggcagacatggtgcggnagatgccagtggtgtacaccagcgggctccgcaacggcgagaggatcgacggcttcctgtaccagtacagcagagctgaggaggtgaggattgtgtgtgtgtgccatggtancttcctgactccggcggagtttgtggcgcatgctggangcggcgaagtcncccacccgatgaggcacatcntcntgaaccccccgtcgtcttcgctctanaccggcncncgcatgcatgcangtggtcaagtgctccgcgtgtggcttcagcaaccctangttagcttggaactnaaatctcatcgtgagactgcatttngttttacancctgacatcanagtntacttttancnaaactaaagacatgtggganattgccccncatccaataanttcagcatatncanttgaccatc

SEQ ID NO: 95659 - DNA, 642 bp, Triticum aestivum
  unsure (1)..(642): unsure at all n locations
  Clone ID: PAT_TA_95659
ctcgtgccgaattcggcacgaggttgggatgggttcttgttccatttatttgcagaaagacgtgccagcatttgggttaacagttgaccgcctcaaaggcgtctcaacactatcaggccaacgtcaagggctctataatactatcaaagttttcatggcggggcattacagttttcatgttaccgacatctattcaagtcggatagacgaaagaaacattcatgcggcatttcttggaatggccatcacggatcaaccaagatgtgaaagtgctaagaagaaaaggtcaagctatgcttgtggcgataacagcgattgcatggatgtgcaatctggaggctactcctgtcagtgccgccctgggcacaaacgaccacaatccgtaccttacagatgggtgtcaactacagcgcaatacaatccaatcataaaggaggttcacaaaatttgcgggaacacaatatggagtcccttttgggcttgaaaaagtnctacccgctgaaaagttcgacttactgtcatcagaaacacacantcttgatcanggggtacatattaagaangngcaaataatgtggcacaatnatgatgaggtactacgtnggaacaaaataccagnatggaagaaacccgnaaagnntg

SEQ ID NO: 95660 - DNA, 608 bp, Triticum aestivum
  unsure (1)..(608): unsure at all n locations
  Clone ID: PAT_TA_95660
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcangtggactacctgatccgctccaantgggtgccttgccttgagttcagcaaggtcgggttcatcttccgtgagcacaatgcgtctcccgggtactacgacggccgctactggacaatgtggaagctgcctatgttcnggtgcaccgacnccacacaggtgatcaacgaggtggaggagtcaagannggatacctgaccgtacgtccgcatcatcggatcaaaacatcgccaagtgnatgctcactcattgcctnaagcaacgggnncaagatcggaaggctaaanantatcacacgggcanattaatgcatncattttnaatcgaattcttggttcctccaatgcctctatgtccaa

SEQ ID NO: 95661 - DNA, 367 bp, Triticum aestivum
  unsure (1)..(367): unsure at all n locations
  Clone ID: PAT_TA_95661
ctcgtgccgaattcggcacgagggaggggcttcagggtgtccgcggtggngacngnaccccgcancccggaggggancgncgccgaanantactantccgtncttggagtnatgccgnccncatcaccgcanaanatcatnanagcntactacaattgcatgaangcgtgtcatccacaatctcacgtgggaacgaccctgangtgancaacttctgcatgttcatcanctaggtttacacggtanttaccgancccgtccancnagccgtgtatgacganatcaatggctttactgcannaacaatcacgcccttcatgggtgatgcacccagggatcatgtgnttgtcgacnagtttacatcata

SEQ ID NO: 95662 - DNA, 450 bp, Triticum aestivum
  unsure (1)..(450): unsure at all n locations
  Clone ID: PAT_TA_95662
ccacagccccactcgtanagagcacgcgcaccggacacgcacgaagtctcctcgaccagcgagcaatggcgaccaccgcgatggcgctctccccctcgtccttcgccgggaaggcggtgaaggacctgccgtcgtcggngctcttcggggaggcgcgcgtcaccatgcgcaagactcggccaaggccaagccggtgtcgtccggcagcccgtggtacggctccgaccgcgtgctctacctcggaccgctctccgggngaccccccgaagctacctcaccggtgagttcccggngactacgggtgggacancgcggggctgtcggncatnccgagactttcaaagancgggagtggngtgtcaangccggtggcatctgggcgttcgggtgctctcccgantgtcgccgcatggngtcaattcggnaagcntttgttaaggcggtccaaat

SEQ ID NO: 95663 - DNA, 239 bp, Triticum aestivum
  unsure (1)..(239): unsure at all n locations
  Clone ID: PAT_TA_95663
cttgagcttgaggtcagtggcaggcaggcaagcaagaaaggaagaagaagaaaaaaggacatggcatctgctactctcctcaantcctccttcctccccaagaaggccgaatggggcgtcacgcgccaggtctccgccccgagggtgtncatggtcntccgcnccggcgcctacgangatgagctcntcaagaccncnanaaccatcncgtcnccngngcgcggcatcctggccatgga

SEQ ID NO: 95664 - DNA, 643 bp, Triticum aestivum
  unsure (1)..(643): unsure at all n locations
  Clone ID: PAT_TA_95664
ggtgataacatggcagacaacttgcgtgctactgctgaggataggttacttccaccatatgctttttctgtagcaagccagcaatctcaggaaaaggataaacactcaaattcaagcgaaacagacagcaagcatacccctctggggactaattctgaggatagccctcaatccagggatcttcctgctgaagacaatgtgatttccccgcacaccgagtttaccacgtccgtgataactgtggttctcaccatctgaaggttctgggaataggaagcagaatacccgttctgaacatgaaaagnttgtactgttaactgaaacttngcaagcaagactcaatccaaagtgtgtgtgttagcaaatgagacgcactccgacagacacgagttgatgattcctggattacacagnaagatatattaaatgtnccacaagtttctgggcacactaaggcgacaaagngggtgtcatttcaccatcttataaaaaagantcanangaacatggggacaccaatgnagacagggtttgtaatggttcctancaaacgtcggcaggaggtgagactactgncatatanccnggatacggatacncntnctggtccggggttcgnaaccncttganaacccctaattca

SEQ ID NO: 95665 - DNA, 642 bp, Triticum aestivum
  unsure (1)..(642): unsure at all n locations
  Clone ID: PAT_TA_95665
cgtggcaggagctggcgggcgtgctggtgttctccgccgtccccttcaccgccgtcaaggccatcgccaacagccccctcggcgccagcctccggcgccgcctcgagtccaggaaggccttcgccgccgccgaggcagacgccctccgcgccgccgcccgcgaggctcgcagctccagcttttgggtacgggggagctcgaccgcggtggctcggtcctctccggtacgactacccggagcacctggccggagattccccggcgattacggttcgatatagcaggctgggcgggacccgttgctttccgccaactacttcaactttggagattttacattgtccatgggcatgcttgctgctcttgggtgttgttgttcctgaactgttagttctatttgggataatgattttgtgggacctgtttgtggaaattggtatcaaaattaagggtgatatccttgattacttgggatcctgggttcnaatgctggtgggcaagganaacgcatgcnactgtaaacctttgatggtgggcanatatcnantatgtggatcagngctaaaccntggaataactctggganaaactncagtggnncgtcacccttggtgtcaanaccgtncttaaancagggaagaa

SEQ ID NO: 95666 - DNA, 630 bp, Triticum aestivum
  unsure (1)..(630): unsure at all n locations
  Clone ID: PAT_TA_95666
gagaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccagtcttgatcgttacaaangacgatgctatcacatcnagcctgttgctggggaagacagccaatggatctgttatgtagcttatccattagacctatttgaanaggttccgttactaacaatgtttacttccattggaggtaacgtatttggttcaaangccctacgtgctcnacntttggagatttacgaatccccctactaatcaaaaactttcaaggccccctcatggntcaaatttaaanaataattgaacaantangnctccttaatgggattccaataancaaaatgggatanccaaaaatntgganacgtttatatgcactggggctnattncaantttnaactaancaacatttcncgg

SEQ ID NO: 95667 - DNA, 377 bp, Triticum aestivum
  unsure (1)..(377): unsure at all n locations
  Clone ID: PAT_TA_95667
gtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcanccgtggtacggtcccgaccgcgtgctctactcgggccgctctccgggcgaccccccgagtacttcaacggcganttcccggcgatacgnttgggaaacggngggctttccggccgaccccgaacttcgcaaaaaccggagttgaggggattcaatngcgcttggcancttggcgcgtccgtgcncttcccngacttgtncccccnaacg

SEQ ID NO: 95668 - DNA, 417 bp, Triticum aestivum
  unsure (1)..(417): unsure at all n locations
  Clone ID: PAT_TA_95668
gaaatggatcataataaaatggattttaggtatctagggaagattcacttggaagtaactatttcctagatacctatggtacttcacggttgaatgaatcaaaaatatctaaaaaagacctaaagttaatgatttatcaatgggtaatgttgctccaatacctaaccaaagagctactacagtaccgattaaaaaaacggtccgtagctactggggcggcgaaatggatttggaaattaattgacattcctccaagaaaaggtactgtcaaataacctgtttggcacaagaaacatttaagagaacgcccnaataacttaatgggnaccgttacggagtatttgaaacacgggaaagaantacaccccggntatatttccaagagganttcaaacggtntgccggtcaacaaccatg

SEQ ID NO: 95669 - DNA, 178 bp, Triticum aestivum
  unsure (1)..(178): unsure at all n locations
  Clone ID: PAT_TA_95669
cngctcntactcaacctcnaacacncacctgattgctcctcctcggctccctcacgcncgatgtctcgctgttcgtgctgattggtcgcaacanccatggangccnnaaggnggggcnccntcccggnccgcccgancaccacttccncgncaanttcgacgcgcaccggcggtccat

SEQ ID NO: 95670 - DNA, 292 bp, Triticum aestivum
  unsure (1)..(292): unsure at all n locations
  Clone ID: PAT_TA_95670
cccagctttttccccttccgtcngtcgncgccgccgctctagggtttcctcttcccnatccccgatccggatccagcagcagcagcgagcgagcgatggcggccgcgggagacgccggcganaagaagatgattacgctcangaatcnggacggcnatgagtttgatcgtgnaggangaggtggccatggnntcgcacacgatccgccacatcatcgangacgactgcgccnacaacggnatccncgctccacaacgtcaactcngaagatcannccanggtcatcgagtac

SEQ ID NO: 95671 - DNA, 547 bp, Triticum aestivum
  unsure (1)..(547): unsure at all n locations
  Clone ID: PAT_TA_95671
cggccgtggaccccaagaagggcagcctgggcaccatcgcgcccatcgccatcggcttcatcgtgggcgccaacatcctggtcggcggcgccttctccggcgcgtccatgaaccccgccgtctccttcggcnccgccctcgtcanctgggagtgggggtaccaagtgggtgtactgggtccagccccctnatcngcggcngcctcgctcggagtcatctacgaagctgctcctcatcttcagcacccaaggagcagtcncnaactaccnactncantagcaaccaaacttgcatgcgagtngcctctatncgtntgatgatngatcgcnctcgtnacntctccttccttgcnatcgcnangatccttttaatttgctttngaagaatccatccatccctgggaccattagggtngcaattatcnatcanttngggngtcttccgtnnnttccccttaaancngggatgactccatntgggaanacgaccgnnaatttttnggaaaaancgtaattnnccgcctgcnngntaattcnannacttaatt

SEQ ID NO: 95672 - DNA, 293 bp, Triticum aestivum
  unsure (1)..(293): unsure at all n locations
  Clone ID: PAT_TA_95672
ctcgtgccgaattcggcacgaagctttcttctnatcctcngcnggctcgccggaaaaggcttcngcngccgcggttgcaanngctnctctccccaagcngggggtctnctcccggnctttaanttncgcantnccgcgangcttggctccttttcctcctcctcaaatatcgntctcctccaaanggcancttcntgccggngccaangccgactcctctggaaagcgcaancgccgncgcacnngaacacagcgcnaaaaccgcgccaaaatatttgcttnngggggcgccc

SEQ ID NO: 95673 - DNA, 460 bp, Triticum aestivum
  unsure (1)..(460): unsure at all n locations
  Clone ID: PAT_TA_95673
cccaacgcgtcgggcgtcggcgtccgtgccgatcccactcactgtcggccatctccaccgaaatcccccacctcccttccttgcgccagccattacttcaccaccgccgcgcgggagcatcggcagctagcgcatggcatggcctccctcccatacaccgccgccgcctgcgcctccgtcagagccgaccccgccccgggactcctcaactacgcagccgtccactcctgcctcctgcgagccgaccgccgctctccctccncgtcctcggcgtcctcctcctcctccattccgcttcctcgccgtggccgccgggggccattctcccccgccgtctcccgctcgcgtcccgctccgctctcccttcnatggcgccgttagtcctcgcgctcngnaacgggccaanngcntcgttcgccgccgnctacccgcnaaggcggctgcccggccggctggtgca

SEQ ID NO: 95674 - DNA, 586 bp, Triticum aestivum
  unsure (1)..(586): unsure at all n locations
  Clone ID: PAT_TA_95674
gcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctgggcgcgctcggctgcgtcttcccggagctgctcgcccgcaacggcgtcaattcggcagaggccgtgtgggtcaaggccggtcccagttttcagtgagggcggctcgactacctccggcaacccnaacctggtgcacgcgcaanagatcctcgccatttgggctgcaagtgggtgnaatggcgccgttnnagggtacgcttcnccggnggcccntccgcaaattntggcccctctaccccgggggagttttacccctgggcnccccaagacccnagnttccggnctcaaagnaaggaattaaaaaggccctcccatgtcncaagtncggtncttnnaaagcaacgtacggaanggccctnaaaactcccgaaantcccgaccctaaaaaaaaccngggtttnaaaatttcccggaaattnggggaa

SEQ ID NO: 95675 - DNA, 666 bp, Triticum aestivum
  unsure (1)..(666): unsure at all n locations
  Clone ID: PAT_TA_95675
tggagggctgcaattaaagttgagtggtaatcaggaccggtgctttgagacagaaatcggcacatgccgtgaaccgggtctaagctgatggagagtacaacccggtcgtataagatttttctccggatgatcgccgcacgaaattggcagcgggagggagacccactccatcaatttccaacctctctgcctgctgccgagttaacaactgaacgtgcggcatgagtggagttccatccaccacgttgcaactatcgtgctgtccgtcgaccagcacgtgttcttcgtgccaagacaccaccaaggaagaaacaccccacccccacgtttgacagcaacgaccacangacacgctgcgattccgcgaattccgaagcctgcagagcgtacggggcatcgatcgatnaancggcaagaatggcggcgacanggaacgctaagagcnacgntcgccgcggcgtgcggcgtctcanccgctgcatcaaaacgcngangcncggcggcggcaantngctctccctcatccggacggantncccgacacagcaccggtggtctcngcggagaccaaaatacactctagggggcagtatgtctgacaagtncgccaaggcgccaatgtctnncntgtcaagaaaccaggantcaggacgtggactcatgagg

SEQ ID NO: 95676 - DNA, 396 bp, Triticum aestivum
  unsure (1)..(396): unsure at all n locations
  Clone ID: PAT_TA_95676
ctcgtgccgaattcggcacgagctgaaacaatgagtttctcttcttcatcgcggcgcttatgcatagcttgggtgctactactttgcctttgcgtactattgtgcagagtgcagggaggatcatctcgcaagctctacatagtttacctgggtgacgtgaagcatggacaccctgaccacgtcgtggcctcgcaccatgacatgctcaccgatcttctcggaagcaaggaagagtctgttgcctctgtggtgtacaactacaagcatggcttttccggcttcgccgcgatgcttacactgggagcaagcaaagcaacttgcagagtttccagaggtcgtccgagtccatcggagcaaaacacacaccgcaaccaccancaagagctgggacttcnt

SEQ ID NO: 95677 - DNA, 494 bp, Triticum aestivum
  unsure (1)..(494): unsure at all n locations
  Clone ID: PAT_TA_95677
ctcctctcctccagttaatagaataccatggcccccgccgtgatggcttcgtcggctaccaccgttgcacccttccaggggctcaagtccacagccggtctccccgtcagccgccgctccagcgccagcctcggcagcgtcagcaatggcggaaggatcaggtgcatgcaggtgtggccaattgagggcatcaagaagttcgagaccttgtcttacttgccacccctctccacggaagccctcctgaagcaggtcgactacctgatccgctccaagtgggtgccctgcctcgagttcagcaaggttggttcgtcttccgtgagcacaacagtcccccgggtactacaacggtcgatactggacaagtggaaactgcccatgtttgggtgcaccgacgccanacangtgctcaacgaggtggnggagtcaanaaggantaccctgaccctattcgtttcatcggtttcaaaactgcccaagtgnaatgntcagtt

SEQ ID NO: 95678 - DNA, 613 bp, Triticum aestivum
  unsure (1)..(613): unsure at all n locations
  Clone ID: PAT_TA_95678
cccactctcctctcctccccggcgccgccagccatcctccccgtcccgcgccttctcctccccaccgtccgctccctcccagggaagcagcagcccccgcccgtcgcccaagagccgaagcccgccaccaagcaatcgctccctctcttcttcctcctgcctcacctctctctccccccctccaaaccctagccccgcaccagcctccctgccccgccgccgtcatctccttcgcccagtcggccgccgccgcaccgcacgaggtgggatgcgaggaggcaggcgagcaggggctggggagcagcagagacgcgcgggtgagcangatantacgcgacggagctgaacgggaccacggacggaactgcgtgctgtgccgggagcgcgggcagacaactggagacgacgangagggcttctacgggtactccanctcggcgangntccgattcaacacgcagtctgtactcgtcagtcgccggacgcaaagcatggaggatgcatcaacctgntcngtcatgcccgaagcatggaggacgcctcaacctgtcanctgaatcaccatnacacatgttaatganttncaatanttngnaattcccccaatttatgg

SEQ ID NO: 95679 - DNA, 306 bp, Triticum aestivum
  unsure (1)..(306): unsure at all n locations
  Clone ID: PAT_TA_95679
tccgagagtagctagcctagtctagggtttccgtagttcggagaggagagaaagggagagatccatggcggagacggantaccgctgcttcgtgggcggnctcgcctgggcnaccgacgaccacancctccagcaangccttcagccagtanngcgagatcctcgacgccaagatcatcaacgaccgcgagacgggcaggtcccgtggattcggcttcgtcangttcggnaatgangagtcgaatnnccaggccatcnatganatnaacgntaangancatcgncnggcgtcaacatcaccgtcac

SEQ ID NO: 95680 - DNA, 470 bp, Triticum aestivum
  unsure (1)..(470): unsure at all n locations
  Clone ID: PAT_TA_95680
atccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccaagaaggagtccactctccacttggtgctcaggctccgtggtgggtatgcagatctttgtcaagaccctcaccggcaagaccatcaccctgggaggntgagtcctcangacaccattgacaatgtgaaggcaaagatcaagacaaggagggatcccccggacancancgcctgatcttgccggcaacaactcnaggatggccgca

SEQ ID NO: 95681 - DNA, 624 bp, Triticum aestivum
  unsure (1)..(624): unsure at all n locations
  Clone ID: PAT_TA_95681
ctcgtgccgaattcggcacgaggcttcaaataagagcattttgaatacattttgacgattttgaaaaataaatgtgaagtttcaactcttgaaacttagtacaagtgactgataaaatcatgatttttgtgattacgaccgacaaaaaaataccttaaagttttatctgtgaaacttggtaagagcaaacgagaaaaagtcgcaagtttgcgttttctttttttttttgagaaaaagtcgcaagttacagatgaaaaatcgtaagtttcaacgattgaaacttaaaacttaagatgccatcatgcaggatccaattacttcatgaatcgcgaggcaatcaagctgccgcgtaacgcttctcangtgtgtacccccgtgcctacatgccccgcgaatttcagtggatgacccaacacaaaagtttacgtgaaaaaaatggnagtactcacagttangcttagtcacacaagcattagatgtgcgtgctaagtcanacacggngttagatatcaccacttaaaagtntatcatatanccaaantanttcancattgaactangccanncttcaaagaaggtgggtnccaggaaaattagtttggcacanantaaaatatanaagga

SEQ ID NO: 95682 - DNA, 674 bp, Triticum aestivum
  unsure (1)..(674): unsure at all n locations
  Clone ID: PAT_TA_95682
ctggcgtccgcgttggacgcccacgacgctcggtgtctcaacgccatgagggtgctgcgcaacctctgcgcctactcgggagaggagcatcgaacgcgcctgagcacggtgaccaaggccatgcccacggtgctgggagccaccatgacaggacgagacaagatcctggaagtgtccgtcggactcacgacacagatctgcaggttcgtcgacatcgaacagttcaccgccgagctgcgccgggccggcttgaacgagcgcgcctacgtggagcggctgggtcggcatcctgcggcaatacaggtacccggagatcaagagtgccacggatgcggcggttcgtggtgcagcagattgcctggctcatgacgagctcaactcgccgcgatggcggtggctttgtggacttgctccgggagctcgggatgaggagtgcaagggggggggcccggtaccaantcgcctatangatctattaccgcgctcatggcgtcntttanaagtcctgactgggaaaacctgcgttaccaactaanncctggaganatcccctttncaactgggtaatacaaaaggcccacgatgcctccaanagtnccanctaatgnatgaccccttncggntaacccgngtntggtacccantacgtaacttaanncaagcgtcntcttntc

SEQ ID NO: 95683 - DNA, 652 bp, Triticum aestivum
  unsure (1)..(652): unsure at all n locations
  Clone ID: PAT_TA_95683
aggagggcatccccccggaccagcagcgtctcatcttcgctggtaagcagcttgaggatggccgcaccctggcggactataacatccagaaggagtccacccttcacctggtgctcaggctcaggggtgggatgcagatttttgtgaagaccctcaccggcaagaccatcacacttgaggtcgagtcctcggacacaattgacaatgtgaaggctaagatccaggacaaggaaggcatccctccggaccagcaacgtctcatctttgctggcaagcagctggaggatggccgcaccctgggctgactacaacatccagaaggagtccaccctccacctgggtgctccgccttcgtgggggcatgcaaatctttgtcaagacctcaccgggcaagacatcancctggaggttgatcctctgacacatcgacaatgtgaaggngaaaatcaaggacaaggagggcatccccggacaacaacgcctgatnttcctggtaaacactgaggatggcgcacctggnggctatacatcagaaggatcaccttantngggcncgtcncgtggggcaataatcctgcaaggacgntcccgtggttggtcaaagctgngnctnaaatcccaagggccgttcgtcccngcnttcagttcacgt

SEQ ID NO: 95684 - DNA, 656 bp, Triticum aestivum
  unsure (1)..(656): unsure at all n locations
  Clone ID: PAT_TA_95684
cggaaacagagaaggagcaaacatgctctgcgctccgccgcaaacgctgcgtccgtcgcggccgctcttgcccccgccccgatgctccggcagcgcacagccgtcgccgtcctcggccgggaacatccggcggcaggtgctccagcccgagggccgcgcgaagctggacccgcgctccgaccgcgacttctacgcgttcccgcgcctcgtcaagcacgtcgacgacggcttcctcgccacgctcaccgacctctaccgggagcggctgcggccggagtcggacgtgctggacctcatgagctcctgggtgagccacctgcctccggagatgcggttccggcgggtcgtcggcacgggtcaacgcgcaagagctggcaaagaaccgcgcctggactactcttcgtcagtgactcaaccgggacaacggcgggactcaagacgctccttcacgccgtgctctgacgttagcgncantactgaatccccgaaaaatttcccggagattacgggtgcnaaccngcnggtggatntgaagttanaacggtgttcacaaaagnatggnctgcggaaggtcgctaaaccctcaatcgtancatatcantctnaaggttaccaccgngngtcaagtgccctcgaccgggaatcggtnccctgng

SEQ ID NO: 95685 - DNA, 632 bp, Triticum aestivum
  unsure (1)..(632): unsure at all n locations
  Clone ID: PAT_TA_95685
catacacattaatacacacttgtacaacaggtgctatacaaacgggtttaaacctctttctgcgacggcatttggaaccgtcgcctagtgagtgactgcataggggggggggtccttcccacacgacctanaaaccgtcggggatatgccctcctancacacacgctcagcaaaatgagttcgtttgcgaccgacgagcgatcaaatacggttatatatacaatagtgctaaaaaattcaattatacaggcaaaatcgttttcggtcntaagttcgtcccacatagtcagtcaccgctaaacatttccattcttatatacatcccatgcagttgctccaaggaaaacagttctgtttgcaangtacatcacacacaatgttccccgttaaatcgtttgtgatagcgttccattacacacgatattgacaatttacatttgcgttantgaatgcataacacatgggctanaanaattgtncggaaangtgtcatcacacacatttttancggaaacttgtccaagtggccaaccaacanttcaanaggattccgngtantgtcataancaaatgttatccaaaaacntgtcttcctagcacnccangggtttccanacnttnaaaaaaccatt

SEQ ID NO: 95686 - DNA, 573 bp, Triticum aestivum
  unsure (1)..(573): unsure at all n locations
  Clone ID: PAT_TA_95686
cttgcttacatggcctctatggttgccgccgcgcgcctcgccggnggggtctcgcggctgnctgctcagggttcnactgcccgnggccttccgcccggcagnctgnngcttcccccgcctcgccgncgtctgcgcagcgtccggtgctgcgcggttcgccatcccggnggcggcggcggcggcggngtggacgcgggggaggagttcgtcgggttcttccgngaggcgtggccgtacatacggggccatcgtgggagcaccttcgaggncgttatatccaacgangttgtgtcngggccacacttggaccgcattttgcacgatatttcactacttcatnggtcttggcattaactttgttcttgttccgggaacacatgtccanattgataaactattgtcggnaaagangaacganngctaatatgttggtcagtaccganttaccgattctgatcactagaagctgcgatggagnagctgncanaataaggtancaatagaancaantctctcctgggctcaatgtnaacctccgttnaatggagtatgtcatggaaggcttgggntaag

SEQ ID NO: 95687 - DNA, 660 bp, Triticum aestivum
  unsure (1)..(660): unsure at all n locations
  Clone ID: PAT_TA_95687
ccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaggccgtcctcaagctcctacgagtacgtcagccanggactcaagaagtacgacttcgacaacacatgggaagcttctaatcgctcctgcttcatggacaacttgttgtcanctctccaagaactcatgacctgccaacatcaagatcantcatctgggtactggggaagaaaggtcaaggaatcatcaatggaactgtcttcncaagatggataaccaacatntnatgccgaaactggaattgaaanccggaacacagtataggaagtcctaggtcanatgtcaaaggaaattgtcctnaaaanttnacgggggncgtg

SEQ ID NO: 95688 - DNA, 611 bp, Triticum aestivum
  unsure (1)..(611): unsure at all n locations
  Clone ID: PAT_TA_95688
attcaagctgtaattgtgggtacatgtaaaacattcaaatgcaaagacagtacaataatcatctatgatgaacgaagtcatatttttctcttatgctgatcagaaaatcttcatgatctgaattgtgtaagttgtcaccaccatcctttcacagttcatctgtcaattgttgcatccttcgttctccatgctgctgctctccaaatctctcaagaactcggcaaatgccacttccgaagacccgccgtcgccgatcgcgtccgacgccatcttcctcgccgccgcaagcatctccctgagcttcctcccttcctccgtctccatcaccagcctcagcttggcgtcaatctcctccgccttcaccgtccccttctcgtaaccaagcatacatcggcagnccggacatgatcgcctccagcgcggagttcaaccgcagtgcgtcatgaaggcgccgacgcctcgtgcccacanttccgcctgcggnaccagtcttacacatgccctgctccgtctctcaaagaagcagcnggaagancgccnagtccggtcgggaatcctctgtctccgngggtctaagncanagaacgggccggntctcancnggagattct

SEQ ID NO: 95689 - DNA, 321 bp, Triticum aestivum
  unsure (1)..(321): unsure at all n locations
  Clone ID: PAT_TA_95689
ntgaanaanaanaaggtgntgatatatgcataccacacangacacatgtataantaatcaagggaggttttactttaggggggcctgtttacantcatggnatggcacctgactgctgacncangtcangtgcgtacataaaggccctcnatcaggttgnggttatcatggtatgntagtagtagatcnatacgatcaatgatgnaatcacggcacagngcatncatgtatccaaanaggatctancagctgcatcagngannagccgcaatggntgcccgcatttgcnactgagtgcanccgaagcngccgttntcgggc

SEQ ID NO: 95690 - DNA, 377 bp, Triticum aestivum
  unsure (1)..(377): unsure at all n locations
  Clone ID: PAT_TA_95690
tcaaaattcaaaataaaaaaataaaaaaagttagtaatggcgcacctgcccanggtgcgccattactangctgtatatatggctgggcgtggtcctctcctccttacctcttcantcttctcctccantccanctctcctccantccatctcctcctctcctccantccatcttcccttctctccancatactaccctcctcctcctcctcctctccggtgacctcctcctcctctccggnaacctcctcctccctcctctcctcccctcacggtttctcctccgtcctctccggtganctcctcctccctcctctccggtgagcccctcctccctcctctctggtgagctcccccttccctcctctttacaaaaaa

SEQ ID NO: 95691 - DNA, 382 bp, Triticum aestivum
  unsure (1)..(382): unsure at all n locations
  Clone ID: PAT_TA_95691
tccttccctctcgctagctaatcacccactaaatactcgctcgctcctcccccggcctcgcctgcgccccattcgtttccattccgcccgcgctttattgattggntgattaattaattagncgancccacttgcgccgctctaattccgccagcggcaggaggaggatccagcgggcgagcggcggtatcgggcggnggtcgatgccgnctggnggngatggcggggcgccgngcgataangncggcnggcacggggcatgcagggggctcgccgccgaggcgcggtcctcgctcgcgcttctcnttcctgctcgccnctggccncggcggncgtntcgttcgggggcgccnacttcnggttggncttcgnctctttccgc

SEQ ID NO: 95692 - DNA, 620 bp, Triticum aestivum
  unsure (1)..(620): unsure at all n locations
  Clone ID: PAT_TA_95692
ctcgtgccgaattcggcacgaggcaagacggcgggcaagcccaaggtggcggcgtccagcancccgtggtacggctccgaccgcgtgctctacctcggcccgctctccggcgaccccccgagctacctcaccggcgagttccccggcgactacggctgggacaccgcgggcctctccgccgaccccganaccttcnccaagaaccgggagctggangtgatccactgccgctgggccatgctgggcgcgctcggctgcgtcttcccggagctgctcgcccgcaacggcgtcaattcggcgaggcgtttnggtcaaaggccggtcccagtcttcaagtganggcggctccactacctcgncaacccaacctggtgcacgcgcanacatctcnccatctgggctgcaagtggtctcaatggcccgttganggtacgcgtcgccngnggccctcggcaaatcnngaccgtctacccggnggnactcnacccctggctcccgaagacccagngtcccgactaagtgaagaataaaacgcctccagtccangtcggtttcggaggaactacgaagggcgtcaaatccanactccgncctaaaanncngcttcaaattnccgatag

SEQ ID NO: 95693 - DNA, 333 bp, Triticum aestivum
  unsure (1)..(333): unsure at all n locations
  Clone ID: PAT_TA_95693
ctcgtgccgaattcggcacgagaaattaccccgaagagagagagagagagagaaananagacanatgcgcaatgccgtgancagtgnacaggnctgggggcgtcgacanttcangaggactgtggnacatncancatcagcagcggnnangtaggcgaagngctngcacccatcgagntcgtctccttcntctagagggtgctcttcgacttcgtcttcctnctcttngcggaacattnaatttattatgttngggatagctgactnnactacnaatcaaatctcanntctccatatttaacctgtttgtnaagnaggnatancncgacattt

SEQ ID NO: 95694 - DNA, 650 bp, Triticum aestivum
  unsure (1)..(650): unsure at all n locations
  Clone ID: PAT_TA_95694
tatagacatgctaataaagaagaaaattgctaatgcacaccaccaccagcagcaacagcaacaactattacaacaacaaagcaatagccaacagcagcaccatcaggctgtctctagtcagcagtctcaaagctcaaatcagcttctccaacaagaaaagccaggaactgggaaatatgcctgttgatgggggcatgccgattctttttgggggcaccggatcaatcaacgaagaaaagaaagaanctggtcttcctccgggtaagagctaatatttcangaactgggaatactgctggccgtctccaaagtttgcacctccgacacttccaatccatacaccaagagattccgatgccaataccacactttcagcagatggtgtttcaagcaaaacccttgggatgtttggtccnnaatgnactggaacttgacatctaccgcaacccaacggggtgtgtngacctttgctggaaaaaagatgggnnnaaatgtgaaccttcgtncagggtacatggttcagggatacntggaacctcatgattcagtaangggttgctttcnagttnaaaaccctncatgcantaagtttttgtcattcaaccagaattcttcnaggggcanaaaagtttttttgggaatnccnacca

SEQ ID NO: 95695 - DNA, 321 bp, Triticum aestivum
  unsure (1)..(321): unsure at all n locations
  Clone ID: PAT_TA_95695
gagccgacgaagcatctgggccacgccgccacaaaaggcaaggcaagggaaagcctcgatgcctcccctcctcacctcacccgcctccctctcctcctcccccctccgcctcgcctcccgcctcgtcgggncggcctccggtcncacccnctcctcctcgtcccgcaagncgtcgtttcctcgcccccacccaaaccgcggcgncgggaaccacaaccancggcggttcgcngcgatnaactggctcgggaaactgggggnnggccgcggggaaaacccccncgcnttcggaagcgttcgcngcgctngcgcaagggccga

SEQ ID NO: 95696 - DNA, 623 bp, Triticum aestivum
  unsure (1)..(623): unsure at all n locations
  Clone ID: PAT_TA_95696
ttttttttcatcaaagttaattcgtttactcaaaaagaaaagttgattcctttgcgaactatcagacaaccaccccancataagnaattgaaggagaattccatgtcatagtcaaaaacatttttagataactttcatcacgaccaaatagctccaaacataaagaagtgcatacatgctaacaacagtgataaagtgacaaaatgacaagaggataacccatgaaagtctccggcctctcagctaaagtactcataacaccaacatttgataaatataaggtgatagctactagttcctcattcctcttcctccgtcaccacctgcatcgccaccaccacttgccttcttccggttctttctccntcaaccggcctgcaaggcctccggccgaatggactngtcagtgagaatcgatgtgcttcncggatcaacctcacatgaacgacgggacattgacgatctgcctgccaacctgatgtgggttgcctgatnaaaacacggcatggtggatggatttgccatgcaaccttgannaaagatcgaaagcgcctgcaggaantccatataaggcaaggnntataagctgtctggcccacaggtacatacggtntnacggnaaa

SEQ ID NO: 95697 - DNA, 191 bp, Triticum aestivum
  unsure (1)..(191): unsure at all n locations
  Clone ID: PAT_TA_95697
cctgctcgaacgcggcgagatccggcccctcgggtccgaacgggaccccgaccatccgcagccggtgggcgcgggcgagcgcctggaacgagaagtagcagggatcgtccaacagcaccgtatcgccgggctcggcgaggaagcggatgatgagatcgagggcctgcgtaccgnangggggggcccggtac

SEQ ID NO: 95698 - DNA, 266 bp, Triticum aestivum
  unsure (1)..(266): unsure at all n locations
  Clone ID: PAT_TA_95698
gcctgacagagttggtctgcagatcatctccattgtgttcgagggaagttgctctgcatgagtgaataaataggtgatggcgcctagttggggtttaagtttgtgagaacggagagagggttttgggtgaaattgtccttgtattgattgagcctccgtgggcatattatatatatatatatatatatatatatatatatatatatatatatatatatatatatatgagtncatcaanaantttnaaaatactcnnaagctcnttc

SEQ ID NO: 95699 - DNA, 624 bp, Triticum aestivum
  unsure (1)..(624): unsure at all n locations
  Clone ID: PAT_TA_95699
catagatagagtcccttcaactgtccgtcatctgtcaatatttggaaacggagatattgattgttctgaactgaagaaaatatgtaacagcaaaaaaataaggaccctgggtatgtgatgataaatttaacagcggagcagattttgctggcgtgattgactcttgggttcaaaggaactgttgaaaaccgtgtactgaagttaagagttggcaaagtaaggaantacccgaagagcatggggaactcaaagaaccgcgtacttttggttaacnggggcttccaacttcgggaacctaacttcaaacgttttnctncngcaaaanccaaaattataaaccngccggtgggtnaataaaaggnttccgnnaaggttaattaccccaaaactntcanngatttatccaaangggttaattttgacaaggacaacctgacaaatctgcctaaaatggccttntaggttgggnactaataatnaacgggaaaatgntggaaaccantgaaaattcccacgggantcaaaattcagtagnattcaagggaaactgccantgntaancaaacccgcagttcccctaaattcaggtgaannaagaaaaaattttgcctaggnccnaaagna

SEQ ID NO: 95700 - DNA, 473 bp, Triticum aestivum
  unsure (1)..(473): unsure at all n locations
  Clone ID: PAT_TA_95700
ctcgtgccgaattcggcacgagaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagcactgcactacaagggcagtccgttccaccgcgtgatccccgacttcatgtgccaanggcggcgacttcaaccaaagggcaacggaccggcggcgatccatctacggcgagaattcgccgacgagaattcgtccacaagcacaccaacccggattctctccatggcaaacgcggccccaacacaaacgtcccattctcatctgcacgtcccctgcatgggtcgacg

SEQ ID NO: 95701 - DNA, 303 bp, Triticum aestivum
  Clone ID: PAT_TA_95701
gccgaagcagccattctggtcggggagctcgtcgacgatctggaggtccagctcctggttgctctggaaccagagcggcgtcgccggaagcggcggcggcgcgaccggcgctgcgttctgcagcattgggaggctgttgctgctgctgctggcgtggaggagcatggcggcgggcaggggctcggcctcctggaggctgtgccgctgctcgaacgcctccacgtacagctgctgcacgtacgccttctggaccctggtgaggtgctgcgccgcgcactggacgccggcgaactcgacctacag

SEQ ID NO: 95702 - DNA, 631 bp, Triticum aestivum
  unsure (1)..(631): unsure at all n locations
  Clone ID: PAT_TA_95702
ctcgtgccgaattcggcacgagggtgaccatgctacacccgggcacgcatcggtgatggtgatctacctttcattcttcagttctggcaatgtcgggcactgggcagatagttttgggcaggggctctcccggtcgaggtggtagtcggtggtggtgtgctccatcatcactgttcgtccttctagcaaccactttggcctgcggcggtggcccctctatggattgcagtggtcactgaaaggtcttcgtgaggatttctccctccaaatctggtgcttgacttcggcagtgagatgcaaactatggacgacgacctatcactgagggatggttgtgcancggctatggttgcatgtgacatgtggctgctanggtaatcnaaaagtggtgggcgacaacatataagagatgtcaatcgtggtgcatccaagggggggccggtaccaattcgcctanatgatctataccgcgctcantggcgtcntttaaactctgactggaaacctggngttncaacttancccttnanaaaccccttccaagnggngtatacaaaaagcccacgttcctccaaattgcaccnaagnaaggancccntncggcataccgcgttgngtaccactncgtaat

SEQ ID NO: 95703 - DNA, 601 bp, Triticum aestivum
  unsure (1)..(601): unsure at all n locations
  Clone ID: PAT_TA_95703
ctcgtgccgaattcggcacgaggcaatctgcacagcgtgaagacatctcccatctcttgctcgggaaggaagaatctccagggtccagactccagacctgtgtggcgatgctgatgaacctcatctattccacccgattagcacagatttcatgcgcaaagggatnggaattgttatactaaattgatggttgatttctggnactgttttgcctgaaatactgaggtcaaactgcataaagagaaatggncgaggctgctcttcttcttgtcacgacaaagatcggaatagctgtggcagcagaaatacttcatcacgctaagtctgttgcaaaactctcaagagaaantgacactgataaggaatgacctanagcttattcgagcatttctcaaggagattggnatgaaactccacanatggngtnaccgaacatggnttggcaatccgatattggcgtntgatattgnanacttgtgganaattttgnctttgtgganacacacaaaaggntatggggctttnnnaataaatcttgaaaacccatnccgnttaccaagtaaaccncggcttgnaanaacaatccttaatctattaaaaa

SEQ ID NO: 95704 - DNA, 572 bp, Triticum aestivum
  unsure (1)..(572): unsure at all n locations
  Clone ID: PAT_TA_95704
ctcgtgccgatctctcctccctctcccatcccctctctctcctccacccgacgtcgccgtcgccgtccaatctccggcgagatcccctcccccgccggcagccatggcctccaccttcagcggcgacgagaccgcccccttcttcggcttccttggcgccgccgcggccctcgtcttctcctgcatgggggcggcgtacgggacggcgaagagcggggtgggggtggcgtcgatgggggtgatgcggccggagctggtgatgaagtccatcgtgcccgtggtcatggcgggggtgctcgggatctacggcctcatcatcgccgtcatcatctccaccgggatnaaccccaaggccaagccctacttcctcttcgacggctacgcgcaactctcctccggnctcgcctgcggctcgcggggctcgccgccggcatggcatcggcatcgtcggcgacgccggcgtcanggcaacgcgcagaaccaagctgttntcggaatgtctnaccntaacnttgccgaagccttgcctgtanggctcatgtcggaacatctcnctcgcgtgcggcaatccc

SEQ ID NO: 95705 - DNA, 196 bp, Triticum aestivum
  unsure (1)..(196): unsure at all n locations
  Clone ID: PAT_TA_95705
ttcacacaccacatgtggattggcggntttctaatagtcngtgctgctgcacatgcacacantttttatggtaagagactatgatccaactactcnatacaacgatctannagatcgcgtccttagacaccgcgatgcacncatatcccaccttaactgggtntntatatntctacnttttcacagttntggcttg

SEQ ID NO: 95706 - DNA, 669 bp, Triticum aestivum
  unsure (1)..(669): unsure at all n locations
  Clone ID: PAT_TA_95706
ctcgtgccgaattcggcacgagcttccgctcccgacgaccgccatggccgctcagagcctcctctttgccgccgccgcgcctctcttccaggctcctgcctctgcccgccctttccagtcgctccgaattgtctgcaccccagaaaggcgccaccgccgccgccaagggcgctccgtccgtcgcccgacgccaccaaagaaagcaagtccgcggtgctcaaagggacctccgcnagtccgaggggtccgtcacgtcacccaagaaagacgacggcctacgacggttaacgttcgtacactggcttgctccctggacttcatggttccacctcccatgagtttgggtgacacgactnaaggatgcatatcaacaagccacatttttaaccccaaacggctgacaattngtnaccagnagatgaatccgtcatgccgggtgacttgggaaattgttgccnagctgaaagntggcgggggacacatttcataccaatccttgacgggccnaagcattgtttggaaaacgttgntggtataaactgagatgcntggaaaagnggcatagntanctatatgaaatctgggancttcaatggttttggcnacccttaggccngttcaaccgtttnnccngaaggntcacccggttgaccacanttacncctttct

SEQ ID NO: 95707 - DNA, 612 bp, Triticum aestivum
  unsure (1)..(612): unsure at all n locations
  Clone ID: PAT_TA_95707
gtagggtctctctctccctccccccttcctcccccgccgccgccgccgccgacgaaaatgttggcggctcgccgccacgccgcctccacccccgctccgctcctcctccggcgcctctccgcccagccgcagcccaaggcccctgtgcctccacctccgcccccgccgtcggacgagggggccgcagcgtgggcccgtcgcgcggccgcgctctcgctgctggggctcaccggcgccgtcgccgccagcaccttcaagcgacttctccgtcttcctctcctgtccaaccaagcaatggggaaagntacaaagaacaacaagtancangcgattcggngagccaacangcngggtccctgggtacacgcgtccatcgccgttnaacgcgcgagngttctttccctgantttcccgtttcgggcccaaggcacggtttcaaattaaagtttcncttggaaaagacangttcgttcanaacgaacgatggagaatcaaaggccacctgantcgacgaaatggagacaaataggacgtccaaanagaatcacaacantatgagnataacctaagcgaacaacaagcaaangcancatctaatggcaccggaagaan

SEQ ID NO: 95708 - DNA, 419 bp, Triticum aestivum
  unsure (1)..(419): unsure at all n locations
  Clone ID: PAT_TA_95708
cgcgaacagagccatcggcactgatagagtagagcttgtcgaaccggggttgctaattacaaattacaaattatttgcaattacaaagtcgcaacggggttgctaattatccaagcaattacaaattatttgcaattgcaaagtaaatgcgggcttgctaattttgacgcacaagtatctgagtatccaatcagaacagcgcggcgttacgacaatcgatttcgaagaggggcagggtcgcagggaaacagtcacgcacctccttgtgtccagcgagggcgcaagaggaaagcgaaacgccgcagccacggtctcctccgacgcgcgacccctgggattggtccgggatcntgcccgccggcttggggattcgtcttccgggccgactcctcaagtntccaaaacagcgtcntgcaagt

SEQ ID NO: 95709 - DNA, 618 bp, Triticum aestivum
  unsure (1)..(618): unsure at all n locations
  Clone ID: PAT_TA_95709
aagaacttcgagattgaagttgctaccaacacggaacctgctttctaatatcagcagccttgacatctctacaagtactttatccctgctttctacagaggcagcaagtttttgaagcagaatgtcacggttacgatccctgtgagcaagcacatcaggatctaccccaaccgaaccatgggatctaccagctgctgcaacgatattaaattccctctgtagaancctactcctgtggataactgctgctcaacggcttttaagctgctgcaaccacccantacttcatcaacggccttccattaaaaagctgttccctccgtcgctcaaactggatacagcttggggcagcacgaactgtgtgtcaactcccaacacggggcaacatcaanggcggtnaacttcaactcaccgtcctatgaaactccgtcaaagaacacgagaaanactcatctgttgcaacattntatggggcannacaacaccgtggttgggggaaactgggaanatgcggaaaagtcgatcaagctcgcaaaactntcaatagaccagcaanaaannctcganctgcgtangggacacaactgcttgaantttaggcaatttcttaagnaaaaa

SEQ ID NO: 95710 - DNA, 580 bp, Triticum aestivum
  unsure (1)..(580): unsure at all n locations
  Clone ID: PAT_TA_95710
caatggcgtccacctcctgcttcctccaccagtccaccgcgcgcctggccgcctcggcacgccctgcgcccgccgtcgggcgcacccagctgttcgtctgcaaggcgcagaagagcgacgaggctgcatctgacgctgccgtcgtcaccagccggcgcgccgcgctgtccctcctccgccggtgcggccgccgtcgccgtcaaggctcccccgccgctgccgcctacggagaagcagcgaacgtttccggcaagcgaagaaagaacacggattccntggcgtacagcgggaaagggtcnaaactgatgatcccngcaaagtgggacccaacaangagcgttantccctggggcaagtgtccgctacgaaggaaatttcnaagccaacaannactctcccgttataacnacccaacaacaaagaaacanaaccgatacgntccccgaaggatcctctccaagtcggtcctccccggnacatctacggtggaaaacgatcgangtggttggtaaacctgtgcacggnaactctgaaantcgngccgtggtgacgtaagatataacatacgtctacagacgcg

SEQ ID NO: 95711 - DNA, 537 bp, Triticum aestivum
  unsure (1)..(537): unsure at all n locations
  Clone ID: PAT_TA_95711
ctcgtgccgaattcggcacgaggtgctgttaaccggactccccgacgccgccgtcgccgccaacatgaccgaggtctgcgtcaaggccgccgtcggccaccccgacacgctcggcgactgtcccttctcccagagggtgctgctcagcctggaggagaagaaggtgccctaccagatgaagctcatcgacgtcagcaacaagcccgactgggtcctgaagatcaatccagagggcaaggtgcctggtgtataacggtggtgatggcaaatggttgctgattctgatgtgatcatccaatcattgaggagaataccaactccacacttgtaccctgctgaatatcatcnatggattnaaaatttctccacctttgtcaacttcctnnaagacaaggatgccaacnatggttcgganaaaganttnttnattacttgcaaggtnccaaaaagaacttnaagccaatgncctanatcaatggggcgaanactccgttnctttcaacctggtcnnaantctacaactcaaagtcncctgga

SEQ ID NO: 95712 - DNA, 596 bp, Triticum aestivum
  unsure (1)..(596): unsure at all n locations
  Clone ID: PAT_TA_95712
gaattcttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcancctggggttccgcccgaagaagcaggggctgcagtagctgccgaatcttctactggtacatggacaactgtttgggactgatggacttaccagtcttgatcgttacaaaggacgatgctatcacatcgagcctgttgctggggaagacagccaatggatcgttatgtacttatccattagacctattngaanagggtcccttactaacatgttacttccattggaggtaactattttggttcaaagcctaagtgctccacgtttggaggtnttacnattcccctactnttcaaaacttcaaaggccgcccaaggatccaattnaaaaanaaatttaacaattgggccccttatggatgtccattaaccaaattgggatancncaaaattggaaactttaaatcccacnggggnctgtttcnangggt

SEQ ID NO: 95713 - DNA, 369 bp, Triticum aestivum
  unsure (1)..(369): unsure at all n locations
  Clone ID: PAT_TA_95713
ctcgtgccgaattcggcacgagcggcacgagcaaagaagagggtagcacctgatctgcttgcttccagaaacaatggcgtctgctactctcctcaaatcgtctttccttcccaagaaggccgaatggggcaccacgcgccaggccgccgcccccaagccggtgaccgtctccatggttgtccgtgccagcgcatacgccgatgactttgtcaaaaccgcgaaaacatcgcatcgccaagcaagggatccttgccatggatgantcnaatgcacctgtggnaaaaacttgctccattggcctttnagacacngagntaccgccagtttacnggcnttcttgtatccaacnagcttggaataatcccgggg

SEQ ID NO: 95714 - DNA, 482 bp, Triticum aestivum
  unsure (1)..(482): unsure at all n locations
  Clone ID: PAT_TA_95714
ttttntttnttttttttttntttttttaccaccaatananacttattttcatatgtttcaatatgtgcccgaanaatattaatgtacattctttcaacacatggnttactctcggcctttgcnccattgncgcaactggtcatctagagaatacaaaggcagggggtcacanacannagcagcanaanatttctaaaacnaccanaagtaacacaaaggttcaacangaggcaataancattgcagnccgaaaancaggccnccnancaagcanggnagctacaagcttcnctatcacaacacatattggagctcaaattannaacaaccatgacgacattacattccacactgaacaancgagaaanccantttccngggcacatagacaggttaacngcnatctcaagtcaccttggaacatctnaattctcaanagngtcccnganatgtncgcctcanacggcctggttacaacccag

SEQ ID NO: 95715 - DNA, 297 bp, Triticum aestivum
  unsure (1)..(297): unsure at all n locations
  Clone ID: PAT_TA_95715
ctccccctcccncctctctctccctagggttcgggtctctcctcccccgtcgccatgatgcagccaccgccgccgtcgcagccgcagccgggcatgggcgccccnatgccgccgcagggcgccggagggcanccgccgcactggggcncgatcncgccggtgaatgatcattangcgcagccgcccccgcagcagcagccgccgccgcaggccatgtggggccagccgccgccccaggccgngccctacggncaggtgcccgccccgcagcaagtactacnccgcgccgcangcccc

SEQ ID NO: 95716 - DNA, 626 bp, Triticum aestivum
  unsure (1)..(626): unsure at all n locations
  Clone ID: PAT_TA_95716
ctcgtgccgaattcggcacgagggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtccaggcctgcactgggtgtgaatgttgcggttatggttggtggatccccaangaaaggaaggaatgggaaaggaaggatgtttatgacgaaaaatgtttccaatcctacaaaagtcnaanatctgtcccttgaactccaatgcaacccccaaactgcaagtttgggtgtttccaacccaacaaacaccaatgncctcaacctggaaggagttgntccnacctacccctggagaaaaaaccattgtttnaccccctaaaccacaacaangcanccngcaanttcctgaaaaantggggnccaattcctgacntgaagaatgcatanccngggtaacacgctcaataantacctggagtaaccacccatgtgaaactcantgganaaaactgttcggaactgtnaatataatgntaacgggantatgcacgtcaganctgngctgannataacgngac

SEQ ID NO: 95717 - DNA, 638 bp, Triticum aestivum
  unsure (1)..(638): unsure at all n locations
  Clone ID: PAT_TA_95717
ctctcctccagttaatagaataccatggcccccgccgtgatggcttcgtcggctaccaccgttgcacccttccaggggctcaagtccacagccggtctccccgtcagccgccgctccagcgccagcctcggcagcgtcagcaatggcggaaggatcaggtgcatgcaggtgtggccaattggagggcatcaagaattccgagaccttgtcttacttgccacccctctccacggaancctccctggaagcaggtcgactacctggatncgtccaagtgggtncctgctccgantcaagcaagttggttcctctcccgtnganacaacantcccccggntactacgacggcccatactgggacaagtngaacttgccatgtttgggnggaccgacncacaaanggctcaacgagtggaggagtcaagaagganacctgaccctattcgtntnaccgttcnacaactgcgccaaatggatgcgtcaantcancgcctcaagcaacggggtgcgaggatccgggaaggctaaatacnattgaaacatggctacnctataaggctttggacttactttgcaaactcgtgacactctctttgacgngaanacntttgtcaagatttggagttgtaaaanggtct

SEQ ID NO: 95718 - DNA, 655 bp, Triticum aestivum
  unsure (1)..(655): unsure at all n locations
  Clone ID: PAT_TA_95718
ctcgtgccgaattcggcacgagattgtaaggcgtgtcaaagaagagggtagcacctgatctgcttgcttccagaaacaatggcgtctgctactctcctcaaatcgtctttccttcccaagaaggccgaatggggcaccacgcgccaggccgccgcccccaagccggtgaccgtctccatggttgtccgtgccagcgcatacgccgatgagcttgtcaaaaccgcgaaaacatccgcatcgccaggcaggggtaccttgccatggatganccaatgccacctgtggcaagagactgcctccgattgggcttngagaacaccgaggtaaccgccangttaccggaccttcctgncatcccaccaanttggggaaactaatctctgggggctacctctttggaggagacctctacaatcnactgttgatggaaagaaattgttgaatccttgtcaacaagnacctcccngtacaagtngacaggnctgtgcactggtgggtcaatgatgatctggtgcaagnccgatggctgctccgtgaagaacatacacaacaagggctccttccaatgngcatgttgtagaatctaangncacnacttctncagaactnctggtctgccttacgaactaagnatggtggccatttgccctnttat

SEQ ID NO: 95719 - DNA, 650 bp, Triticum aestivum
  unsure (1)..(650): unsure at all n locations
  Clone ID: PAT_TA_95719
aaccgctcgggtcgtccacccacgcctccgcctccacctccctccactcgcgcactggcggcgccggcggttgcgcaggctgactgcttccttcggaaggaatccttccccaggcgcggtgcggcggctggccaggctgattggtagctgcccctctccccgtgcgtgtatgcttgctagccgagcgagcgagcgagcgaacgagcgaagagagcgccttaccctcccgggcgaacggccagagtccttcccgagggcggcagctagggttcctagccgccgtcggcctccgcggcggcgccnccaagccgccggtacaggactacccggcgacnatccgtangtaaccgatggntgctgctacgttattaatgtgtgcatatttccaactggggcaattctcataaggaatcaatgggacacaatgactatataaggaaagatggactgatcggnacattagttggattcnctccaattgcactcnatnccaagggatgatttatgatatganctgaactgaacctctacnanaantttaaaagggatcaaacanttacctgacttgaatcgtaattggaanaaaaaagtggaaaaaatggnttcagggttaagngttngccaaattganccaaattagttcgctgcgg

SEQ ID NO: 95720 - DNA, 604 bp, Triticum aestivum
  unsure (1)..(604): unsure at all n locations
  Clone ID: PAT_TA_95720
ctggggcaaggcagcgagcacgccgcgtgcacgagttgaggcactggtaaacctgtggttctttggttagttcaatatggaggggactctggttcagtctgccattgctcctaccgcatacaggagtagctctacgcggtcccgtgtgcgcacaagggccacaatgttacgcagtacgccaaccaggaccctcactctcgggggttttcaaggactgcggcaaacaaatttcctgggatacaaggtccgttatcaaacgtgactttgggctccattgtaagcaagccagatttcacgaccacgtgggtcaggttcaaagaatgggtgtccgggccangttccagcggttccaaanagaaanatcaagtgattatgcttgaacaggaggaagcangaccctaggcacaacttnttgggacagaacagattctgcttgggcttattggtgaaggaactggaatgcacaaaggtctaaatctatgggataatcctaaggatgcccgtgtggaagtnaaangttatggaagagcatgggtttgttgcnttgaaatcattnnaccgtgaancgtgtatcaactgtacttaaaaccccactaggatacat

SEQ ID NO: 95721 - DNA, 671 bp, Triticum aestivum
  unsure (1)..(671): unsure at all n locations
  Clone ID: PAT_TA_95721
gcaagtttgacaacctttacggttgccgccactcgctccctgatggtcttatgagggctactgatgttatgatcgccggcaaggttgctgtggtctgcggttatggtgatgttggcaagggctgtgccgccgcactcaagcaggctgggtgcccgtgtgatccgtgacagagattgacccatctgtgcccttccaggccctggatgggagggcatccaagtcctcacctttgggaggacgttgtctcctggatgctgacatcttttgtgaccaccaactggggaaacaaggacacanccatggnttgaccacattaggaaagatgaaagaacaatgccattgtcctgcaacattgggcactttttgacaacgaatttnacatngaacggctgggaacctaccctggggtcaaangcacaacaacaacctcaaaacgacctttggtctcccctngaacnacacnggacatgncctgcctnaggctcnatnacttggtgtgcacngcacccaactngnaagtctgccaanacaacaagtntgccaactggattntgaagaaagctcggaanntaaaaagggtctgnccaacactcacaaagncctncccactggaanttggagtncanntacaggcatcntntncacccattnggccnaccgggtccnaaatn

SEQ ID NO: 95722 - DNA, 672 bp, Triticum aestivum
  unsure (1)..(672): unsure at all n locations
  Clone ID: PAT_TA_95722
cgccactgctgcatgcagagagaagcagtacgactgaagcttgtgagccatcaacacggcaatcgtagccgaaagcctgagccgcgcccacgactttctcaccgctctctctctctctctttctgccgcgcaataaaactccggagcagccaatccaccatgtgagcagtcaaggagcagcgtggcagggctcctataaaacattttcccttgcaccaccgctgcactcnagcacactgcactgcgccaccaccatatcccaaaatactcaactcnagcgctgcttgccnactggaactggggtgggactggggtgacactgctgcacgctgccacgccatggtccccctggtccttnaaaggacattaagantctcctgtccntcgccngggtcaacggcatatgccccaaccttggagcgcaaccanctttcnggcgcaaaagncngggcaacccgtctttaaanccccggccgacccaaaccaanagnaggacgnaggaagggaacanacacacacaanaggtggnttcaatgggacngcaaccggcggtaaaaggtctctacggttgcgctcacaannagagnggacgtncggccctcgcgtgccggtggnataangagccgtcgccnataancacncaacagnaaggggataggcnntaatccgaga

SEQ ID NO: 95723 - DNA, 491 bp, Triticum aestivum
  unsure (1)..(491): unsure at all n locations
  Clone ID: PAT_TA_95723
taagaagcaatattaaggcagaacgaaaatacgaacggccaccaccaccactgtatggggctccccccaggccagaccaaggaggcagtccccgcctgctacgctacaagcggcgaccacaaccttccctgggcaacataacatatggggagccccaaatcttgcaataataaccataacacatctaccacacgatccaagagcacattgcaacggtcattggacaagttagcaaacactactaagtacttgcggggcatccgcaaagcccggttttactgnccctcgctgggagcatgcttccggagctccctggtctcctcctccgcgggtncctccgtgatgtccggaanccaagaggtccaagtttcacgaaaggatttcatgatcaanggctgccttggnaggtccttcgtcaangngccaactccngaatggctcanccnaagccgttttngccanatncaancacatnaagcnattnaggttca

SEQ ID NO: 95724 - DNA, 526 bp, Triticum aestivum
  unsure (1)..(526): unsure at all n locations
  Clone ID: PAT_TA_95724
ctcgtgccgaattcggcacgagggaaaatcatgtttagtagtctaaatatgcttcaagtaaaaatctgggaggagttagtgaaagacgaacgtggagtatgtgatcccgagtttcagtgataacagtaaaatataaaaagaaagtaaaaaaatgaagaaacattgaagttttgtctacatacatgctgaaagaacatgtggtgcccccatgtgtgggttttgggtaattggatgacattctcctatgggactaatgggtgccttggagttatatttggtaggatttgtcccgtaagcctttccttgaatccatttggttgggttcaaagganttatgtgttgtccaaggtactccttccaaaggaattaccaaagatggncatgtgaggtttaacttattgccaagcatgtcttgaaagaagaaatgtgtgacatccaatttacttcaagacacanccctaagggagagattggaaaatcaaggtgatnaagactaatncaaagaggttcaagtgataacacacaa

SEQ ID NO: 95725 - DNA, 564 bp, Triticum aestivum
  unsure (1)..(564): unsure at all n locations
  Clone ID: PAT_TA_95725
gaaatcatggacgacgccggcctggtgctcgccgccgcgttgacaggcgcaatcttcgtcgtgttgctcgtcctgctcgtcgtcgtccttgtccggaggcggtggctcgaccgcgagggcgtggcgtccggccgcggcttcctcctgttcggcgtctgttgccaaggacggcacccaagggccgntcctccggacgactccctggcaaggagccggcagcgggcggccgccgcggcgaaggaggcggatgacganccgggcgaaggcgantcccaaaagtggaagaaatttcccgtgggcccaacaaangcccgncccacgattagaggaggcacggagaaaggcacttcaacngtggaacccgcttttgtccncccggaacttcccccaccgaaaaacccaagctttcaaacgctctgccgtgtctcaaattttagttctaacttccctgganncccattgcatatacacaatntttgggaaaatacgagatatcacacnggtaataatcaacatatanactgtatttgcaatcagggtataatttttttnaaaaaaaaaaaa

SEQ ID NO: 95726 - DNA, 589 bp, Triticum aestivum
  unsure (1)..(589): unsure at all n locations
  Clone ID: PAT_TA_95726
ctaaccctagccgcctcctgcacgcttctcctccgctccccgccccgcctcgagcagctcaggaacgcgcgcagccatggcgacggagaccgagaccttcgccttccaggccgagatcaaccaagctcctctcgctcatcatcaacaccttctactccaacaaggagatcttcctccgcgagctcatctccaatcctccgatgccttgggacaagttcaggtcgaagagctcacggacaagagcaagtccgatgcgcaancccgantcttcatccacatcatccccgacaaggcgaccaacacgtcaagattcgtccgacaagcggatttggatgaccaanccggctcgtcaacactccngncatcgcaagtccggggaccaaaggattcaagggagctccnccgcccggggccgactntccatgatgggatttggnnccgnttcaaccgctactcgtcncnaaaaggtgtctcacacaaaganaagacacancatctgtggatccaagcggtggtctnacgtaccggaaactcngganaatcgaggtcaaangnctcacnagnnacaatgatcctnggncnacagttt

SEQ ID NO: 95727 - DNA, 584 bp, Triticum aestivum
  unsure (1)..(584): unsure at all n locations
  Clone ID: PAT_TA_95727
ggcagacgcgcgccctcgtcgtctcctccccgcgcgccgccgaggcggtcctgcgcacgcacgaccacatcttcgcctcgcggccgccgaacgcgttcgccgacgccctcctggacggcggcgccgacgtcgccttcgccccctacggagagttctggcggcaggccaggaggctggtcaccacgcacctgctcagcgccaggaaggtgcactccgctccgccgcggccgcgaggaggaggcgcgcctgggtgatggcaagatcagggcgcggcggncgccggcgcctccgtggacatgacgaactgctcggcncttcaacaacgacatagcgtgccttccgtgtccgggaagtcttccgggaggaaggccggaacgantgttcaaggaagcgatngacggaactgggcgcntcggcgggtcaactgctggatattccgggctggcaaagtggctgtcgccgatgcgttgccaaacatcngtnaagagaaatggacactgtccataaatatcgacacatttagaaanancgcanaganaaacacagncatagaaaannnaaaggaactctcattgcctacctag

SEQ ID NO: 95728 - DNA, 440 bp, Triticum aestivum
  unsure (1)..(440): unsure at all n locations
  Clone ID: PAT_TA_95728
tcgtggatgcctccggtggtttatatgtgaatatataggaggaagatctaggtcagggggtcactaaggggcccacacggtagggggcacgccctccacccttatcaccaccttgtagctcttctgacttacactgcaagtctcctgggtttcttttgggtccaagaaaaacatccgtgaatgttttattccgtttgggactcccgtttgggtattccttttcctacgaaggctcaaaaaacaaaggaaaaattagaaactgggcactgggatcctaagtttaataggttaancccacaaaaataatataaaataacatattaatgcatataaaacatacaaaattagatnatatnatagcatgggggcaaccaaaatttataatactttggagacgtatcaanatcccccaanttatccctntncccccaaaggggggg

SEQ ID NO: 95729 - DNA, 635 bp, Triticum aestivum
  unsure (1)..(635): unsure at all n locations
  Clone ID: PAT_TA_95729
gaggagcttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcatccctcacctacctcgacggcacgctgcccgggtgactttggtttccaccccttgggggctgtccgaccccggagggnaaccggcgggttcatccagcccaagtggctgggcctacggcganatnttcaaaacggccggacggcaatnatgggggttgttggcatatnnccccgggaggccctggggaaggtgggcctggggcccccggaaaggaatnccttggttccaagcaggccatttcccccggnggnactaacaattannggccgaccanaaagccttcntgtncaaangggccancggttcncggacacggggtccaaaacggtanaacccggcccaagggaacaatantctgggctnaaaatactcgnggtcggaaccgctaaccggngggcatttaaccgtcggtcgacaaacaaagnatagggccanncaaggtnaaagcn

SEQ ID NO: 95730 - DNA, 627 bp, Triticum aestivum
  unsure (1)..(627): unsure at all n locations
  Clone ID: PAT_TA_95730
ctcgtgccgaattcggcacgagcctccgccctctcctccctcccaaacctttcctctccactcccaaaccacaagtccctatcgcccccatcaccgccgtacgctgcaccgcggcgcccaaaccgaccacctccacccccaagcctgcccagcaagaaggcaaccaggagcaagaacccactcccgacgaggccgacgccaacccccaccgcatccccgacgacgagaccccgccgtcggcgactgcgaccactccttctcggtgggtcccggcgctgccgtcggcatctcnaacggacggccgcctccgtcggacgngctgaccaagangagccgcccaactacgaaatncgggttggaagcgcacaagactcccctgggagaagcccaagggtgggcatcgccganttcctgganaactggagggctatgggancccggcgnacggtccggccncnctgggaacgtggcggcttttgacngaccnccgggaggaggggantttgatggccaaggcggctggacaaccctgnnacggaccctcgcntgtgcgtgtgaatgcctgaatgtaaacccgtcagnggaacnnaggacctcanaggccccncggcncagcatctttcntnc

SEQ ID NO: 95731 - DNA, 359 bp, Triticum aestivum
  unsure (1)..(359): unsure at all n locations
  Clone ID: PAT_TA_95731
gttctggttcggttcgggttcggttcgagagagaggccgagtagctagcctagtctagggtttcggtagagaggaagtgagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaatgagtcnatgcgccaggccatcgangagatgaacggcaaggagctcgacgggcgcancatcaccgtcaaccaggccagtcccgccgctccggcggtngnggcg

SEQ ID NO: 95732 - DNA, 607 bp, Triticum aestivum
  unsure (1)..(607): unsure at all n locations
  Clone ID: PAT_TA_95732
ccgccccccaacccaaaccctaccccgccgccgccgtcgccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaaggacaaggagggcatcccgccggaccaagcagcgcctcatcttccgccggtaagcagctcnaggacggccgcacccttgccgactacaacatccaagaagganccaccctccactgggtgctccgcctccgcggcggcgccaaagaacgcaagaagaaacctacaccaaccccaagaanaaaanacaancacaagaagtgaactcgncncctccattnctanaagtcgacacccaccggnaagncacaagtcaaggaggatgcccnaaccccactgcggnccngactttatggcaacatttnacgcantaagngggaattngctcactantttaaacaaaggttaagnggntctttgccgcncttactactactacagancacnattattgccgttgcttaangaacctgntaaantccganttaccaagggttg

SEQ ID NO: 95733 - DNA, 623 bp, Triticum aestivum
  unsure (1)..(623): unsure at all n locations
  Clone ID: PAT_TA_95733
ctcgtgccgaattcggcacgagctcgtgccgaattcggcacgagtgtccccggaggtggcggtggcagcggcagagggggtcagcgaggatggccgctggggcgaggaggcggagccgatgaccccggcggtggcagcgacagagggggtcngngatgatggtcnatggggcgaggaggcggagccgatgaccccggcggcggcggaggggtcccangggctcnaggaccgacgtctgatgcagtcgtggtcctccgtcgtcaagagctaaatngaagcgcccgacggtgtaccgtccaagangaagaggaaagaacatcctgcgccggttcggccgtngcgtcatggaggagacggagagaaaaggcaccggtggccctttaagnccaagaagtcnccgcctcaatcntgcagccatgagggtggaccgatggcgtccaaaaagnactttactttccggtnancctgttctggcgtatcaaancggnatttgaancccgncaaactntaaaggcaanacctanatctanctactgtcctganaatactacaacaatacttcaatggcagtataatcgatgttctatatctatgacagggaacccnttgcagtttanngtaat

SEQ ID NO: 95734 - DNA, 491 bp, Triticum aestivum
  unsure (1)..(491): unsure at all n locations
  Clone ID: PAT_TA_95734
cgccgacatcgccgcccgcttccgcgtcgacgcccaggcggtgctccacgccaacaacctcaccgacagcgagaacatataccccttcaccactctgctcatcccgctcaagagtgcgcccacgccggacatgctcgtgtcgccggcgccaccgccagcaccggcgccaccgcaggcccagcagccgccgccgtctggagggtcgggcagcgggaagggggttgccgtcggggtcggtgttggtgtcggcgttcttgcgctggcgggacttcttgggcctgatgttcttatgtgtccggcggcggcggcgaccgcggcccggcgttgtggaagacggcatccggggaagggcttctcgactgccctcgtctgccgattacacctcttgcctcgggcaagcatactcctcggntacgacgaatcctcgtaacgtcnggtttgtnncaacnaaccgcgcncggggtggatcctgacgtgtanaatactcggaa

SEQ ID NO: 95735 - DNA, 433 bp, Triticum aestivum
  unsure (1)..(433): unsure at all n locations
  Clone ID: PAT_TA_95735
ctgcccacgacggtcagacctcaccaggatcctctgcgctgtgcgctacccacatttcacacccacaccgcaacaaactcgtcgtcgccgtcgtcgccaggaaacgcatgtgacccgctgcggcctgaggcgaattctctcctgggtgtccgtgtccgtttgatgctcaaggaggacaggtggggagggacggaggggatcatggacttcaggagcagcaacggcgggtccgtcctccggagcgcangccggcggacggggcgccgctgacgaagcaggggtccatctactccctcacttcgaggattccagacaccntccggcgggggcgccggcgtnggangcaacgactcgggaagattcactccatgaacatggacnactgctcccggacatctggaccccnaggaaaccaagcatggtgctccgcctc

SEQ ID NO: 95736 - DNA, 301 bp, Triticum aestivum
  unsure (1)..(301): unsure at all n locations
  Clone ID: PAT_TA_95736
gatagaatcctcggtatcgcaggtcaactccctgacctggtccctccattgcctggttaatggatcaaggttctccatgtatgccaacttctcaagaacagccttcatagagctgagctcatccaccagtaattccacctgtctgcggtcactgctgaacattgcatactctgccgctgcaagagaaccaagcttctcaaggagggagcatatcacccctgctgcaacactgggtcgctaactccgccattaatgcactctccggtttctcctccgtgccgaatcggacganggggggggc

SEQ ID NO: 95737 - DNA, 491 bp, Triticum aestivum
  unsure (1)..(491): unsure at all n locations
  Clone ID: PAT_TA_95737
ctctctttccctcccactcctccctccccgccgccgcctcctctcccccccgccgccgccgcctctcccaccggctcgatggaccagacgccgcggcgccgccgccggagacgcgccgaggccgccccctccgatggcgccccggacacggcggagtacagcctcgacgagccgaccatggcggagaagctcgcggccctgagtccgcccgccgacgcggcgggcgtcgccgccgtnggtgccccccagcgcccgactccgtccacatcctgctcaagcaggcctgcaagccgacgaccgcgccgcgctgctccggtgcctgttacaacanagacccaagttatcgtgaatcggtntaatcctgacncaacagacgctgtgaattcctcaaatcctggatatcgctcatgcatctagggttaatgctggttggcttgtcccatggttcaactcngttaaccgganatgacanatattccnagatctcncgg

SEQ ID NO: 95738 - DNA, 553 bp, Triticum aestivum
  unsure (1)..(553): unsure at all n locations
  Clone ID: PAT_TA_95738
cccgcccgttccaatcccgtcgacgccaacgccccactctactctctccgacgctgcaacagatcctggcacctgctatgccgccatgccctcaacgtccggctccggcgcagggatgaaggtcaaggtcgccgagccatacttccacaagttatccatggctgcttttgattccgcccagactaggtaatttgcacgaacggtcgattcccgatttcttaccgatctatccagttaacacaattttggtacgacctcattttagctaagttcaagatcaattgagtgcactgtgggattcatagttgcaaaacattcctggtatttccttggcttaatttcctgtataacaagaccccgccgagcgagtctccacaacaagtaactgggatcgacgccgcctccctacaagagcgcacaatcaacgaaactccagatntatcatgttcccgtgtacagactgaantgcctcanaggtccgtgattcctttaaccgtgaacatgtcgttacnatngacatcnnatggtaaagtngcaattcaaaaaaaaaaaa

SEQ ID NO: 95739 - DNA, 306 bp, Triticum aestivum
  unsure (1)..(306): unsure at all n locations
  Clone ID: PAT_TA_95739
cttccccgtaggaatcccacccccggcgacctcacaccccacccccagttccccttgcatcccttccctagctacctacccttgccggcgcaacaactgcccgaggcaccccgtgcccacctcgacctagtccaccctactacctccctctagcttccccatactccacccgcaagccgccacacccacctcaccttctccggtggggcacaccgcctcgagctcaagccccaccctcaatcttctccggcgcggcgcaccaccccgagcgtcggcaatcttccccaccttctngngggnaaaacc

SEQ ID NO: 95740 - DNA, 418 bp, Triticum aestivum
  unsure (1)..(418): unsure at all n locations
  Clone ID: PAT_TA_95740
ctcgtgccgaattcggcacgagattgaaactaaaattatataaaatttatgcaactaaaattatcaaagtattttctgttcaaaacattataaggaaaaggaattttcataaaattaataaaaaaacaaaaaataaaataaaataaataagtagaaacaaaataaactttaataataagtaggaacaaaataaaataaaataaattttaataaaataaataagtagaaacaaaaaaataaagcaaaaaagaaaacaaaaaaactgggaaaaaataaaaaatgccacctacttgggccaccacggcctgactacgactagaaacccaaccatgggtcaggattcaggcccgcagaaggcccagtaggcccacatgcagcatagtgtgtgatcaggcccagtaaacaacatttgaganga

SEQ ID NO: 95741 - DNA, 637 bp, Triticum aestivum
  unsure (1)..(637): unsure at all n locations
  Clone ID: PAT_TA_95741
acctgcaaacgcagtcctgcctggtcagaacggagcacctgtttactgtaatggggttggtccggtgcctcagtattaccttggagctcctttcatgtacccatggagcatggggtggaataaccttcctgtaatggtgccgggtggaagtatgcccgagtctgcttctccatcagaaagctgcagcactagttcggcgccatggatgaactctcccatgatgccaggctcaaggcttcctgcacccccgtttccatatcctcttgttccgcctgccctctggggttgcttaccaaactgggcagccgcggcatggaacacaccatggatncgggaccaatggggtgcatatctccgtctgggtcaaagcaacacagctgttcaagcaatggtctcctaccctggggaacattctaaggactcaatccacagaaagatgacaaggaggaaancacgtggttccaagaatcgcannatatnccacangacaaaatcatatgggaactggnacaaactgagaccggngcttaaccttaatnaaggtaaacaggcacacaatcancctgcgtctaagnaacccactttccgcatatcagaacctaacgaggtngcacaaaatttgaaaaatnccgttaat

SEQ ID NO: 95742 - DNA, 601 bp, Triticum aestivum
  unsure (1)..(601): unsure at all n locations
  Clone ID: PAT_TA_95742
cacagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaaggcgcgcgtcaccatgcgcaagaccgcggccaaggccaagccggtgtcgtcgggcagcccgtggtacggctccgaccgcgtgctctacctccggccgctatccggcgaccccccgactacctcaccggtgattcccccggcgactacggatgggacaccgcggggtcttcggccgaccccgaacttccgccaagaaccggaantggagtgatcactgccggtgggcatgctgggcgcgctcggtgctcttcccggactctcgcccgcaacgctcaattccgcaagcgttngttcaaggcngtcccantttnaaccaaggcggctcaatactcgggaaccaagctcttcatcgaaagatctccatcgggctgcagtctgtatggcnctcanggtaacgctcccgnggccctcgnaaatttnaccgtntaccgggganttaacctggcccta

SEQ ID NO: 95743 - DNA, 505 bp, Triticum aestivum
  unsure (1)..(505): unsure at all n locations
  Clone ID: PAT_TA_95743
agcagcgccaccaccagcatccgcagcatcatcaccagcaccacaggcagcatctagctagctagtacggagtagtagcgagcacagcgagaactaaccatcttacagagagagagtggtcnngatgaagaagnagggagagggagatggaggcgacggcagtgagcctgacccgcacggtcctggacggggtgctgggcagcgcgggcacggcgatggccgacgaggcggccctgctgctcggcgtccggagggaggtgggcttcatccgcagcgagctgcagatgatgcagtccttcctgcggggtgcagtcctccgccangcgctggggcgccgacggcgggggtgcaganacacggtgcgcacgtgcgtcaagcagtgcncgactcgcgtgcgactggaggactgctctanactnacctgcacgctccggtcngctggctgctctgggcccggctcncngccgcacgnntgccggcggatcggggctaagcnacgtnttga

SEQ ID NO: 95744 - DNA, 746 bp, Triticum aestivum
  unsure (1)..(746): unsure at all n locations
  Clone ID: PAT_TA_95744
accttgcgcgccattaaccctcaataaagggaacaaaagcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggtcacgtagtggggccatcgccctgatagacggttttccgccctttgacgttgganccacgttctttaatagtggcccttgttccaaactgggaacaacactcaacctactccggtctatccttttgatttaataaggatttgccgattccgcctattggttaaaaaatgactgatttaacaaaatttnacgcgatttttacaaatattaacgcttacatttaagggganttttccggaaatttccccgaacccaattgttattttccaaatanatccaatatgtacccnccatgaganataacctgataatgttcaataatattgaaaagganatatgntatcaacattcgtgtccctatccntttgcggaattgctccggtttgccacaaaaancgggaataaaancnaataattgggacaaggtaacaaaggttcaaaggaatnttaattccnaaatta

SEQ ID NO: 95745 - DNA, 661 bp, Triticum aestivum
  unsure (1)..(661): unsure at all n locations
  Clone ID: PAT_TA_95745
gttatactgcagctaagcagtatagtctgaaattctaagtttgaggaggatttcagtgtttctaaagaaagggacaaggatcagggctataagattgttgaaagactcagagacatgtatcatgaatcgggtacagtatgctttctacccgtcttttccttatattgactaaaccttagtaaatgactatttccagttttctcatgtaacctgaactgctgctggtttaaatttcagttcccgcaagctgcggacacatggtctgctccgtgtcctcctacctgcttcaaggcctctaattcttcccccaagattgccattatgattaacaatctgacgaaancaatttaattggggcacatcanattattctgnacngaagttaatcccanctgcgctactctttgcttacanttaaatgnactttangcannaaagaatanaaaacacacgtgatctaaggngatatttgcaanaatccaactagcaatgataactntatcgnnaatcgggtgttgtgnatcatgactagatacacagaaatatccgagngtanggagtatacattcccgtatttgacacttganactatggagttaacaatncnttgatncagngaactaaatttcataccgcgnaataagtactcanattaaacatt

SEQ ID NO: 95746 - DNA, 689 bp, Triticum aestivum
  unsure (1)..(689): unsure at all n locations
  Clone ID: PAT_TA_95746
cttggtaaccttggcaccggtggggtccttcttctccacgcccttgatgacaccaacagcaaccgtttgtctcatatcacgcacagcaaagcggccaagaggagggtaggtggcgaaggtctccacaaccatgggcttgtgtgggaatcatcttcacgataccggcgtcaccattcttgaggaacttgggcagcgcctccagtccttaccagatcgcctgtccatcttgggcaccaagtcaagcaaacttgacagcatgtggaaggtgttggnagtcccaacactggggcatagccgttaccgatctgacaaggntggttcaagatgataactgggaggtgaanttttggccnctccttggnaaggnaaccttggngtttggntgcaanaaaccaaccttcaaatccttaacaaaacgtctttganttgaaccnacnttgtcacaagnaaagctccagnaanaancctggggntctcaanaaatntctcantntcaaacaatgggacaanggtanacatcnagctgntgaacaattaaaacggcaacagganattcaagcacaacttaaaactaaggaaaccaaggcttnctaggccctggccctgttggcaacccaaagnaggcctttcaanaggttngcccaaaagtnccccaacnaatngaaggactttagttcacnnttggaaan

SEQ ID NO: 95747 - DNA, 620 bp, Triticum aestivum
  unsure (1)..(620): unsure at all n locations
  Clone ID: PAT_TA_95747
ggaaggaaggaatggaaaggaaggatgttatgacgaaaaatgtttcaatctacaaagctcaagcatctgctcttgaagctcatgcagcccccaattgcaaggttttggttgttgccaacccagcaaacaccaatgctctcatcctgaaggagtttgctccatctatccctgagaagaacacattgtttgacccgcctagaccacaacagggcactcggtcaagtttctgagagactggtgtccaatttcctgacgttaagaatgctattatctgggggtatcaacccntccaatcantaaccctgatgttaacaagcaactttnaaaccccaantgggaaaaaacttttcntgaaattttccaaantatnaatgntaatnggaantcaatgcantgtccaacaacttgggctgcatcatcaaancaggaanctcnatgcctctcngtgcantcacttgtgatnaatcctnacgggtctggaacccttngggantttttccagggtggtaccgangtcaaacgtgtgctgcggctaacaaccttcanaactcatggngtaaggnatnttagggtccntnatanttcaganaatgncacnccanacttnagaaaggttgcaa

SEQ ID NO: 95748 - DNA, 339 bp, Triticum aestivum
  unsure (1)..(339): unsure at all n locations
  Clone ID: PAT_TA_95748
ctcgtgccgaattcggcacgaggccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgatccatccatccatctaataccatgtaacgctacctgantcgaaggcctttgtatgttggtnnaagcacctgccaacataacanagcaagttnantcccatcatttaaccgacccctnaataatccccngtggnttaacctaa

SEQ ID NO: 95749 - DNA, 322 bp, Triticum aestivum
  unsure (1)..(322): unsure at all n locations
  Clone ID: PAT_TA_95749
atactgtgtgctgcataactaaaaataatcaatctgtaggtttagtaatacaatcttgattaatagacagatcaattatgtcagtcaatgaattttttgctggagtcaaggatgcgagacatttattatatttgttgcttgtgttgggaaggaaatcaaatcaaacgttcattgtttttagttgttattcctaatagagtagcacatgaaaactcaaaacaaaataggaaagtgttgtggcattttaatactgaaaccaacagggtactaaagaaactggatggatataaacctccgtgcatcnacncaagggggggggggg

SEQ ID NO: 95750 - DNA, 519 bp, Triticum aestivum
  unsure (1)..(519): unsure at all n locations
  Clone ID: PAT_TA_95750
ctccagcctgccccctcccccagtccccaaatccgtagtcccgcgcgccgcgatggaggcgagcaagctcaaggcggccaggctcctggagcagatgagcgcccacctcgccaccgacgccggcaaggagatcgccaacaaggtcggcttcgtctaccagctcaacatctcgcccaagaagatgggcgtggacgaggagntttccgtccgtggacctcaaagaaggggcctctccacagggaantacgaggggacgccggacgcggcttcacttcaccgacgacactcctcgccatccgccaacggcaagctgaaccgcagatgcgtttataaggggcaantgaagatttaagggganatcaacgccgcgcagaattcangccggnatcttccccaagcgtccaagtngtanaacccgattgcctnncttgcccagtgancgtttataaaaatcattatctccccatggattgtgttgacaaattaaaaattggttactagaacacacaagacacagan

SEQ ID NO: 95751 - DNA, 391 bp, Triticum aestivum
  unsure (1)..(391): unsure at all n locations
  Clone ID: PAT_TA_95751
gggtagggttccttgcggccgaagcggccacgcacgcaccacaccacaacttagacagtccacccgccgcctcgcggctccaaaaccctcgcctcacccccgcccccctagggttcgcctcgcctcgcagcgccgcgccgccgcagccatgggctcatcgctcccggccaaggaggcaacctcttcaaatcatcgtcaatcatatgaaactaagcaatnataagaaaaggtngaaaggcgcaaattccatattnaagaatttcccngaacattgggaatttntccattaaaggtttgcactaattttatggnttnggaatcctnancaanaaatttttccccctngntttaaaantttnaaaancanttncctgaattntnggttaattta

SEQ ID NO: 95752 - DNA, 468 bp, Triticum aestivum
  unsure (1)..(468): unsure at all n locations
  Clone ID: PAT_TA_95752
agaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagtccggcgggatggagatggcggccgagaacggcggctgcggctgcacccagtgcaagtgcggaccaactgcggctgtcctgctgcagcttgctagattcatcatcgatnatgcatcaccgtnccgttcttcatcatcattcgtaacgattntaatactaacatacnatttaacccaactgattngaggctttangttcgcaccttaactgcataagaatcaaggtccatgcatattgtaacagcccccttaataactcccttnattaaaa

SEQ ID NO: 95753 - DNA, 691 bp, Triticum aestivum
  unsure (1)..(691): unsure at all n locations
  Clone ID: PAT_TA_95753
cttctccaccaccggccgccgccgcggccaggccggcgtggcggcgcgccaccgcgccatcaccagcatccaccagcaccaatccatctccacgccgccgccagcacacaccacccatccatccagccaccagagccaccgcatcaccaccgcgcctccaccccatgctcgcgcgctcgaccagacgaggtgcctgggtgccccgcgcgaccatccccacgctgctgctgctcttcccacgtccctggatgctgctctgcttgcgcccgatntctgctgctccttcttcaatctcctgctgcttctcttcttctatccccaaaaactgttgctgtccccatcctcaacttccttngctgtcctctttcttcaatcatgcttctgctttccccaacgttctgttcctttcttctccttnatttcctgcctgcgcttctccttctcctttaactgctgcgattctctctctccaaatctttgctgtgcctgctgaacctcaagctgtctctccttctntcaanaaanggtgctgtccttctgccaagctcnctgcgctctctctctanactttgcngcgcatctttcccncncctccnaaatcgtattnaatanaacttganatagtcanatgccgaacgnaagttagtaactgnggtattgnttnaaaaaaaaancnggggggccatncntt

SEQ ID NO: 95754 - DNA, 600 bp, Triticum aestivum
  unsure (1)..(600): unsure at all n locations
  Clone ID: PAT_TA_95754
gcaacaagatcctcagggccagcacttcggtgaagcttgttttgtatggtatgcttgatttcttgcttgagctcatgtgggatgtcattgcgatgagcaatatcacgaattcgtgttagagggacagtggcagtaaactccgacttaaacgaaggtaaacagggatgaatcttgcgaatcacaagcacatcctcaaggtgatatgccttttgtgtaagtacatcttttcaattcacggaaaatttgcctccgatatctcagcatgttttgttgggncgggtaatgaccgccatcttccngaacaagatatcctgacctgttataaaccaactnttaaataaatagcaagagcatatgaagacctcccatcctactttggttaaccaacangtttttganaaaaagccggngaacaagttntaactnctgccaccattcctaanccattttccaccccaacatttaaanccattccancnaaccaacttacccatnccgncatccactatccaagccattgnccatnaaanagttncnactncaatgccanaaagnttcacatcccnggcaantgaantgaaatccaacgttgggacaatt

SEQ ID NO: 95755 - DNA, 391 bp, Triticum aestivum
  unsure (1)..(391): unsure at all n locations
  Clone ID: PAT_TA_95755
ccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaagctccgttggtggcatgcagttcttcgtcaaagacccttgaccggcaagacatcaaccttggagncccancctcctgacacatccgacaantccaaggcaagttccaagacaaggagggatccaaccggacaacagcgtct

SEQ ID NO: 95756 - DNA, 452 bp, Triticum aestivum
  unsure (1)..(452): unsure at all n locations
  Clone ID: PAT_TA_95756
ctcgtgccgaattcggcacgaggacaaggaagagtagcatccatggcgtgcatcaataccttgcagagctgctccatgttcaaaggggccaaggctgaggccagaaggggcaaagccaccggcgcagggagcttcgggtgccgggcgtccacgttcatggacgggaacgggctcccggctccgggtccgacgagaaccccgaccgccatcatctccggcnagtggcccnaaaatttccctnctcnancttcgaacactcccgcgcctacttcaatncccagcaagaagcagcagaanaacaatttccaaacttgcattttaaaaaangggccctcncttgcnaggcatttnaaccccntctgatgncanaacnggcnaggcttgtggaggtttaagnattttaccctttagccccggttttcaaagccccaancttcgntctcctaaaanat

SEQ ID NO: 95757 - DNA, 371 bp, Triticum aestivum
  unsure (1)..(371): unsure at all n locations
  Clone ID: PAT_TA_95757
ggccgcccgactttgaccgcctcctcgtctccgctcccacgcccgcgggagagaggcgaccggcggcggcgcgcgaggagggcctacccatcccacccaccaccccgccggccaagatgttcggncgcgcccccaagaagagcgacaacaccaagtactacgatgtgctcggggtgcccaagaacgccgcccaggacgacctcaagaaggcctaccgcaaggncgccatcaataaccaccccgacaatggcggngaccccgagaagttcaaaggagctggcacacgcctatgaggttttgnntgaccctgcagaagcntgagatctangatcantatggcgaaagatgtctcaatgaggattggttgaggg

SEQ ID NO: 95758 - DNA, 318 bp, Triticum aestivum
  unsure (1)..(318): unsure at all n locations
  Clone ID: PAT_TA_95758
ctcgtgccgaattcggcacgagtccangttcacctccaccctgcctccccattttttatacacacacccaccgcgaangtcaggccgccccgcccgccagccacaaggnaagagngagacgaaaacataaacgccccganangatataagtngtgcggcagangtggaatctgggacagaccaaatcnncggcaagaancangcagccatggcnacgcangncgccntcgcaatgntgttccccanatttncagccgnncacngggccaangncatggacagccggngacncnggtcaggtatcnnncgcacgggcgt

SEQ ID NO: 95759 - DNA, 349 bp, Triticum aestivum
  unsure (1)..(349): unsure at all n locations
  Clone ID: PAT_TA_95759
ctcgtgccgaattcggcacgagaaaaggaataattcgcgttcgcgtgatcagtagccagccagtacacaatgcttacagttgccatatactccctctctacagtgcacgcatacacagtaacacgttacacggtgctctgcccgtctttgggcatctcagtccgacgagccgggccagacattggaacggcagcgagactccttngacgacggcggcgaggccgagggagacgctgggcgccaaatgacagcagtttggaccgcccacctgccgcgcccgaacgccacgcagacttcnacgccgactttcccaaaaacgttagccggcccttggaccaattaaancaac

SEQ ID NO: 95760 - DNA, 322 bp, Triticum aestivum
  unsure (1)..(322): unsure at all n locations
  Clone ID: PAT_TA_95760
ctcgcgccgccgcaccaccaaccagcgccgtcgccgccgccgccgccggagaaggagagggagcagccgcagccatgggtcgcgtccgcaccaagaccgtgaagaagacntcccgccaggtcatcgngaagtnctactctcggatgaccctcgacttccacaccaacaanaangtgntagaggaggtctcnatcctccagtcganncgcctcngcaacaaggtngnccggnttcaccacccatctgatgcttgcatccaagcgccngncccgtgcancggcatctccctcaagctgnaggaggaagannttnaccgccgcat

SEQ ID NO: 95761 - DNA, 435 bp, Triticum aestivum
  unsure (1)..(435): unsure at all n locations
  Clone ID: PAT_TA_95761
gttcgctttccctcttcctgtccccctcagcgcggcgcttggcttgctcagtctcacagctgtttcttggcatccgtctcctcgtcctgtccgtcgtcgcagctgtccttgccggccggccctttcccttccttgggggctctccagggccctcttctcctcctcctcttcgtcgttgtccttcgccgccgccgctgccgccgacttgccgccgtccgagacaccgcttctccggcgcgcgtttcaagggctccaagcantcctccatcgcctctccttcccgttcctccggtcttggattaanactccgtcaagtccgccggcgtgatttccgcgctcgattcatcctcaanccccgcacactccggngccgttntccgcgcggattcnagaagagtantctttagangatttttaacgccggaactgcatacc

SEQ ID NO: 95762 - DNA, 585 bp, Triticum aestivum
  unsure (1)..(585): unsure at all n locations
  Clone ID: PAT_TA_95762
ctcgtgccgaattcggcacgagcagcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgaagggccgcatcaccatgcgcaagacggcgggcaagccaaggtggcggcgtccagcagccgtgggtacggtccgaccgcgtgctctacctccggccgtctccgggaccccccgagtactcaccggcgantccccggcgactacggcgggaacgcgggctgtccgccgaacccaaccttcgccaaaacgggactggagtcatcaacnccgctggcatgttcgggcgtcggtgctcttccccgactgtccccgcaacgntcaantccgcnagcgtctgttcaangccgtccaattntcaacaaggcgctcnatactcggaacccaacttgtgacngnaaaanctccnncgggctcaagtgtgnaatggcccgtgaggtacctcccggggccctgcaaatctgncgnttaccgggaatnanc

SEQ ID NO: 95763 - DNA, 592 bp, Triticum aestivum
  unsure (1)..(592): unsure at all n locations
  Clone ID: PAT_TA_95763
atccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaaggacaaggagggcatccctccggattcagcagcgtctcatcttccgctgggcaagcagtccgaggatggccgcaccctggctgactacaacatccagaaggaatccacatccactgggtgctcaaatccgttggtgggatgcantttttccgtcaaaaccctggaccggcaaacatcacctggaggttgancctctgaacatcgacactcaaggcaagttcaagacaaggagnattcccccngacaacacnccaattttgctgggaacactccaggatngcgcagctcnctgatacaatccanaagatccaatccactggtgtcangccgtgggggatcaanttcgtcaanacctgacgggaaacacacctggagtcaatctctgaacatnaaagtcaggcaanntcaganagngggatccacgncaaaagtttatcttnngag

SEQ ID NO: 95764 - DNA, 482 bp, Triticum aestivum
  unsure (1)..(482): unsure at all n locations
  Clone ID: PAT_TA_95764
ctcgtgccgaattcggcaccagtctacgtccgcggcaccatcctcggatacaagaggtccaagtcgaaccagtacgagacggcgtcgctggtgcagatcgagggggtgaacaccagggaggacgtggcctgggtacggcggcaagaggatggcctacgtctacaaggccaagaccaagagcaacggcacccactaccgctgcatctggggcaaggtctccccgcccccacggcaacaccggcgtcctccgcgccaattcacctccaacctgcccgcccgaggccatggggaaaaagtcaggtcttcaatttccccnacanatctaaaagtattttgaatgttggagtttcctctcccttagtttaattcaaagcctgtaaatggttcaaggctggatacantcaactgcgtttccctgtgaanacngtacctcaangttaccttaagtgtnggcccaattaatgatgtanatgtnatcccaa

SEQ ID NO: 95765 - DNA, 431 bp, Triticum aestivum
  unsure (1)..(431): unsure at all n locations
  Clone ID: PAT_TA_95765
gaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttgggtggagttttgcccccaagccatcatctgggtcctcacaaggccagggagtgcctgcctctgattctcatccttgaggaacagactgaatatctctcacctaccgttaaatgcatctatcctttatcagcgtcatatcatggttgatggaaaaggtcccgcactgacaanctacctgctggttcaaatgnaacatttccattccccaaaacnggtganaataaagttcctttaatacacaagggcctttcgccttaacctttcaggaataagatcantttaactctg

SEQ ID NO: 95766 - DNA, 496 bp, Triticum aestivum
  unsure (1)..(496): unsure at all n locations
  Clone ID: PAT_TA_95766
ggaaagagtagctcgaccgagcaaaccgattcatggcgacngcggcgtgtcctctccctcaccggtgtctgctcctcctccatctggccctcctcgctttcctgctggcggcggccccggcggccgaggcgtntgacgggggaagattnngccggccgcgtcctctgcgaacgttctgcgcccgactcctgccatccgggccccgaaggaccacgtcctccgaaaggcgctgaggttgctgttcctgttgcatcnacgaatctggtgaaggtcatcaactaccaagncgtttaacaaactacaaagggcgtctacagcgttnccanagacatgccttaanaacgaccgatggattccntgccttggnaaggccatcaacaacttccaacaacatncaccaagaaggggggaccaatcctgggtcaanttaaaattcacaacatcnagggacttcnaaaagttcaaanttctctanaacctgcaacttctctttatt

SEQ ID NO: 95767 - DNA, 490 bp, Triticum aestivum
  unsure (1)..(490): unsure at all n locations
  Clone ID: PAT_TA_95767
ccattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttccgcttgcagccagtgccgatnagattttgctgtttgctgctcaagcaaagcaggatacagtggagaaggtttgttgaaattgtttagaagcagcttgctgttnctgaagcactgaatttgcggtaccaccaantttcctgaccttgggagcttattcaactggacacgtccagattgtgatgggccttnaggaggattccaattaagcgttggaggagaagaacgcgcaggcattncgacagttgaaatgctccacctcatttacaacttgtctctcgaatcacttgaaggaagtcctaatcntaatgattgggactcctaacnan

SEQ ID NO: 95768 - DNA, 348 bp, Triticum aestivum
  unsure (1)..(348): unsure at all n locations
  Clone ID: PAT_TA_95768
ctcgtgccgaattcggcacgagcatctcactgagctcgcaggcagccccagccaccagcgaaatggccgcgtcggcgctgcaccagacgaccagcttcctcggcaccgccccgcggcgtgatgacctcgtccgcagcgtcngcgacttctgcggccgcatcaccatncgccggaccgtcnagagcgcgccccaagagcatctgggtacngccctgaccgtcccaagtactgngccttctccgagcagaccccgcngtacctgaccggcgantnccccggcgactaacngggtggganaacgccggttttntngctgncccanaaacttctnccnaaaacnggaactgg

SEQ ID NO: 95769 - DNA, 463 bp, Triticum aestivum
  unsure (1)..(463): unsure at all n locations
  Clone ID: PAT_TA_95769
gtttcattttggatgggcaagaatgtcgccaaggcccgtacgtggaccatcagacattttctttgagatttttgccaagtaccacgacgacgcatcttgttcatctaccgccatttttgggaaccgctaagaacggcaagtacctccggcaatacctttgacgcccgatgcatagaacgactaccgtcgccgaacgacccaagtaccactaccgtcgacctccgaaagaccccatgggacgtccaaatactttcccgtgacctcccaacatcctacgaatgttccacgactacaaaatggggtaccactaccattgccggaaacccgttgtaacggatcgtcaantcccgactaccgttcgccgttgaacaactacttccaactacggccgttcnccgagaacgctacttccctccnacaacttgattcgtttccngatnaggacctttccnaactttcaagt

SEQ ID NO: 95770 - DNA, 447 bp, Triticum aestivum
  unsure (1)..(447): unsure at all n locations
  Clone ID: PAT_TA_95770
ccaccacctacctcacaaagaaagacaggtcaacctcacccaggagaagaagagagagaagcgagaagatgtcggggcgcggcaagggaggcaaggggctcggcaagggcggcgccaagcgccaccggaaggtcctccgcgacaacatccagggcatcaccaagccggcgatccggaggctggcgcgtcggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccanggacgcaacctctacggtttcgggggctaagctccggcgangcgaatcaacttcacacttgatcagataacagtantaggctttcagtgtcatggta

SEQ ID NO: 95771 - DNA, 461 bp, Triticum aestivum
  unsure (1)..(461): unsure at all n locations
  Clone ID: PAT_TA_95771
ctcgtgccgaattcggcacgagccaagaaatccacagagaccaagcccaggcccagcccaaagcccaccacgagcccgaggatggccgccgcagagacgccgccgccgaccggcgggatgggcttcctggggctgctcagcttccgccgcagcgccaccgccgtagcctccttcgacccggcgcaggacgacgagctgctcgtcctcgacgcgctccaggcccacgtcgccgaccgcctcgccgccctctccacctccgcgcagcaggggcagcaggggccagtgctctcgctggcgttcctctccaagctgctcgacgccgtggtgtcctcggacgccgcgttccgggacgccctcgccgtgggccccgtgggcgccgcgctcgcccggncccccgccgaccgcctcgccgccgactgctcgaccgctccgtcaaggcgctcgacgtgctcaacgccgtn

SEQ ID NO: 95772 - DNA, 454 bp, Triticum aestivum
  unsure (1)..(454): unsure at all n locations
  Clone ID: PAT_TA_95772
ccccagatctcctttatcatttccttctgcgccacccaacccctctgctttcgaggcctccgaccaccatccctccatggctccccgcccagtgccttccaaggtcacccatggatctgtacccaccggccaccaccatccatggctcctccggtattgggacacgacgtcgtcccatctccgttctagacatcaccatgtgacaccaacgcttggcctgctcctccaccacggcccagctcggaccacgccgctatcgatgccgccgttgagaatccaccccaactcgagcagttcaacggcgtcatggaggaagcancgagcaaccgcattgcaaatatgaggaacatcatcagtgcaagaatcaaatcactccgaacggngaagaatatcncatanttttgttcaaatagtaggtgcactcccaanttgatacttatgaacaccatctgag

SEQ ID NO: 95773 - DNA, 233 bp, Triticum aestivum
  unsure (1)..(233): unsure at all n locations
  Clone ID: PAT_TA_95773
ctcgtgccnaattcngcaccaggccagagggagggaaggaaanttcncagctctccgncatgacctccgtgccgcanttccacggnctcaggagctactcntcacccaggtccatggtgannctaccgtccttgatgaacangtcacagggcatccgctgcgactanatcggntcctccacnaatatcatcatggtgacnactannatcctgatgctgttcncnggncggttc

SEQ ID NO: 95774 - DNA, 482 bp, Triticum aestivum
  unsure (1)..(482): unsure at all n locations
  Clone ID: PAT_TA_95774
ctcgtgccgaattcggcacgagcatatgcaatgtttgtgttgctttctctatgaataacatatgtcacatctgataacaaagttattgctattttattcttttgggaagataaactatcaacatcagaacccataaccaaatcgacaagtttcgctgataaaacaagcatgttatggaaaatcaggcaaatgaacatgttcactgatatcgaccaaaagagggactgccgcatgtttcatttacttcttttctactaaaaatagaaatatagcacagtccacaaattgattagttattttttaccgaaacacatgcctctatngtgctccacaaatcgactgtgtttgccaagacacaggcaaccgtttgaagtatgttaaaagattacgcaagtgcgtacaaaagaagatggtgttgcacaaaaataagtttgtgcatataaacaaaaaaaatctacatgcaccaaaaaacgattatcaaa

SEQ ID NO: 95775 - DNA, 320 bp, Triticum aestivum
  unsure (1)..(320): unsure at all n locations
  Clone ID: PAT_TA_95775
ttttttttttttcagatagagaaaagtaggagcttctctgagtaaaaccccccacacgtcaggtcataaaagtaggagtacttgttactgaaggaagcttcagagtgtcatcaactaacagagcgttgagaatcacgtgtggtatancaaggccccagccaccaagattggttgattgacatacaaggactaacaataaaattatcagtttcattcaggactancgatgccaaattagcatgtacctgacatactatagcagacaaccaacatccactcangcaatgaacangcanagactactatgcnatngtctccat

SEQ ID NO: 95776 - DNA, 478 bp, Triticum aestivum
  unsure (1)..(478): unsure at all n locations
  Clone ID: PAT_TA_95776
gccatggaagctgtgtaccaagcgctggtcgtgaccgtggctgccttcgtaggcatctccttaccctgcctcctcctcgccttcctctgccgccaccgcaagaaccgcctcctcgagccggaccaccgctgctcgtcatcgtcgtccctcccaatctccgccccggtcggaatatcgtcggagctctcctcgtcgtggtcgctgtacggatcggccgtcgactcctcgctcaagaagctctcgctcgacgacctcgccagggccaccggcgaatctccccggacaacatcatcggcgacggcagcttcgggttcgtgtaccgcgccgtgctcccggacggaggacgccgtttgccgtgaaacgcctctccgcgggacaangccgcccgcgccggnaacgcgaantccgcgccgaactggaagtgctcgggaagctcagcaacgcaactcgcgcgcctgctnggtactgngccccccgg

SEQ ID NO: 95777 - DNA, 466 bp, Triticum aestivum
  unsure (1)..(466): unsure at all n locations
  Clone ID: PAT_TA_95777
ctcgtgccgaattcggcacgaggattcatcggcgagcgccccggccgtccccgcgactctcccaccccgcagatcggcagggcggaggagggcatggcgtacatgtgcgccgacagcggcaacctcatggccatcgcgcagcaggtgatccagcagcagcagcagcacaaccagcagcagcagcggcaccaccaccaccaccaccacctcgtcccgccgcccatgccgatgccgcccgcccccgcgcccccgcacgcgcagatcccgggctcgctgccgttcggggccgcggggtccgcggcgtggccccaggccgagaacttcttctctgacgtcttcggggcgtccgccgccgacgccgtgttctccgacctcgccgccggcacggacttcgactccgacgtgtggatggagagcctcatcggggacgcccccgtgttcaaggactcggacctcgacggctcan

SEQ ID NO: 95778 - DNA, 479 bp, Triticum aestivum
  unsure (1)..(479): unsure at all n locations
  Clone ID: PAT_TA_95778
gcagtcttttttattgaacatgagagaatggcaatagctatcatgctttcagtaatctacctgaaaaactaagatatatatgattaacttaggtgaagccaccatggtacaacaaggatgatttcacttaataatcaccagctacttcacaacctagttaaacaaaaataagaaccatcttctagtaggtttggtacctgttataanaagctgattgtacattatgttgctaggtcttcaagcatattcatgcaattcaaacacacatcaccaccaacatcacaagaccaactatgatgcaagttcttgtctcaagttagcggcttgctgcggttctccagtttctcccctgttctctgtatcctcgtcatcgctctcctcgtcctgtgaagcaacaccgcttcaatgttctcctcatcctcctcctcatcctcctcatcatcatagtcatcctcaatctcccaacctgcacaatantc

SEQ ID NO: 95779 - DNA, 452 bp, Triticum aestivum
  unsure (1)..(452): unsure at all n locations
  Clone ID: PAT_TA_95779
agcaagcctcgccacgcccgattctcaccgtccgcgagaccactctcgtagcgccctcgacgagcaccggcgccgccccgccggagtgctccctaccgctcaccttcttcgacatcttctggctcaacctcccaccggtcgagcgcgtcttcttctaccgcctcgccgccgacgccgacgtccccgccatcctctccaacctcaaggcctcactgtcccaagccctccacgcctactacccgctcgccggccgcctccgcctcgcgcctggcacggctgaccgctacgagattcactaccagccgggcgacggcgtcacttcacgttcccgagtaccgtggggacgttcnacgtcnacaagctggccgtcnacaagccgcgggaagataacaagatnncgccgttgcgccgcaattccgaanggggggggccttttnccgctgaagcnacct

SEQ ID NO: 95780 - DNA, 465 bp, Triticum aestivum
  unsure (1)..(465): unsure at all n locations
  Clone ID: PAT_TA_95780
cttccgtcctccccccgtcgtcgcggctccagctagggtttctcgcccccgccctcccgccccaccgccggccccgtccgccatgtcgaagcaaggaggaaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatctggtctcaagaagagtgggaagaaatgagtctgcccacccattcgtaataaccagaaaatgataatctatctatctacctatctgtgtcgcgcttnntatctgtggntgtaacanactaacttcaattgtgttnaacaatgtgcaacntccaatatgtcctaaactatggattcanaanctctntgcttancatananaaatgtcctnnctaaaatnaa

SEQ ID NO: 95781 - DNA, 481 bp, Triticum aestivum
  unsure (1)..(481): unsure at all n locations
  Clone ID: PAT_TA_95781
cacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcacagctgcggctgctcctgctgcaactgctagattcatcatcgattaagcatgcaccgtgccgtgcgtgatcancnattgtatcgatttactactaacatacaagttancccnaacttantcaagggcctttnttttggcaacttaacctgcacaacantcangtncaaagccatgatgttaaaaaggcccccctaaatnaaacctcccctgata

SEQ ID NO: 95782 - DNA, 519 bp, Triticum aestivum
  unsure (1)..(519): unsure at all n locations
  Clone ID: PAT_TA_95782
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggnaacggcaccggcggcgagtcnatctacggcgagaagttcgccgacgagaagttcgtcnacaagcacaccaagcccgggatcctctcnatggccaacgcggggcccaacacaacggctccagttcttatctgcacgtccctgnattggctcgangnaagcactgtcttcgganagtcntcaaggnatggactcgtcaagaaatcaaaagnggg

SEQ ID NO: 95783 - DNA, 537 bp, Triticum aestivum
  unsure (1)..(537): unsure at all n locations
  Clone ID: PAT_TA_95783
tttttttttttttttttatgggccttggggctacaagcatgttgattcgttttaatgcacgtcccaaaagaccaaaaaagctggatccatgtgcataagtatttaagacagcattcacactgggattacacaaacactgaaagaagtaaatactactgctgctgctattcgatgtctcaaaggaacataaactgaagctatgcgcaatacaagagcatttcatttgcctacggtacatcctgcggctcagatcaaaatactgttgtagtttaattaacttcacaataaaatctagaatgtaactcagctactactcgtcaaatcttcaaatgatttttctggaataagtcttcgcaaaccccatatagctaaagggcacttgatactagtatgggcaatgcagcatagataatggggacacaaaatatactcctagcgctaaacaacaggatagcacataagtcaaattatatacaaacatggnggttcgttanttggaaaactgtgccccanaagatggaagtcttctacttcttg

SEQ ID NO: 95784 - DNA, 612 bp, Triticum aestivum
  unsure (1)..(612): unsure at all n locations
  Clone ID: PAT_TA_95784
aagaacttcctgaaaatgtttctgcgcagtttgaccataatatcagcagtataccgaatatgagaaccaaagccttctcgtctcacagttactacctagaaaaggtgcttccgaaactgttggagctaggggctgtgcgtattgctcctttctcaaatagattggctaattcagttccatcaaatatcaatgcgttgagatgtttggcaaactatgaggcattgagattttctgaacccataagaattcttgcagataacatggttgaccgaatgatcaagaagagtgctttgactaatgggaagtacatgtcaattcaacctccgcttttgaaagaggatatggtagctttctcaagctgtatatatgacggtgactgggaaggagaatattgcaatgggagaatgctcgcgaaaggggctggagagggaagtttcgccgaccaagtcgagtgataaatccccgaaggcaatcggaggaatgggagattcctttaactcctatagangttggaatgatgctgcatggcatggggttgataatacaactcactcnagttcctccggtaaaatatcaagctgagaataatgacnctctcccgagttgttcant

SEQ ID NO: 95785 - DNA, 607 bp, Triticum aestivum
  unsure (1)..(607): unsure at all n locations
  Clone ID: PAT_TA_95785
ggaaaggcgtcttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactgggcgcttaccgccagctcttccaccctgagcagcttatcagtggcaaggaggatgcagccaacaacttcgcccgtggtcattacaccattggcaaggagattgttgatctctgccttgatctatcaagaagcttcagacaactgcactggtctcaaggatccctgtctcaaagctgttggaggtggaatggntctggcctggtcccttccccggagcgtcncccgttgactatggaagaatcaaacttgggtcaantttac

SEQ ID NO: 95786 - DNA, 584 bp, Triticum aestivum
  unsure (1)..(584): unsure at all n locations
  Clone ID: PAT_TA_95786
ccggagccgggagtacaagctctgcagcaagcacaccgagggcaagcgcccgctctacgccatcggcttcaacttcatcgacgcccgctactacgacgtcttcgccaccgtcggcggcaatcgtgtgacgacgtaccgtggcctccccgacggtaacttggctgttctgcaagcatacattgatgcggacgatgctcagtcattctacactctgagctgggcttgtgaccttgacggcacaccactgctagtggcagcaggaagcaatgcggtcattcgggtcatcaactgtgccaaccgagaatttgttaagagtttcctgggcaatggggaatcattaattgggatangatccaaccattgaancttcgtcttaattctgcaagcaaggacaatctgttagctatggaatgtcaatacaaggtatcngatcttgattngctgggaggaagaagtcaccgtaatgaantattgantgttgactcaaccttcnganatcaacgaattgcantgtggaaggtaatacgttaaatcgggcaatgaaaaatttggcanactgganaatctttaatgacgactcacaa

SEQ ID NO: 95787 - DNA, 258 bp, Triticum aestivum
  unsure (1)..(258): unsure at all n locations
  Clone ID: PAT_TA_95787
ggacaagaagacaagccgccataagagcaagagcaggggaagatcgaagcacaggaggagcaggaagagtgacagtgaggacgattcggaggaggagagaaccaaggacaagaagaagaataggcggaagaagcacagatcctcagatgaggatagcgagagtgactctgacaggaagaggcacatgaagagtangaaagataggaagaggcggaggacgcaccgccggaaggatgactcatcagaggatgatactgg

SEQ ID NO: 95788 - DNA, 584 bp, Triticum aestivum
  unsure (1)..(584): unsure at all n locations
  Clone ID: PAT_TA_95788
tgtatatttcccactgcctggctcgtcaccttgacctcatcgccgcgccatcgccccaatcggcctccgccgcccgccccatccctttgtcttctcgccgtcntcatcatcccgctccatctcctctcctcggtgctgcggccttccgggtcctgcctgcgaccgtgagggcttgagagggacggtccaacgcacgccgacagggacccggagacgaggagggctagcaatagcaagcaccaccgacctgnctgcaagctgagcaancaaaccanggccagcctcgctcaattggtcgctgctccctccagcttgcgccctgagcagcggncgtcttcattcncnccggtgactgaggtggtcaagaaaggatgtcnaaggagggtcgccngcgnctgccatccggnccngagcaacncgccngcganagagaaaatggnggcggggacaagnngtcgcgaanctgcggggntcgctcgcgtcacgcctgctgcacgcgntctcgtcccggcgncctcgnaagcacanncgancagaaaacactcagattcaggaaaccnngacttcggnggagaccggtggna

SEQ ID NO: 95789 - DNA, 622 bp, Triticum aestivum
  unsure (1)..(622): unsure at all n locations
  Clone ID: PAT_TA_95789
gggaaattcctcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctgggtgctcaagcttcgtgggaggcatgcagatttttcgtcaagacctcaaccgggcaaagacatcaacttggaggtggagtcctcggacacaatcgacaactnaaggcaaagttcaagacaaaggagggcatccctcccggacaacaacgcctcancntcgctgggaaacaacttgaaggatggccgcaacctggctggactacaacatcaanaaggatcaacctccaactggtgctcaagnttctggaaggaagcanattttgtcaaaaagctcacggnaagacatcaacctggaggtgggtctcggcacatcnaaatgtaaggcaagntcaagataagnaggattccccggncaacannttan

SEQ ID NO: 95790 - DNA, 228 bp, Triticum aestivum
  unsure (1)..(228): unsure at all n locations
  Clone ID: PAT_TA_95790
gagtttttttttttttttttttttttttttttttttttttttttttttttttttttttcagcncaaatgcatgatatcatcttgatatgacagatacaagttggggggcttcaaagcccttctttttatctcgtcncctcgctctcnatcganagattatcacaaacgaggaaaattacaagcanagcatgcaggtagctagaaaaacncgagacccacatgacagtg

SEQ ID NO: 95791 - DNA, 550 bp, Triticum aestivum
  unsure (1)..(550): unsure at all n locations
  Clone ID: PAT_TA_95791
accttcccagcgaaaacaccaccacacctctccccgtcgacgcaagaagcagcagcggcatccatggcccccaaggcggagaagaagccggtggcggagaaggccgagaagacgacggcggcgaagaagaccaaggccgagaagcggccgccggcgtccaaggagggcggcgagaagaagggcaagaagaagtccaagaagagcgtggagacttacaagatctacatcttcaaggtgctgaagcaggtgcacccggacatcggcatctcctccaaggccatgtccatcatgaactccttcatcaacgacatcttcgagaagctcgccggcgagtcggccaagctcgccaggtacaacaagaagcccaacatcacgtccagggagattcaaacctccgtccgcctcgtcctcccggcgagctcccaagcangccgtctctgaaggtacaaaggcgtcacaagttanatccgcttaaatacctgctcctgngtttcccnaangtgttgantccccnggtgttnatgaancatggtcgtgtantaaatttcaa

SEQ ID NO: 95792 - DNA, 541 bp, Triticum aestivum
  unsure (1)..(541): unsure at all n locations
  Clone ID: PAT_TA_95792
tggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgatcaagaacagggagaagcataagggaacttcgagacatccacgttgaggatgcncaaggccacaagtttgccacccgtctgggcaacgtgttcacatcggcaanggcacaagccgtggtgagctccccaaaggcaanggtatcaagctcacatcattgaggacaaaggaagcggat

SEQ ID NO: 95793 - DNA, 429 bp, Triticum aestivum
  unsure (1)..(429): unsure at all n locations
  Clone ID: PAT_TA_95793
cggcgatgagttccaccggagcaggcgtcgccggccgcggcaaggcgaaggcgaccaagtcggtgtcgcggtcgtccaaggccgggctccagttccccgtcggccgcatcgcgcgctacctcaaggccggcaagtacgccgagcgcgtcggcgccggcgcccccgtctacctctccgccgtcctcgagtacctcgccgccgaggtgctggagctggccgggaacgcggcgcgggacaacaagaagaccaggatcgtgccgcggcacatccagctggcggtgcgcaacgacgaggagctgagcaagctgctgggctcggtgacgatngccaacggcggcgtgatgcccaacatcaaccangtgctgctgcccaagaaggccgggcccaagggggatctgggctcggctcgcaagantctgagccgcgcgg

SEQ ID NO: 95794 - DNA, 539 bp, Triticum aestivum
  unsure (1)..(539): unsure at all n locations
  Clone ID: PAT_TA_95794
aagaaacaaaagttcgagcagatgccgttctagcaggtacaagaactcccgttcggtaggcgcctgctttagcaatagatgtgagactactaaagaggcaggtaaagtgggaagtgggattcatgatgcaagcttatgaagaaaaaaagagatctcattaatgcttctaaaaatagttatagcaatcccttgccatctgagccagaacgaatcccagtcaaatctctaaatggctctatttaagaatgggtatgccatacaccccgcggggattgtagttcaattggtcagagcaccgccctgtcaaggcggaagctgcgggttcgagccccgtcagtcccgaactagggttcaagcaaatatgacagatagggtacgacatattgcttattcctgattgatctagttgacgacagttgccttgttggaccgattgtggactggtagagtaaataattggattttcctgagttattttttaagggaaagaaggaaangnagatcaaaacnttttctcggacttccaaacanaaatactc

SEQ ID NO: 95795 - DNA, 504 bp, Triticum aestivum
  unsure (1)..(504): unsure at all n locations
  Clone ID: PAT_TA_95795
gagatcttcttcacagtggtccaaacaagaaattanagattcgaaatagctctcagaatggcattgcagttccagatgcaaacagagttccggtcgcgtcaacctccgatgtggttgatttgatgaatcttggtcaaaagaaccgtgcagtttgctcaacggctatgaatgacagaagtagtcgctcccatagttgtgtaacagtccatgttcaagggcgagatttaacatcaggcacggtgctaagaggctgcatgcatcttgtggatttagctggcagcgaaagagtcgataaatccgaggttgtgggagacagattgaaangaggcacaacacataaacaagtcactggcagcactangggatgtcatcgcgtccctcgcccagaaaaatgngcatgttccttaccggaatagcaacttactcanttactgcaggacctcctgggaggacagcaaaacatngagttgtcaaannnccccgaccggntgcatggngaacata

SEQ ID NO: 95796 - DNA, 602 bp, Triticum aestivum
  unsure (1)..(602): unsure at all n locations
  Clone ID: PAT_TA_95796
cacacaagcactagcttcagctagccagcctcagccactccgggcattttcttgcatccacgacggcaatggccaccgctgatgtccagaacccgacggccgcgctgacggaggaggcgcccgcggtggagacgccggtggccgccgaggaggccccgaaagacggaggaggtccccgcgccggcgggaggccgaggtctaggcgtctgcccccgtctaggtttaaggcgaccaaggaggaaggcgccgggcgccgcttagacggaggaagccaaggagaccgaccaagcaactgcngccgacccggaggcgnaggcgcccaaagaccaanaagggcaaccttggtccaaacaaanacaaaggaggccnttgnaaaaggcaaccggggtnncngagttaaanggagnaaggccccctgntgccaacaaaaaaacggnttcccaagaaaaaccgntaacggggngnccccccggctttaaaanacccnccccctgngnactnaactttangggncaaaaaaaaganggctgnggtcacttcaggggggcgttcncanttgaagcatcacattgatggtnatttnaagttatggattaaccggc

SEQ ID NO: 95797 - DNA, 595 bp, Triticum aestivum
  unsure (1)..(595): unsure at all n locations
  Clone ID: PAT_TA_95797
gcacgacacatccaggtccaagcaaagcatccccagccgagccgagaccgcgtgcgctccacgcagcatccgccgcagcagccgcccagagaagtcgcccggagaaaggaggaggatgtcgtggcagacgtacgtcgacgaccacctgtgctgcgagatcgacggccagcacctcacctccgccgccatcctccggccacgacggcagcgtctggggcgcatcccccaacttcccccattcaagcccgaggaattgctggcatcattaaaacttngaggaacctgggaatctttcaccaatggcttttccttgggaggacaaataatggcatccaagtgaacttggtttatcccnaggaaagaaggaccggtggatcactatcaagaaaccgnatggcctattcttgggaccacnatgaccatatcctggcnattcatttggcctggaaagtcgggatactgtccacaagnttttaaccccccgantanttatttggccccnggataattgcncacgtggcttgnacatcncttgngtcaagatttcagnanaattacttggttgcgttgtacttnaggaaaaaggtttncantt

SEQ ID NO: 95798 - DNA, 644 bp, Triticum aestivum
  unsure (1)..(644): unsure at all n locations
  Clone ID: PAT_TA_95798
aaatgaacaagaggtctttcaagtacgcctgggtgcttgacaagctcaaggccgagcgtgagagaggtatcaccatcgatattgccctctggaagtttgagacaaccaagtactactgcaccgtcattgatgcccctgggtcaccgtgacttcatcaagaacatgatcaccggtacctcccaggctgactgtgctgttctcatcatcgactccaccactgggtggtttgaggctgggtatctccaaggatggccaagacacgtngagcacncctccttgctttcactccttgggagtgaagcagatgattctgctgctgcaacaagatgggacgccacaatccccaaattacccgaaggtcctttacgaaagaaattgttaaggagnctcttcctacctgaagaagnccggtacaaccctggacaaggtcccttccgtcccnactctgggtccaagggtgacaacatgatntagaggccacaacctntacnggganaaggccaacctgctttaggacttacaanttaacaaccaagagcctnanaaacctcgtctccctanaggtttaaaaatggggnatgaacgtccgttgcctnttaaacgggtacaaccngaaggtgtacttggccaangccgaaanagga

SEQ ID NO: 95799 - DNA, 525 bp, Triticum aestivum
  unsure (1)..(525): unsure at all n locations
  Clone ID: PAT_TA_95799
cagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagtccggcggnttcgagaccgccggcggggaaaccggcggctgcgactgcacaactgcaanngcggaacggcctgcggctgctcctgctgcagctgcaatgaccggngcccaagaaggccggccggcgaggcnacacaggattagganggacaactggcaagcaacaacaacaacaacaacaacatcaacaaccgctgatccccgcccgcgcgcgcgctgaataaataaacctccngtgtcctnanccgtactgtanccgtntttcaacaattatgccttctaatcctcaanctaatantgggctctcnagtnattctcngncncc

SEQ ID NO: 95800 - DNA, 603 bp, Triticum aestivum
  unsure (1)..(603): unsure at all n locations
  Clone ID: PAT_TA_95800
atcactagctaatacggtgcactgttagctacagaccaagaagtgatcatggcccgcgctcaggtaatgctcatggccgtcgccttggtgctgatgctcgcggcggtcccgcgcgctgccgtggccatcgactgcggccacgttgacagcttggtgaagaccctgcctggagctacgttcaagggcggcccacccntctgggcaattgctgcggcggcgtccaagagctccataaccaaggcgcatccaaaagcgatttgccaagccgctttcaactgcctccaaggggatttctccctggatccaacatcctccaacgaaggacaacgcccgcacctcgccccccaantgcgtgtccacctccccatacacatcatcctccacatccactgcaacatgttttaatgacgacattcgtncaaccnggnntcagtcatccatcannttgattttaaccccanctctancctaagttntaangcaccaattagccatttatacngatatgataananccnccggcnggtgcnggaaccncggggnaatattacgtgtaccnaaaattaaattgtcaagggaacccatgttangcttttntataaa

SEQ ID NO: 95801 - DNA, 600 bp, Triticum aestivum
  unsure (1)..(600): unsure at all n locations
  Clone ID: PAT_TA_95801
ccgaggacggctactccggcgtggaggtacgcgtgacgccgatgcgcacggagatcatcatcagggccacgcggacgcagaacgtgcttggtgagaagggccgcaggatcagggagctcacctccgtcgtccagaagcgcttcaacttcccggagaacggcgttgagctttacgccgagaaggtcgtcaaccgtgggcctctgcgccatcgcccangctgatcactcccgctacaaccctccggtggctttccgtccgcagggcatgctatggtgtcttccctttgttatggagagttggtgctaagggttgtgaagtcatttttgaacggcaactcaaggcccagagancagtcnatgaattcaaaggacggtaatgattcatccggncaacccgtttacnatacattgatgcgcatttagacttcttctcaaacaggcttctttgnacaaagngaaattatcttacgggacccaaggnaactntgcctacacccgctgctgactgtacatcaaccccgaagagagacantcgcacggnttgttagtcaatcataacacagcataacgantatttgccacatttcaccnanacagnatn

SEQ ID NO: 95802 - DNA, 614 bp, Triticum aestivum
  unsure (1)..(614): unsure at all n locations
  Clone ID: PAT_TA_95802
cgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtgggtcatctctgccccaagcaaagatgcccctatgttttgtggtttggtgtcaatgaggacaattacacctccagacgttaacatttctccaaatgctaacttcaccactaactngctttntcccctagcaaagattcattaatgacaacttcccgtattattgnggttttnaatgacactgttcaatgccatcaactggccacacaagaaaaccttttatgnccctcccagcaaaggatgnaaaggtggnaaggccncanttttaaaanaatcccaacanaacnggtctgccaaggtgtttgnagntcttcccngaacttaatggaacttaccgtattttcccggtccacgtgganttcattgttgtttcacgtttnaacnaaaggtganatacatacananangttaaggtcactaggaaancanggatagtttnnagaanttgccntattttcgaanagcacan

SEQ ID NO: 95803 - DNA, 632 bp, Triticum aestivum
  unsure (1)..(632): unsure at all n locations
  Clone ID: PAT_TA_95803
aatattttgtgcccaacttccttctaatgaggaaacgctcagagtcttaacatgcttagaattttaaactggcaccaaaatattctaactaaaattcaccgaagttgatgggcaaaaggggtctctaactagaagtcactaattcaataataatatttaagatatgaaactattttgtttatttcaatctaggttcaaatgtaaacttttctttaagagtatgtgagaattcaacttaatatttaataagagaatgcaggggaaataactggattggggntnacacaacccataatcccgaaaaacctacttcctcttggaaactatgggtgactgggtaaaaagcaagtaaagtactacccggtaaaactatgggngatctattaggagaaactatttcccacactttaatgacccaaatcaatacttanccttattaccnnaagaatncatggggcaaagaagagtcctcnatgggtgtcacccngggaaaatgcanacccgtatcatcctttatagntactattaagaagncgcagaatgcgtcacgcgcnaaacttgtgnaanaacatgatcacagcttaagcantcaagncaataacnctcctgctnacgganaaaantcgcaccac

SEQ ID NO: 95804 - DNA, 411 bp, Triticum aestivum
  unsure (1)..(411): unsure at all n locations
  Clone ID: PAT_TA_95804
cggtgaggaggacgggcttgtctcggtgcaatcgtcgtcatcgtcttcctcgcatcaacaccaaacatcactcatgggaccgttgctgtctagccaccaccgtcgccattccaacagtaagatgacgagcagcggcaccctgtgggcgaagctgaagcagggcacgcaccatatcgtccaaggagtcatgggcgccgccgacanccgggcggtctaagnttcaccgttcgnacngtgccgttggtganattccgccttcaatcggcgaaaagcgtccngctgcgggtcnttgcaagntcccctcnaaatggctccgganatggaccntcccctgtgtgatcccaacccttggggggaatctcaaccaaangcttgccnaaacaacatttcccggngggttttccnggcaac

SEQ ID NO: 95805 - DNA, 383 bp, Triticum aestivum
  unsure (1)..(383): unsure at all n locations
  Clone ID: PAT_TA_95805
ctcctcccctagggttttgctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccactttgtgaagaggcatctcactgggaganttggagaaagaaatacgacccaccattgggtgttgaantcaccattggtttcaccactaactgcngaaattccntttctactgctggggacactgctgggcaaagaaattttngggggcttaanaatgggtactatatccatggncaagtgtgcaataacanttttgagtcacttccaaaggctgacctaaaaaatttccc

SEQ ID NO: 95806 - DNA, 627 bp, Triticum aestivum
  unsure (1)..(627): unsure at all n locations
  Clone ID: PAT_TA_95806
aagaaacacccctgctcgatcaaattacccagcgcccgaacaacgccgctagcctccggccgcctccgcccccgccgatgagctttctcgccgggcgcctcgccgcccaggagggcgcctacttcctgcaggagtccaagctcgccgccgggcgcctcgcggcgaaagctccccgcgtccgcgcgtgggcccaggccggcgtccccgcctccgtcgcccgacgtgctcccggagatnctccgccatccgtgcccatcaagccgacgccgcctcctgcggnacccaccctctaaggtccaacccgctgggcctccaaaaggcgggccnaggccgctggggtgtccccgaagtgctcaaccgcttcgctcctaagtcnccctgccgnaagcaacttnggcccaaaaaatggaattccnactgagaacttacnatcaacngnaacggcnanaacggggnttatatcactctccaaggttctanaanttaagtgtnattctggtaccaagttggaaggatctgctggaacaaatggngttgaggacaanaatgtttgtgttacggaanaataagtgnatcattacacnccgactaaggaanacatgnacaaanccntttttaanaaatanc

SEQ ID NO: 95807 - DNA, 527 bp, Triticum aestivum
  unsure (1)..(527): unsure at all n locations
  Clone ID: PAT_TA_95807
gcagttcccctcctcaacccccgagagtccgccgcgcccacccgccagccccgatggcccgcacgaagcagacggcgaggaagtccaccggcggcaaggcgccgcggaagcagctggcgaccaaggcggcgcgcaagtccggccccggccaccggcggcgtgaagaagccgcaccgcttccgcccccggcaccgtccgcgctccgggagattncgcaantaccagaaagagaccgagttgtcatcccgcaagtgcccttcccagcgccttggtgcgggaaattttcgcnagacttttnaagaccgactcccgcttnccnaaantcccgccgttttnccgcgctcccaaggagccgcccgagcctactcccttgggcttttttccaagacacaacttctgcgcatccnangcccaangctnaacatcaatgcccaagaattcaactntgcccgccgatccgttgcnaaaagggctaagttctccntgttgtcnattntgggaacggngttaaattttactcctcccct

SEQ ID NO: 95808 - DNA, 315 bp, Triticum aestivum
  unsure (1)..(315): unsure at all n locations
  Clone ID: PAT_TA_95808
acgaagtgccgagcacgaacatagcggcgctgcaacctctccgccccctacgaagagagagaaaaccatggcggcggtcggcggcgcgggcaacggagccggcgaggaggcaggcggggcggagttctacctgcgggtactacgttgggcacaagggcaattcggggacgattcctcgattcgattccgccccgacggcaactccgctacccaacatccaactacaagaacaaacaatattcgcaggagtcttcgctcccttccntgctccgccagncaggaggttaatccaagacnccggaatattnaaggggg

SEQ ID NO: 95809 - DNA, 220 bp, Triticum aestivum
  unsure (1)..(220): unsure at all n locations
  Clone ID: PAT_TA_95809
cgcnagcgagccaacacncatacggaacgggcctcgtctccccctccgttccctccccccgccttatcctctcnggnccggagcgancgancgccccaccgctccctgctcncnccttcctcccgatggcgtccctcaccaccaccaccgcctcntcacaggccgccctgcncgcggcggcctccgccntcccnggccacngcctcgtccgtctcgccca

SEQ ID NO: 95810 - DNA, 600 bp, Triticum aestivum
  unsure (1)..(600): unsure at all n locations
  Clone ID: PAT_TA_95810
ccataccatactcgcaaccacatctgcaactatgggtttcaccgatctcgtttccgaagcaggcctgactctcctgaacaactatgtcaagacccgcagctacattgttggctactccccatcgcaggccgatgtaaaggtctaccaagcaaatcaagcagtccccgcgcctgagaagtacccatacgcatggcgctgggtacaaccacatgctcaccttccnagggcgantccgatcccttcctgggtgacccaaccaagactcaccgcctacggcccgancctcccagtcacctcaacccgccaagcacctgagaaggagcttaagacgacgacgacgagtcactgttccgcacacnacgaggaggagacccnagntgccagttaagagacgtctggcnattcaacaaaaagaaggccgcaagtcaacctgctgccagtctatctcactatggcttnaccatggatgatnaacaaaatggacancaagggaactccttcangaaaagangnccgtctgggtgctccanctgttgcgtcgttcgttaaaactcagttacttggctcagacanagtccctcacagtncananaattaaat

SEQ ID NO: 95811 - DNA, 568 bp, Triticum aestivum
  unsure (1)..(568): unsure at all n locations
  Clone ID: PAT_TA_95811
cctcgccgtcgcgtccccgctcaaaaccctaaaccctaccttgagccccagcccaagccccagccgccgccgcggtctcctcctcggctcctcccatctccgcctgccgccgctgctctcgcggagcggccgcctccgctgctcggccggctacggcgatgccgccgcgccgcagcaggcggctccgacgacgcagcggccggacgagatcccgtggagcagggagctctgcaactcggtgcggctcatanggacggtgggcaccgacatcgactgcgccaagctccccancggngctcggtcgcgcgggggcgcattgccgtctggaantcggcaaccgagacaacttggtactcttgattttggaacactngctgtatgctctgancatttaaacaagagacgaantgtttcngacgntgtacaaacggttaagagggctgaaacggagttacaaagtgtcttaaatcatcntgatcttnacttcgtattaaatcacagatgtgaacatgaatagtggatatcactcgtaataataaagaataanantccccctanaaagtgaaca

SEQ ID NO: 95812 - DNA, 549 bp, Triticum aestivum
  unsure (1)..(549): unsure at all n locations
  Clone ID: PAT_TA_95812
atcatcctcgacaccaaagctcatcttcttctccttgaaatctttttgggttcatcagatttggaggatgtcttgcaactgtggatccggttgcagctgcggctcagactgcaagtgcgggaagatgtaccctgatctgacggagcagggcagtgccgccggcccaggtcgccgccgtggtccgtcctccggcgtgggcgcctggagaacaaggcgggcattcgagttggccgccggcatcccggcgaagggtgcagctgcggcgacaactgcaatgcaacccctgcaactgttnaactgcatgcacccctgtgatggtgttaagagtatacgtnnaataacaaggncccccgaatttgaatggantcccacaagggtgcctttncctttccttgtggtttaattgcncctctcccgcctangctctgccttgggggccttgggtgnaagtnttttgaacttccccgtaatgctcaacnactcactatggatggattnataaattaanaagnatgattactaattatanccaatnctaaaaaaaaaaaa

SEQ ID NO: 95813 - DNA, 406 bp, Triticum aestivum
  unsure (1)..(406): unsure at all n locations
  Clone ID: PAT_TA_95813
accagcctcctcactcctcacagcatcctctcagtccttagcttccttccctcgccaccacccacagccaaggaggatgtcttgctgcggcggcaactgcgggtgcggcgccggctgcaagtgcggcaacggctgcggcggatgcggctgctcctgctgcagctgcaactggagccggcgcacaggaggccggccggcagaggcgagcacgaggatgaggaaggaagaaccaagcatcatcatcaccaccaccaccacccagcgtatcaattacactaccgccgcatgcgctcgccgcgcgccgctaaattaaataaaaccncatgtgttccttnattcctgttacgacaatgtccctcctcaagcctccacttcctaaatgaatatatggcgcctcnactttttn

SEQ ID NO: 95814 - DNA, 344 bp, Triticum aestivum
  unsure (1)..(344): unsure at all n locations
  Clone ID: PAT_TA_95814
ggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtccgtctacgcgctcaagcgccagggccgcaccctctacggcttccggcggtaaagggccggccggccgacggggagtcatctttggtccgccgcctgcagatccaagaanctggatgaaccccgantgtttnattccctattccctcccggtagtttgaatcnatccgtnggaaaaatttattccccaatattgtttgggaaaaaaa

SEQ ID NO: 95815 - DNA, 640 bp, Triticum aestivum
  unsure (1)..(640): unsure at all n locations
  Clone ID: PAT_TA_95815
cagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccaaggcggcgactcaccaggggcaacggcaccggaggcgagtccatctacggcgagaattgccgacgagaattcgtccacaagcacaccaagcccgggatcctctccatggccaacgccgggcccaacacaacggctccagttcttcatctgcacgtcccctgcaaatggctcgacgnaagcacgtggtcttcggcnagtctcaagggcatggacgcgtcaagaaatcgagaagtggctccgnacggaactgtcaagangtctcatnccacngngcagtctaatcgcccgccgccgtcgcgtctcnatccccgtttccgttctgntcattaataaaatcnttcgttcctggcgtcganaatncngttgtagangtangtg

SEQ ID NO: 95816 - DNA, 598 bp, Triticum aestivum
  unsure (1)..(598): unsure at all n locations
  Clone ID: PAT_TA_95816
cttccggcggcgaagcaacacaccctcccttctccccctcccgaagcagcgatggcccccaaggcggagaagaagccggcggcgaagaagcctgcggaggaggagcccgcggcggagaaggccgagaaggcccctgctgggaagaagccgagggccgagaagcgggttccggcgggcaagaccgcctccaaggagggcggcgagaagaggggcaggaagaagggcaagaagagcgtcgagacctacaagatctacatcttcaaggtgctgaagcangtgcaacctgacatcgggatctcctccaaaggcatgtccatcatgaactccttcatcaacgacatcttcgagaagctcgccggggaagctgccaagctcgcccgctacaacaagaagcccacatcactccaaggagattcaaacctcctacgcctcgtctccctggggagctncccaacaagcctctccaaggnacaangcgtcacaanttaactcctcctaaattcntccctgttctanannaattattcctncgttgntaatgtttncgtggnncggttactcaataantaacccacgtnggntaaatncgaacnttcaa

SEQ ID NO: 95817 - DNA, 613 bp, Triticum aestivum
  unsure (1)..(613): unsure at all n locations
  Clone ID: PAT_TA_95817
gccagcgccactcgcaccacagtcatccactcacaagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggcccggggctgctgcaccggcatccagaacctgctggcggaggcaacaacangcccgaacggcgcaacatctgcggctgcctcaagaacgttgccnacngcgnctccggngggccctacatcaccgcggcgccgcgctccctccaagtgcaacgtccgcctcccctacaagatnagcccagngtcacngcaactcgatcaatgaacgaactgaacgccttggccgttntcaactaagtcgccgtgcaagatccattccgggaataaattgctgcncaanactgancttactnggcttgnggcaatctgtgnttactancctccngtnggtttaggtcatggttttgtnancatcatgnnttngctggntngtggtccaag

SEQ ID NO: 95818 - DNA, 328 bp, Triticum aestivum
  unsure (1)..(328): unsure at all n locations
  Clone ID: PAT_TA_95818
gcggagtccagcatctgctcaagctgaggatggtnatcgccccacgcccaaccngccacgcngnccctctcatcnctcncgtccctcctcctcgcccgctcctcctccgccgccaccgncaccgcgtcntccgcccgccccgnctccctctccctcacgtgctcncggtcncngtcgngggnctactgcccaaccggncnacggttgccgaggcgccgtggtggctatgtcgtcggcngcgcccantcnggtgtnngtgcagnagtcncatgangagtngnaaggncgtccnncccnggagtagttcttcaacctccngtgcaagggg

SEQ ID NO: 95819 - DNA, 547 bp, Triticum aestivum
  unsure (1)..(547): unsure at all n locations
  Clone ID: PAT_TA_95819
cactcccccgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcgacgtcaaggtgaacggcgccgtccacaagggcatgccgcacaagttctacnacggccgcaccggccgcgtctgcaacgtcancaancgcnccatccgcgtngagattaacaagcaagtccgcaacangatcatcaanaanaggatcatgtccgtttngagcacgtgcagccatccaagtgcaacgaagattctccagangaaactcacaacgacaagcttatgcngaggcaaggcgtcggtgagtcatagcacaanaggaacantntgggccaagccggggtcatgttnaggganacatcnatacgtaccccatccgtatactctcacnttcaanggtggnataancctgntcta

SEQ ID NO: 95820 - DNA, 603 bp, Triticum aestivum
  unsure (1)..(603): unsure at all n locations
  Clone ID: PAT_TA_95820
gccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatcccgacttcatgtgcaagggggcgaattcaccaggggcaacggcaccggaggcgagtccatctacggcgagaattcccgacgagaantcgtccacaagcacaccaagcccgggatctctcatggccaacgccgggccaacacaacggtccaattcttatctgcaacgtccctgcattgctnacgnaacactggtcntcgggagtcgccanggatgacgnctcaagacannanaagtggctcccatggactgcncaacaggtctcacccgctgcgcaantaaattccccccccgtcgcgttntcgtangccctttccttcngcctcatcaanagaatc

SEQ ID NO: 95821 - DNA, 366 bp, Triticum aestivum
  unsure (1)..(366): unsure at all n locations
  Clone ID: PAT_TA_95821
cgggcatgcctcaagtgctgcagcgtgtgccgctgcgtgccggcgggcacggccggcaacaaggagacctgcggcaagtgctacaccgactggaccatgcacggcaacaacaccaagtgcccctgaatatcttcggccaacctaaatatcttagtagagtagctaagctttgctcatgattgtcgttagcgttaccggtgaccttcgtgatttcgtcttggtgtggaaggaacggtgttgactagactagcactagctagctggtgaacctggtcctggtgtgttcctgtgttaaaagtaagtacgtttgtcctgtaagttggcntaattctcntgtaataaagnccatnccaangttangtnggg

SEQ ID NO: 95822 - DNA, 465 bp, Triticum aestivum
  unsure (1)..(465): unsure at all n locations
  Clone ID: PAT_TA_95822
gccaaaggtaatccaatccgcacagaaatccccatctcaaaaccctnaccctcatcccccgatcccggcgagcgagatggccaacccgagggtgttcttcgacatgaccgtcggcggcgcgccggcggggcgcatcgtgatggagctgtacaaggacgcggtgccgcggacggtggagaactccgcgcgctctgcaccggcgagaaggcgtccggcaagagcngcaagccgctgcactacaanggcacgcttccacgcgtnattcccgacttaatttnccaaggcgggaattnaccaagggcaacggaacggagggattcatctacgggaaaatttccccaacaaatttnntccaaaanaaacaacccngnttttccccaangncaaacccggccnaaacaaaggcccattnttnaantgaacntcccctgaattgnnccaanggaaanttncttccgnaaggct

SEQ ID NO: 95823 - DNA, 428 bp, Triticum aestivum
  unsure (1)..(428): unsure at all n locations
  Clone ID: PAT_TA_95823
atcatcctcgacaccaaagctcatcttcttctccttgaaatctttttgggttcatcanatttggaggatgtcttgcaactgtggatccggttgcagctgcggctcagactgcaagtgcgggaagatgtaccctgatctgacggagcaaggcaatgccgcggcccaagtcgccgccgtggtcctcctcngcgttgcgcctgganaacaaagcggggcatttcgaagtgggccgcccggcatccggcgaaggttgcaactnccggcganaactgcaanncaaccctgcaactgtttaactgcatnacccttttaaggtgttgaaaatatacgtnaataacacnccctccgatctgatgagtccacaaggngcgtntcctttccttgtggttaattgcccctctccgcctatgtctccttngngccttggt

SEQ ID NO: 95824 - DNA, 500 bp, Triticum aestivum
  unsure (1)..(500): unsure at all n locations
  Clone ID: PAT_TA_95824
caattacccaccggttctcctacctagcagcgaaaccccacctccccgcacctccgaccttcgtagcggcagcagaatccatggcgcccaaggcggagaagaagccggcggcaaagaagcccgcggaggaggagcccgcggcggagaaggccccggcggcgaagaagcccaaggccgagaagcggctgccggcggggaagtccgccgctggcaaggacggcgacaagaagggcaagaagaaggcgaagaagacgtgggagacttcaagtctacatcttcaaggtgctgaagcaagtgcacccggacatcggatctcctccaaaggcatntccatcaatgaatccttcatcaacgaatctttcgagaantcgcccggcgaggcgccaactcgcccgctacaacaagaacccacacactcccgggaattcanacnccntcgcttntcctccctgggnantccccnaanangcctttccgagggacaaaggcncacaattcac

SEQ ID NO: 95825 - DNA, 452 bp, Triticum aestivum
  unsure (1)..(452): unsure at all n locations
  Clone ID: PAT_TA_95825
ctcatctctccacccaatcatcactagctaatacggtgcactgttagctacagaccaagaagtgatcatggcccgcgctcaggtaatgctcatggccgtcgccttggtgctgatgctcgcggcggtcccgcgcgctgccgtggccatcgactgcggccacgttgacagcttgggtgagaccctgcctgagctacgttcagggcggcccagcccgtctgggcaattgctgcggcggcgtccaaagctccataaccaaggcgcaatccaaagagcgatttgccaagcccgcttgcaactgcctcaaggggatttntcctggatccacaatctcaacgangacaacgccgcagcttcgnccccaaangcgtgtcaactcccatacaatcatctcgaatcgacggaacatgtttaatgacgacatcgtcaactggngtnatnacancangttggtt

SEQ ID NO: 95826 - DNA, 225 bp, Triticum aestivum
  unsure (1)..(225): unsure at all n locations
  Clone ID: PAT_TA_95826
ccgcctccaccgcacccccaaaaccctagcgctcgctccgccccaacancatggccggagcgcaagagtccctcgtgtacgccggngtnatgcgcggncanaacgacgtngtcacgggcatcgcgangcccatngacaactcgcccttnancgtctcctcctcccgcganaatntctgctcntctgggaatcaccaanccatacaagcacccaagantccaatcc

SEQ ID NO: 95827 - DNA, 490 bp, Triticum aestivum
  unsure (1)..(490): unsure at all n locations
  Clone ID: PAT_TA_95827
ctcccgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgagagcctcacgggcaagagcaagctcgatgcgcaacccgagctcttcatccacatcatcnccgacaaggnggaccancacgctcacgatcgtcgacagngggattgncatgaacaagtcgggncctcgtcaacaacctccgggaacatcgccaggtcgggggancaatgganntcatggtgggactcgctgccgggggctgacgtgtccatgattggggcagttcggttttgggttctactccggccaacncgncncccanaaggtcctcggtaccacaannaaaacgacac

SEQ ID NO: 95828 - DNA, 354 bp, Triticum aestivum
  unsure (1)..(354): unsure at all n locations
  Clone ID: PAT_TA_95828
cccgtcccctctctcctttccccaacccaaaccaggagcgccctccctccctccccnagccgcccgccncctccccacccagggaaacccaccagccatgaaagggggccaaatccaanggcgccnccaaggccgacaccaanttggcggtgaanancaanggggcggagaanccngcagccaaggggaagaagggcaaangcntgaaaggaccccaacaagcccannagggggccctccgccttcttcgtcttcannggcgagntccgcnaggagtttanncagtaanaancccaagancaaatccgtcnngccgtcngnaaaangggcngtgagaggtgaaganctgntcga

SEQ ID NO: 95829 - DNA, 173 bp, Triticum aestivum
  unsure (1)..(173): unsure at all n locations
  Clone ID: PAT_TA_95829
ctgacacccacccccacccccacccacacgcgccgctcgtcgaggggggaggaagcgatggggcggggcctgaccctaactcgcaccggttgagccccganancgtgtcngtggagctctccatggncggggantantancacctcctnntgctgcgnancnggtcccggntc

SEQ ID NO: 95830 - DNA, 464 bp, Triticum aestivum
  unsure (1)..(464): unsure at all n locations
  Clone ID: PAT_TA_95830
ggccactttttctcttccccgcggccgagttgatggtgtatggaagacgagcgggcgggcgcggcggcggccaatcggagcagcagcatgagaccctctgccccgacctctccctttttgggagacacgcaggggcggcgacccagcgacggcagcggccagtgccgtctccagacctctcctatcagcaggacatcctcctggcctccccaccgcgccgcctacccgtacccatccgtcaagcaagagcaggctctaggtgaggtggatcgcggcagcctcctgctcctaacctgcgacacactccgacgagtggctcggacaanggcgccgttgccaaaggccacctttacgatggattctcccaacatgacggagatatggacacgacatgcgacgagtactaggacaataaactactcagtatttttcgaactttacctgagttttataacttcgtttag

SEQ ID NO: 95831 - DNA, 308 bp, Triticum aestivum
  unsure (1)..(308): unsure at all n locations
  Clone ID: PAT_TA_95831
gccgcttcggtggaggcggcccctgccgcngccgcctccaccgaagnggccaccttggtcgccgccgcgtccggggccgcttcngtgnaggcggcggcggnttccgcgacnagggccctccagccgangtcgtcaaggtgtcgacnttcctgcacgcctgcnagggggacgcggtaatcaagctgancatcganaaatgccctacttcaangtnnccatatanctccaagaacaaaacccatntcngcaaagtccacgaanatnttcaggnccatcaangaatcatattcccggtcaaaatttctacg

SEQ ID NO: 95832 - DNA, 474 bp, Triticum aestivum
  unsure (1)..(474): unsure at all n locations
  Clone ID: PAT_TA_95832
gcgatttcttgttccttggtcacctggagttctctaagtcttgcagaaaggataggtgagcattgcattttgattggccctttttctttacaaaaataaataaataaatttgtttggtactttctccgttatacttgagatatagaaacacgctttgattgcttgcagctctcgaacagccagctgtgcagaaagtactatatggcacgcccttgaaacaaagaagatgttcttgtgatggacagaagggcccaactgctgaagatacccttctgtcaaggagcaagaagagcagtttccccaagagacaaagaaatcctgtgatggtaacaatcacaagagaacaaaacgattaagaaatccancaaangngggtaaatgtnnacaccaatacttacacattttttagatgaactacacacttacgggtaacaatctccaatctaagcctgggcaattcttggagcgtgcgtg

SEQ ID NO: 95833 - DNA, 485 bp, Triticum aestivum
  unsure (1)..(485): unsure at all n locations
  Clone ID: PAT_TA_95833
gtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcanggcggccccggcccgtctgggcaatgctgcgacggcgtcaagaactccataaccaagcgcgattccaaagcgatttccaaagcgcttncaactgcctcaagggatntctcctggatccacaatctcaacgaagacaacgccgcagatccccccaaatgcggtgtcaactcccatacacatcatctcaaaatcgactgaacaggtgtaatnggcacattccttcaactggggtcactcatcaaccacttgagttttaacgccactcnancctangtatatggcacaattatcgatttatacngatatgataaaacncccaacggttctggacccctgagaataatnct

SEQ ID NO: 95834 - DNA, 419 bp, Triticum aestivum
  unsure (1)..(419): unsure at all n locations
  Clone ID: PAT_TA_95834
gttccaccgcccgcgcccgcacccgcacagcaaaggcaaccggagccatggcccgtaccaagcagaccgcccgcaagtccaccggcggcaaggcgccccgcaagcagctcgccaccaaggccgccaggaagtcggccccgaccaccggcggcgtgaagaagccgcaccgctacaggcccgggaccgtggcgctccgcgagatccgcaagtaccaagaagagcacggagtgctcatccgcaagtgccttccagcgcctggnccgcgaagatngcgcaagactncaagacggactccgcttccagtcccacgccngctccgcctccaaggaggcggccgagcctactcgtcggctcttccgaagacacaactctggcgcnatccangccaaggcncacatcatcccaagaatccactcgcc

SEQ ID NO: 95835 - DNA, 463 bp, Triticum aestivum
  unsure (1)..(463): unsure at all n locations
  Clone ID: PAT_TA_95835
ctcccagcgaaacaccaccgcaccccacaatcccacgggtctccccggcgaagtagcagcggcatccatggcccccaaggcggagaagaagccggtggcggagaaggccgagaagacgacggcagccaagaagaccaaggccgagaagcggccgccggcgtccaaggagggcggcgaagaagaaggggaagaagaaatccaagaanaacgtggagacgtncaaagatntacatcntcaaagtgctgaaacaagtgcaacccgggcatcgggatctcctccaaggcaagttcatcatgaatccttaacaacgaaatcttcaaaaacttccccgggaattcggcaaaccttnnaaggtcattaanancccccantantttccggggatttaaactcnttngctcttctccccgggaatttccnaaaaacctttccaagggacaaagggtttccaatttatccccc

SEQ ID NO: 95836 - DNA, 468 bp, Triticum aestivum
  unsure (1)..(468): unsure at all n locations
  Clone ID: PAT_TA_95836
gacaatgaggccatctatgacatctgccgccgctcccttgacattgagcgcccaacatacaccaacctcaacaggctcgtttctcaggtcatctcatccctgactgcttccctgaggtttgatggtgctctgaatgttgatgtgaacgaattncagaccaacctggtgccctacccaaggatncacttcatgctttcctcctangccccagtcatctcanctganaangggtttnatgancaaatctcngtnnctgagattaccaaaaaaggcctnctagncatnctccannattggcaaatttngaccccgccacgggaaatnnatgggctggtgtctcangtnccntggtgatgttntgcccaaagatgtnaangccgctgtggcaacatcaagacgaagcgcacatcaatttgtggactggtgcccantggttcaagtgtgnataaatacaancancancgttng

SEQ ID NO: 95837 - DNA, 337 bp, Triticum aestivum
  unsure (1)..(337): unsure at all n locations
  Clone ID: PAT_TA_95837
nntcccnaacanctggattccaaccccctcctcgccccgtccaantccattncnggggangaaaanaaanagtataggttacaggttccgaactggacgatactaccaaggttctagaagcgtacgctcgttgggagggctgcggncggtgcgctgcngtggttgatggagganganaangccatngggttgtcctcggtcggcctcgtngcttatccngccnanatcnccggagatngatctcnangccggtnncggggaccanatncaatgccnggtctgcctccacacccacnggagacactcatcgnnccctgcaantggaacgggacatcaa

SEQ ID NO: 95838 - DNA, 486 bp, Triticum aestivum
  unsure (1)..(486): unsure at all n locations
  Clone ID: PAT_TA_95838
attccccaacaactggattccaaccccctcctcgccccgtcgaatccatcgaggcgaggaaaaaaaagagtagaggttagggttccgaatggacgatactagaaggttctagaagcgtacgctcgttgggagggctgcgggcggtgcgctgcggtggtgttgganngangagaaangccaaggggttgtcctcggnggcctcgtcgcttatcccgccgacatccccggagatngacctcgaagccggtgccggggaacaactccantgccggatntgcctccaaaacgacngggagagactcatcgcgccctgcaagtncaaagggacatccaagtacgttcaacgcgactgcctcgaccactggagaacggtcaaggaagggtttgcattttctcaatgcaccaactgcaaggctccttaatacttgagggttatgttcacactgacangaaatggnaacgctaaanttcgtttcttgttacaaa

SEQ ID NO: 95839 - DNA, 509 bp, Triticum aestivum
  unsure (1)..(509): unsure at all n locations
  Clone ID: PAT_TA_95839
ggaaaggcgtcttcgtactcgcctctctccgcgcatcctanccttcgccctcctccttccccatttcgccagcggcgcagcccaccaaccacccccacccgccgccatgagggagtgcatctcgatncacatcggccangccggcatccaggtcgggaacgcgtgctgggagctctactgcctccnagcatggcattcaacctgatggccaaatncccggtgacaagaccgttnggggaggtgatgatgcttcaacaactttcttcaancgagactgggtgctgggaacatttccccctnctgtctttgtagatttccgagccactgtgattgatnagtgaagactggtgcttacggcagtcttcaaccctgagcagnttacaatnggaaggangatcaaccaaaattcccccgttggcattacacnattggaagaattgtgatcggtctttacgttcagaatttaaacaatgacnggcccnaagatccttgtntnacgcgttggggng

SEQ ID NO: 95840 - DNA, 325 bp, Triticum aestivum
  unsure (1)..(325): unsure at all n locations
  Clone ID: PAT_TA_95840
gggaggcggacgacctgttcaaggacaccggacgccatcaagacccggaggacggcggcgagcccgcgcagaagtccaggccggcgccgccacccactgctgtttcgggggcaatgtgggccgtggcgccgaacagcggcgcaggcggcggcggcgccttctggatgcagccggcatgggccttcggcgccgggaacacggtgcaagcgccgctgcattcatttcaaagaagcactttcccggcgggatggggcgacacgaatctccggcatgctccgcgggctcaatcctggcggccgtccaccggcggcgacaacanaccaca

SEQ ID NO: 95841 - DNA, 474 bp, Triticum aestivum
  unsure (1)..(474): unsure at all n locations
  Clone ID: PAT_TA_95841
ctcctgtcccctctacctccagccccgctgtccaagatttcaatttcgaactcgacaacctccacccggcggngaccaatttgacgcatccatcactgccctcccacattaaatcgaggcaaccgcgcatccgccaccagagaaagagccatccatccatccggaccggaggtcgaagagcangaggccatggcgctcgggtggttcaangtcntggaggtgcaagtgcaaancgcgcgggcgtaccaaatnggttgggaagganaaagngggggtcttgggttccccctcnaanaaanggtcnttcaagttctctaancnnccaaggcgttgtcctctccgncgngctctgngggttctcctccgctgcggtgnaaanctgatttgcgcctgtcggctgattcgtttccaaggaagcggcgtttaaccgnccgttggctctgaaanatcaagggtggntccgtgccctaaaaa

SEQ ID NO: 95842 - DNA, 472 bp, Triticum aestivum
  unsure (1)..(472): unsure at all n locations
  Clone ID: PAT_TA_95842
cgaacgacagctcgcgccgccgcccgtgaaacctagctccgccgccgttgggagcgcgactccaagccagcaccaccgccccaaaccctccaaacaacagccaacaatggcggactctccctccttccgccgccacccgctccccttctcgatcgacatcgtccgctggntcccgtcctccgcctcctccgggcgccanctcgcggnggncgtccacganccctccgtgcccgcctcctcgcgcctcancctcctancgctccacgaacccgcctccccgctcgcctcctcccgctcccctcccgggccaagggcctccgctgctccccttncgtcctngccggcgggaaatcctncgggtcctcaantcctncctcctccttcgacaacgactcggcggtgtcgtcccggcggcgcnggttcatgtggggccgtncgcgggctcactgccgcggcaagggtggtgaggcgg

SEQ ID NO: 95843 - DNA, 479 bp, Triticum aestivum
  unsure (1)..(479): unsure at all n locations
  Clone ID: PAT_TA_95843
gcagatngctcgagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaagacatcactgagctcttggctgctggtaaggagaatttgctgcggtaccatctggtggtggtggtgtggctgtttcanccgctgctcccgctgctggtggtgctgctggccctgcanctgagtcaaagaaagaagagaagncntgggagaangaagagaatgatgatgacatgggctcaatctgttcgactaatctggggcatcctgtgtctcaatatctancctgggcaagaaacaagatcaatgatgtttaaccttaattagctn

SEQ ID NO: 95844 - DNA, 371 bp, Triticum aestivum
  unsure (1)..(371): unsure at all n locations
  Clone ID: PAT_TA_95844
cgcatctcgagtagtttccagctcgccggagacgcancaagcaagaagatggccggaaggaagggcggcgacaggaaaaaagaggtgaccccctcccttnaaggngggggtcaaatttcccgttgggngganatggggctactccaaaaaagggcgcttaacccaaagctttggtccgggnccccgtntaantcnccgccgtnntcnagtaactcgccgccgaagtgctggagcttnccgggaangcgggcaaagacaacaaagaagaccgcatcattccgcgccaactgctgntccctgtncgcaaangaacaaaaanttcggaaggtgntcccctgggtnaacaatnnccaaaggggggtgatttccaa

SEQ ID NO: 95845 - DNA, 513 bp, Triticum aestivum
  Clone ID: PAT_TA_95845
aagcagcccaactattggtgttctgattctggtgatcgagcttcctcggtattattcctttccttgtagctggcctctcatccgcgcgtgtcaaggcacatccatccccaatggctgccgcctccgcgctcaccctcaagacggccgccgttgtcgccatctgcgtcatgttgctgctccaaaccaccgtggggctgggatacccgacgccgacggcaccggcgcccgccggcggaggattggcgtgccctgatgcccagattgcctgccgaacaaaatgccttgccggatgcgacgaaacctcgccggccatgtgccaggccgtctgtgccgtcttgccggcggcgagtacggcctgcgtcgacaaggtcttcagcgcctgcgtaaccttctgcaagaacctgtgcgagtccatctcgagcccctgatctgctggccgctctgttgtgcgtcctgggtgcacgcgttgtcccggaactcctcgatcatcatcggtcaactttagtgtgctcc

SEQ ID NO: 95846 - DNA, 549 bp, Triticum aestivum
  unsure (1)..(549): unsure at all n locations
  Clone ID: PAT_TA_95846
gtcccacaccaagccccacgctcgaaccaccaccaccaccagcacccatggcacccaaggcagcggagaagaagccggcggcggccacggccgagaagaccaccgcggggaagaagcccaaggcggagaagcgggcgccggcgtccaaggaggccggcggcgaggggaagacgaggggcaggaagaagggcagcaaggccaagaagggtgtggagacgtacaagatctacatcttcaaggtgctcaagcaggtgcacccggacatcggcatctcctccaaggccatgtccatcatgaactccttcatcaacgacatcttcgagaagctggccggcgagtccgccaagctcgcccgctacaacaagaagcccaccatcacgtcccgggagatncaagacctccgtccgccttgtcctccccggcgagctcgccaagcacgctgtctctgagggcaccaagggcgtcaccaagttcanctcatcctangcttcatcgtctgtgtcatgagctgatngtggcangcgtcgtgtacgtatttgnaacagtaca

SEQ ID NO: 95847 - DNA, 511 bp, Triticum aestivum
  unsure (1)..(511): unsure at all n locations
  Clone ID: PAT_TA_95847
gagaagttggacatgtgaaatgtttttggtgcctgttcagcaaatgttaacatgacccgacttgaaactgaaactagttactccctggaggctggatgatcctcgaaggggtgattatttggttctatgaggtctgtcttgatgggatgtaaagactaggtccagttccagtttttaccttagctttgacttttgtttactgggttttccgcgggtttgaaagatcaaatgaagtgccagataacctgttcacaagtgttgatgtggctgttgtctttttcatcaagtatgacaaactgactgatgggaaattaagcattgatggagtataactgtgtgttatggtcgaatgtagcaagataattagatgaatatacactcgcgggcctgataacaaacaggccattggtgcacaaatttgctgttctgcctagcattacaactacaatttgcgattaaacggacaccatgtggttctttaacatgttgattggcttgtacncctganata

SEQ ID NO: 95848 - DNA, 516 bp, Triticum aestivum
  unsure (1)..(516): unsure at all n locations
  Clone ID: PAT_TA_95848
ctccaaaccctagtagcgccgccgccgccaggtaagaggcgagatggtgtccggctccggcgtgtgcgccaagcgcgtggtggtggacgcccgccaccacatgctcggncgcctgncctcgatcgtcgccaaggagctgctcaacgggcagcgcgtggtggtggtccgatgcgaggagatctgcatgtccggcggcctcgtccgccagaagatgaagtacctccgcttcctccgcaagaggatgaacancaagccctcccacggtcccatccacttccgcgccccggccaagatctctggcgcaccatccgcggtatgattccgcacaagaacgccaagggcgaaggcgcgctcgccaagctcaaggngtacnaaggcctnccgccgncgtacaacaagacaaacgcatgggcatccccgacgcgctcaaaggtttaaggctgaacctggggaaaagtaangggctcctccggcaactccccaanggagtccggttggactaagcccanaacaatc

SEQ ID NO: 95849 - DNA, 519 bp, Triticum aestivum
  unsure (1)..(519): unsure at all n locations
  Clone ID: PAT_TA_95849
tagctacgagttgtagtagacccagagcctgattggattgtactagatggagcctgcggtgagagctgaagacgaggcgatgagcacggaggagctgctccaagcccagacggatctctaccaccactccctagcctacatcaagtctatggcgcttggtgccgccgcagaactcggcgtcgccgacgccatccacggccgtggcggtgccatcaccttgtctcaccttgcggccgcgaccggcgtccacccgacgaaagtccaacacttcgggcggctgatgcgcgcgcttaccgtcactggtgtcttcacctcggaggaaaaagaaggcggtggtggtgccctgtacaagctcactcggatttcacgcctccttgtcggagtcggcaagcgtcggctctccccgatggtgcgtatgcttgtcagcgaggtcagtttcaccactcccatgagcatctgcgagtggntaacactgagacccggncaaggccatgttcgaggccaatttgactctaccaa

SEQ ID NO: 95850 - DNA, 539 bp, Triticum aestivum
  unsure (1)..(539): unsure at all n locations
  Clone ID: PAT_TA_95850
gcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagactaaccgcccgccgctctccatgcgccgcctctccaactttaatgaagggaaaggaggagaagaacattgctgtggttgttggtacaatcacaagatgacatgcggnttcaagangtccaacaattgaaaggttaccgctctgaggntcacagagacagcgaagggcaaggattgtcaatgctggtggggagtgcctcactttttgaccagcttgcactccgttgctccaactgggggagaacaatatcctgtttanggggaccaanaatgnccgttaaggcggtaaggnatttcggnaaagcacctggtgtngcgcaaaaccaa

SEQ ID NO: 95851 - DNA, 532 bp, Triticum aestivum
  unsure (1)..(532): unsure at all n locations
  Clone ID: PAT_TA_95851
cccaaatctcctcagcctcccggcgcatctccgacgacatggcccgcaccaagcagacggcgaggaagtccaccggcggcaaggcgccgaggaagcagctggccaccaaggccgcccgcaagtccgccccggccaccggcggggtgaagaagccccaccgcttccgccccggcaccgtcgcgctccgggagatccgcaagtaccagaagagcaccgagctgctcatccgcaagctccccttccagcgcctcgtgagggagatcgcccaggacttcaagaccgacctccgcttccagtcctccgccgtctccgccctgcaggaggccgccgaggcctacctggtggggctgttcgaggacaccaacctctgcgccatccacgccaagcgcgtcaccatcatgcccaaggacatccagctcgcccgccgcatccgtggcgaaanggcctaagctctgttagtcntcgtcttaaccaanatgttgctcatccggtggnaatgtgccttgcantggttcggtcctngcaaaggngg

SEQ ID NO: 95852 - DNA, 526 bp, Triticum aestivum
  unsure (1)..(526): unsure at all n locations
  Clone ID: PAT_TA_95852
gagagagcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccancctgttattctgcatatgctggatattgaatttgctgctgaagctcttaaaggcgtcaagatggagttgatngatgccgcatttccacttctcaagggagttgttgcaacaactgatgttgtcgangcctgcactggtgtgaatgttgcngttatggttggtggnttccccangaaggaaggaatggaaaggaangatgttatgacgaaaaatgtttcaatctacaaagctcaagcatctgctcctgaagctcaagcaacccccaactgcaanggtttgggtgttgcaaaccaacaaaacaacaatggctctcatccctgaaaggagtttgctcaatccaaccccnaaaaanaaa

SEQ ID NO: 95853 - DNA, 527 bp, Triticum aestivum
  unsure (1)..(527): unsure at all n locations
  Clone ID: PAT_TA_95853
gaggccgcaaggtagaagccttttgattaggaggcagtccagcaagttggacgaactgctgataaagagataatactattctgaatttttatctgaaaagcaagattggatcacgggtgtatgttggctatgtctctcacggtgtgtggaaccagttattggttaatttcatcttgtttgttgacattgatggtgttgtccattggtttaacagaaatttgttgaagctaaagatgaagaggaactcgtggaagaggaaaaaatgacatggtagaaactcattcacacatatcagggtcataatgagaggattgatctgcttgattcgctcctgatggtcggtggattgtttctggtanggctaagagttctgtgaaggtaagattttgatccaacctattaagcagtaccacacaaattacaggagaatctgttgtttggtccaacctataaaggtgccatatatgctcagttgctcacaacagtgctaatattaacaaggtgaataaactcccgccccaaacgga

SEQ ID NO: 95854 - DNA, 533 bp, Triticum aestivum
  Clone ID: PAT_TA_95854
atcatcatccccgataccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgagcaagggtgcgtgtgcgtgtgatttgcttgctcgctctccgcctaagctctgcccaaggtgtccttgtgtgtatgtgtgtgcgcatgtctccctgtaattgcttcatccaactccactatggatgggagtgatgaatatgtaagaatgaaagattt

SEQ ID NO: 95855 - DNA, 405 bp, Triticum aestivum
  unsure (1)..(405): unsure at all n locations
  Clone ID: PAT_TA_95855
gcaaccggnggncancaagcctgacgtcnccattgtcntccaagcctaaattangnttancaatcanccccgttattaattcaagtaagccggngataagtgggtacgcacancacacatgcgggccttccggcgtggccgcgtacgtggctggccanaagctggagcactgtgtggctgcatcnggtccgcgcatggcatggctggctgtgcatgcanagatccancttanctagcccgaccgactgcatgccatgtatgaagggagaccangagtgagagcgagtgtgagtgagtgagtgagtgagtgagagagatgcatgctacagcaagctttgtactgtattatcaaacattttatcaagcctgtcacatgcattggnttctttttanaaaaaaaaaaaa

SEQ ID NO: 95856 - DNA, 550 bp, Triticum aestivum
  unsure (1)..(550): unsure at all n locations
  Clone ID: PAT_TA_95856
ccgccccccaacccaaaccctaccccgccgccgccgtcgccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccagaaggagtccaccctccacctggtgctccgcctccgcggcggcgccaagaancgcaagaagaagactacaccaaagcccaaagaagcaaaaagcacaagcacaagaaagtgaaagctcgccgtcctccaagttctacaaaggtcgacgacgccaccggnaaggtcaacaaggctcaaggaaaggattgcccgaacgcccaactgcggggcccggaaccttcatgggcaaacaattntaacggcaactaatgcgggaantgcggctcacctanntttaaaacaaaan

SEQ ID NO: 95857 - DNA, 545 bp, Triticum aestivum
  unsure (1)..(545): unsure at all n locations
  Clone ID: PAT_TA_95857
caagctctcacatccggatctgcccctcctctcctccaatcccagtttccggcgaagcgcaatggcgtcgtgggacgagctcgtggactccacgctcgcgactctggccggcaagaacctgctcttcatgcagcgcctcatcacccttccgccgccggtgccgccctccaggaccttcgccgggccggggccctgggaccgccccaccgtcgagatccggctcgacggcgcctccacccaagaatggctcgccctaaatggcttggtcagcgaggagggagacgaggtggaccggaaggtggtcctcttctccgggaacgactacatcggcctcgccacgcatccggcagtccttgaggctgcggccaangcagctcaaggcccgggcatggggccgaggagctcctccttgatcttgggtacactacttaccacaaaactggccgangaatcactcgcggatttgctcaaaatggaggattgccttcttgtccaacggatatctgcaaaaacttcgtcatgttccnaatangtacatcacncnn

SEQ ID NO: 95858 - DNA, 530 bp, Triticum aestivum
  unsure (1)..(530): unsure at all n locations
  Clone ID: PAT_TA_95858
gcagctagcctcgctctcgtgcgcaggatgcggagcggtgtcagcgcgcgccttctgccgcaggcggtggccatcgccatcgccgtggccgtcgcctgctgcatggccgccgcaccgtcgtcggcgcaggggacgacgacgcccgcggacgccagcggcgcggtgccgtcgtgcgcgtcgaagctcgtgacgtgcgcgggctacctgaacaccaccgacacgccgccggagtcgtgctgcgacccactcaaggaggcggcgaccacgcaggcggcgtgcatgtgcgccatcctcatgaacaaggccgcgctgcaggcgttcggcgtagcgccggagcagggggtgctcctcgccaagcgctgcggcgtcaccaacgacgcgtccacctgcgccaagtaaccgccggcgccggtgccgatgctgcaactgcaggtagcacagccgcttcttcagcatccacgggaactgctgcttcacaattgccaagccaacggnaagcgnggaacacgcatcccctgaactnatngccn

SEQ ID NO: 95859 - DNA, 199 bp, Triticum aestivum
  unsure (1)..(199): unsure at all n locations
  Clone ID: PAT_TA_95859
ncggggttggnttctcctccccttccggttcgggttctggttcggttcgggtccganagtagctancctantctagggntnccgtangttcggagaggagagaacnggatagatcnatggcgagnnacatgantancgctgacttcatgaggcggcctcncctgngccattgacaantacaacctccaccagnccntca

SEQ ID NO: 95860 - DNA, 558 bp, Triticum aestivum
  unsure (1)..(558): unsure at all n locations
  Clone ID: PAT_TA_95860
acttgcataggaaaatgtgaccttttcaatgtagaatggctaccaaatccttctggcccagtcaagctgtcgttttataaagataacaagaactggatgagaatggtagaccagacaccaggtatcttgactagaaacctaataagcatgatctgccccatttggtgaagttagatttctagctgctatgaggagcaaagcatgggactaatcagtaacttcattctttgtagacaagttcagtcattgatttgcatgttgtctaaggcaaataatacagcattacgtgactcctccttttagttctccttttctcatactgaagtgttgttgttaatgctcactttgaagcaccatgtctgtatggcatttacttattgtttatgttcaaatgccctcaaaatagcattaagatgtccttacaaagtgttcatgtggtccccgtgataatgccttttgagaatgggttgagagtangtcctgtgcttcagataactgaatgtccaagtaatatcatcaaccttcaacgagcaacgactctaaactacatcgctcaaa

SEQ ID NO: 95861 - DNA, 562 bp, Triticum aestivum
  unsure (1)..(562): unsure at all n locations
  Clone ID: PAT_TA_95861
cctctccctcactctcacctccgagaagctccagcggcagccatggccccaaaggcagacaagaagccggcggccgagaacaaggtggagaaggcggcggagaagacccccgcggggaagaagcccaaggccgagaagcggctgccggcaggcaagacggcgtccaaggaggccggcggcgaggggaagacccggggcaggaagaagggcagcaaggcgaagaagggcgtggagacgtacaagatctacatcttcaaggtgctgaagcaggtgcacccggacatcggcatctcctccaaggccatgtccatcatgaactccttcatcaacgacatctttgaagaagctcgccggcgagtcggccaagctcgcgaggtacaacaagaagcccaccatcacctctagggagatcagacctccgtcgcctcgtcctccccggggaactcccaagcacgctgtctccganggcacaaaggcgtcacaagttcaatcctcctagactgacaancgccgcttgttggaaaaatgttatttgctgctgtaatccccgaatcngctaatt

SEQ ID NO: 95862 - DNA, 565 bp, Triticum aestivum
  unsure (1)..(565): unsure at all n locations
  Clone ID: PAT_TA_95862
tgcctcctgcgcctccacttccatcgcctccccaaggtaagagccgccccccctccccccccccccctgacgctgcatctaatcccaatgcttttcttcgtgtctttactcttgcagatcgcagatccgctccggtgagaatccgtcgccatgtcttccagcgaggtcgcctgcacccttgccgccctcatcctccacgatgacgggatccccatcactgtaagttgttcgtctttgttccttctcttctttgcgcgattcttggtctgtttcgttgtctgagggttgttgcttggcccaacgcagtctgagaagatcgcgaaggtggtgaaggctgccggaatcaaggttgaggnctactggcccgcgctcttcgccaagctcctggaagaaaangagcgtcgatgaactcatcctttccgtcggatntggtaaaactctcccgctnccantgggttanaatcctctgtantttatncaaggntttgatcacgttgnccgttggtgtacttaaaagtagacatatcaaaattgttgcaactgctccaaatttagggaagtantn

SEQ ID NO: 95863 - DNA, 545 bp, Triticum aestivum
  unsure (1)..(545): unsure at all n locations
  Clone ID: PAT_TA_95863
ccctcccagcgctcccccctcctcaacaacctcccggcgcatctccgactccatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcacatcatgccaaggacatcaactcgcccgccgcatccgttgagagagggctaagctctgtgctctctcngtaancctcgtcctagcaaatgtgtcagcgtgaattgtcntgttggtatngncggtcttcaaggnggatt

SEQ ID NO: 95864 - DNA, 560 bp, Triticum aestivum
  unsure (1)..(560): unsure at all n locations
  Clone ID: PAT_TA_95864
ccaccccgatgtggatgcctccccaccagctccctccccatcaactccctgctagccacctccccgtgccccacttccctccccgcaccgccccacctccctccccaccttctccagcgcggcgcgcccctacccttctcaccttctccggcagcgccgcccacaaccacctccgacagcgtcccacaagaaccacctctctacgccggtcgtcgccctcctctttctcaagcgccatccagccggtcatggcgggatccggccgcccacggtcgccgacgcggccttagccaccagatccggctgccctcggccgccggtgtggccttagcctccctcggccgaatccatcggctgccgaatccaagcgccggcaagcggatgggccgccaaccctgcaacaccgtanaagagattcggtgggttgcctccgcgcccaattctcctccgnctccctctcgagaaaatcctcttccaaggnttcatcaagcaacgaatcccgcgccaactggctgctgcgggcccangcaacaaattctgtcaagggttgctccgtccgg

SEQ ID NO: 95865 - DNA, 557 bp, Triticum aestivum
  unsure (1)..(557): unsure at all n locations
  Clone ID: PAT_TA_95865
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactaacaatngccggtaattgggcaatgtggaaactgcctaagttcggggtgcactgacnccacacaaggtgatnaacgaagtggaaggaagtcaagaaggagtaccctgacgccntaagtccgcatcatcggnttcgacaacatgcgtcaagtgcantgngtcagcttcaancgccttnaaaccaacgggctgtgaangagtccggaaagggt

SEQ ID NO: 95866 - DNA, 574 bp, Triticum aestivum
  unsure (1)..(574): unsure at all n locations
  Clone ID: PAT_TA_95866
cccgcacctccgccgccgcgtcacacggaagcgagagacacagcaggagacaacgacggcgacggcgatgaggagtcacgcgctccagctcgtcgcgcgcgcggtgcgcgcctccgctccccgtccccatccccagcgccatctccatcaggtcgccgcgctgagagcgtcgacgggtttcttctcgaccgaagccgccgctggcgcatctgcggctgctactgccggcgcggcgcagggcgggtcgaagtccgctgcggctgctgccgcgtcttctggcgcggcgcaggccgcttcgaagcccgcggcggtggcgtcgggctctgacggcggtggcggagggaacgggcgggatgggaagtcgcaacaaggggactccggcaagtctgtccgaagaagggccgtctcaaggtttaattttcctctgcttcttgtgaccggaggangaatcatantgtactacgacaaaggagaagaaacgtcacaatnaaagaactgaagaacaagtacgaantcaattgaaaccaagcacaatcagttaggaatgntnccaattgggggnccaatcnaccct

SEQ ID NO: 95867 - DNA, 283 bp, Triticum aestivum
  unsure (1)..(283): unsure at all n locations
  Clone ID: PAT_TA_95867
atcnnccaccgccgtatcagnngttctccattgcgctactggccgacggccgctcacaggatttccctcctagatcaantcggtcttcctcctccacgcgcgcgctgctccnanggccgtgggccgactcagcctcttcgctcccncgccggggcanngctcatgcgggcgttcatggntctgcaagtctcanctccttcctaccgctcaagcncngcncatggataanngatggcttcagccgcgtcancggggtcnaggagtcncttgncttangcctcgc

SEQ ID NO: 95868 - DNA, 515 bp, Triticum aestivum
  unsure (1)..(515): unsure at all n locations
  Clone ID: PAT_TA_95868
gtcgattcgaacctcccccaaatcagcagcagtcgaccggaggcgccgccatggcccgtaccaagcagaccgcccgcaagtccaccggcggcaaggcgccccgcaagcagctcgccaccaaggtccgtctcgtcccctcttccctcgcctcgtttgaattcgatctgtttgtccttgttgattcgagatttgctgactgacgatctgatttgaattgctgtgtgatttcaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatccgcaggacttcaagacggacctccgcttcaagtccacgccgtgtggncctccaagaggcggcgaaggcgtactctcgggctgttcaggacacaaccttgcgcatcaagcaagcggtcacatcatgccaagg

SEQ ID NO: 95869 - DNA, 538 bp, Triticum aestivum
  unsure (1)..(538): unsure at all n locations
  Clone ID: PAT_TA_95869
cgcatccacacacacacacaccacagaccacctctccccgcccaagcatccccatccgcatcctcatccatggcccccaaggcagccgagaagaagccggtggagaagaccccggcggggaagaagcccaaggcggagaagaaggtgccggcgtccaaggagggcggcggggacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtcggccaagctggcgcgctacaacaagaagcccaccatcacgtcccgcgagatccaagacctccgtccgcctcgtcctccccggcgaagctcgccaagcacgccgtctccgagggcaacaagggcgtcaccaagttaactcgcctgattcgtctgtcctgtgtgtgtcntcctggtggatngattgatgttcnccctgtatttct

SEQ ID NO: 95870 - DNA, 545 bp, Triticum aestivum
  unsure (1)..(545): unsure at all n locations
  Clone ID: PAT_TA_95870
ccatcccatccccaggtcataaacccaagtcggactcgccttcctcctcgccaactactcctctcctctcctccgcgcatcgcaccggggtcacctgagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgatgctgatgattcttggcaaagggtggacatganctgagcaagagcactggaaacgctggtgcacgtgttgct

SEQ ID NO: 95871 - DNA, 542 bp, Triticum aestivum
  unsure (1)..(542): unsure at all n locations
  Clone ID: PAT_TA_95871
caagcaagcaagcaagcagccaccgaagcagcctccgctcccctccccgaccccgaagcaatggcgcgcacgaagcagacggcgaggaagtcgaccggaggcaaggcgccgaggaagcagctggcgaccaaggccgcccgcaagtcggccccggccaccggcggcgtgaagaagccccaccgcttccgccccggcaccgtcgcgctccgtgagatccgcaagtaccaagaagagcacggagctgctgatccgcaagctgccgttccaagcggctggtgcgggagatcgcgcaggacttcaagaccgacctccgcttccagagctccgccgttgtccgcgctgcaagaggccgccgaggcgtacctcgtcgggctcttcgaggacaccaaacctctgcgctatccacgccaaagcgcgtcaccatcatgcccaaggacatcaagctcgcccgccgcatccgcggggagaggcctgancaacggtcgcntgttccttcgtttcaaaaatcttctgttatgttccggtctanacttgggggtacc

SEQ ID NO: 95872 - DNA, 542 bp, Triticum aestivum
  unsure (1)..(542): unsure at all n locations
  Clone ID: PAT_TA_95872
ctccccggttcctcctcctcctctcgccagatccgctccattcgcggcgcctcgacgccgacgccacctcaccccgacgccgtcccgagggctcgccatcgccatggatgcaaccaccagcctcccctctccgttccgagctgtccgacagctccgtcgcggacgccttcctcctcctcgtagacgagatcgggccgggatggccccgcagcaccgccccgaccccttcgaccacctcggaacaccaccgcgccgtctgcctcctctactacgacagcgggcttcctccacttcgaccgcctgctgctcctaaacctcccgccgagccgccgtgtgctcctagacctcgaagaacgctgctgatgcccctgtgatngactaagtcgaagaagaaccttcttccctttcagtggagctttcagatgggggattcctggagctaaatgctaacgccgaagggtacaactacatggagaacggcgacgactaaggagtaattaaggaggtccaaggcaggagggcntgcctccttcaatgtgntn

SEQ ID NO: 95873 - DNA, 529 bp, Triticum aestivum
  unsure (1)..(529): unsure at all n locations
  Clone ID: PAT_TA_95873
ctccagtcaagcaatcctcgcacatctctccacctcccgaatcctctctcccccaccagcgcggcagctcgccatggacgcctcagccaccgtagccgccgggaaggcgaagaagggcgcggccgggcgcaaggccggaggccccaggaagaagtccgtggcgcggtccgtcaaggccgggctccagttccccgtcggccgcatcgggcgcttcctcaagaagggccgctacgcccagcgcgtcggctccggcgctcccgtctacctcgcggccgtcctcgagtacctcgccgccgagctgctggagctcgcgggcaacgccgccaaggacaacaagaagagcgcatcatcccccgccacctgctgctcgccgtcaggaacgaccaagagctcggcaggctgctcgccggcgtcaacatcgcccaagggggggtgattcccaacatcaaaccggtgctgctggccaagaaaaccgccganaaattccccaanggagcccaagtcccccaaaaagaacggcaaattnccc

SEQ ID NO: 95874 - DNA, 546 bp, Triticum aestivum
  unsure (1)..(546): unsure at all n locations
  Clone ID: PAT_TA_95874
agcgaacatgatgaatgcccacgccaacctagctctggccgctttggcattcccagcccacatgcccaactctaaattctcccacatccgatcacgatgcacccgacgcccaccccttccactctcaatggcggcacatccaccaatccgaagtaacccaacacagatcacaatgagcaccaccggcagtgccagtgccggcggggagcaagccggcatctccggcacggaccgcttccgcatgctagacttccatcacgtcgagttttggtgtgccgatgccgcctccgctgccggacgcttctccttcgggctcggcgtgccactcgccgcagagtccggcctctccacggggaacaccgcgcacgcctcccacctactccactcgcgctcgggctctctcgcgttcctcttcagcgccccatacgcacanggcaacgcggtcaacgcgtccgtgcctccttcgaacgccgacaacggaagccgctttacggaaacaanggccttcggggnccccnttgcgttcggtntccccaanccgccgng

SEQ ID NO: 95875 - DNA, 297 bp, Triticum aestivum
  unsure (1)..(297): unsure at all n locations
  Clone ID: PAT_TA_95875
ggcgacgtcatcgactccaagatcatcactgacagggagacgggccgatcccgcgggttcgggttcgtcaccttcgcgtcggacgaggcnatgcgccaggcgatcgaggccatgaacggcnaggacctgnacggccgcaacatcatcgtcaacgaggcgnagtcccgtcgctccngcngangatgcggnagcngcttccgnnagcagccgtntncggctacnggnccaancgcccattanggctgntgnaggtggccgctntnggaagaagctgcntcctccaacaaatgtnncgca

SEQ ID NO: 95876 - DNA, 166 bp, Triticum aestivum
  Clone ID: PAT_TA_95876
cgtcgtcgtcgtagccgccgccgactactagaggaaacgatggggcacctcctgagagattgttgttgtatgcggtggcgctgactagccgccaatatcttctttgcttctattctgtccggatttgttgaataaaggcgcgaaggaaattaacaaaaaaaaaaaa

SEQ ID NO: 95877 - DNA, 547 bp, Triticum aestivum
  unsure (1)..(547): unsure at all n locations
  Clone ID: PAT_TA_95877
agcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccaaccaacgtatcatcaacaaccgccgcatgcgctcgcgggcgccgcgctgaataaaattaaaccaccgttcgtgttccttattccgttggccccntcccnttttttccncaaattangggccttcccccngccc

SEQ ID NO: 95878 - DNA, 555 bp, Triticum aestivum
  unsure (1)..(555): unsure at all n locations
  Clone ID: PAT_TA_95878
cagcaatcccccaaatctcctcagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcaggaggccgccgaggcctacctggtgggcctcttcgaggacaccaacctctgcgccatccacgccaagcgcgtcaccatcatgcccaaggacatccaactcgcccgccgcatccgtggagaganggnctaaagctctgttcgtcgtcgtccggtaatcctcctccttancccgaagtggtcaaccggtgggaaatgtgcttgcnanggttngttcnngtcccnggccca

SEQ ID NO: 95879 - DNA, 547 bp, Triticum aestivum
  unsure (1)..(547): unsure at all n locations
  Clone ID: PAT_TA_95879
tctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccaagaaggagtccactctccacttggtgctcaagctacgtggtggtatgcagatctttgtcaagaccctcaccggcaagaccatcaccctggaggttgagtcctcaagacaccattgacaatgtgaangccaagattcaggacaaggagggcatccccccggaccaacagcgcctgattctttgccggcaagcaagctccaaggatggccgcaaccccttgcggnnttacaacatccaaaaaggggtccaacctccaanttggggcncaaggtccnttggngggaattcaaatanttnntaaaan

SEQ ID NO: 95880 - DNA, 514 bp, Triticum aestivum
  unsure (1)..(514): unsure at all n locations
  Clone ID: PAT_TA_95880
aataactgcatcatatttggaggtaacagtgacgtgtcataagttttgggatacaccaatactttactttacttaccaaattacattactaatagaaaatttacttataatgataggaaatcgtgtctgtattgatggagctcgaactacatagtacaatcaacatgtgtctagctcagagctcttgtcctataattccatgttatgcatgatttcttctaaagtttccatgaattttgctttacatcaaaaacttaatcgaactccttccaggacaaaagtaaacaatactacatatcttgatataaatcctctgagtagtatgccccaatttttagttcttcatatacatttttacttgcatagtatattaatttttctcaaaacaggtacatacttctatcatgcatagcgagtgtatgaaacatcttttttaattaagatgtccttcaataaaaatattgtatatttaagaaatatttggataacatacatgatcngtanatccttttca

SEQ ID NO: 95881 - DNA, 534 bp, Triticum aestivum
  unsure (1)..(534): unsure at all n locations
  Clone ID: PAT_TA_95881
aatctccctcccaaccaatccaccaaggaaaccccgatggcccgcacgaagcagacggcgaggaagtccaccggcggcaaggcgccgcggaagcagctggccaccaaggcggcgcgcaagtcggcgccggccaccggcggcgtcaagaagccgcaccgcttccgcccgggcaccgtggcgctccgggagatccgcaagtaccagaagagcacggagctgctcatccgcaagctgcccttccagcgcctcgtgcgggagatcgcgcaggacttcaagaccgacctccgcttccagagctccgccgtctccgcgctgcaggaggccgccgaggcctacctcgtggggctcttcgaggacaccaacctctgcgccatccacgccaagcgcgtcaccatcatgcccaaggacatccagctcgcccgccgcaatcgggganaaaaggcctaanatcgtgtcgtcntaactgcaagtgtnnaagattacaagtgntgccttgtnaagtnattcgggaattgtgggaaggaanttccccct

SEQ ID NO: 95882 - DNA, 198 bp, Triticum aestivum
  unsure (1)..(198): unsure at all n locations
  Clone ID: PAT_TA_95882
acactaaccactacaaancactgaagaaccacagggtgtcaatcatggcntccancgggtctacttgngtntgctctcctgcttgcngttgatatcctcgtcncctcaactgaacaaactcaggccaataaggnngagaagaaagccggcgtaganggctacggaggcggcngcggcngcngcagttancccggnggc

SEQ ID NO: 95883 - DNA, 515 bp, Triticum aestivum
  unsure (1)..(515): unsure at all n locations
  Clone ID: PAT_TA_95883
gttaccaggagatcatcaaggagacctcctcggaccacttggtggtgtccatcttgttgatggcgacgatgagctgcttgacaccgagagtggtccgaggagcgttaccaggagatcatcaaggagacctccaacttcatcaagaaggtcggctacaaccccaagcacgttcccttcgtccccatctccggcttcaacggtgacaacatgattgaggcttcctccaactgcccctggtacaagggttgggagaaggagaccaaggccaaggccactggtaagaccctcctcgaggccattgacgccatcgaccctcccagccgtcccaccgacaagcccctccgtcttcccctccaggatgtctacaagattggaggtattggcacggtgcccgtcggtcgtgtcgagaccggtatcatcaaggccggtatggtcgtcaccttcgcccccgctggtgtcacactgangtcaatccgtcgagatgcancacgancancttgtcnanggtgtccccg

SEQ ID NO: 95884 - DNA, 507 bp, Triticum aestivum
  unsure (1)..(507): unsure at all n locations
  Clone ID: PAT_TA_95884
cacttttgaatggcagatcccccttactggaccaaattcaattgttggccgtgctgttgtcgtccatggtgacgctgatgatcttggcaagggtaatgctttggaaacacttgaatcatacatttttatgtctccctgtgcatgactgtttgtcaaacttgaatgaagttgtttttgcaggattcctagaatagttatgtgcttgtatattttatatgttttaatggatcacaatcatgaattcatgtcgtatgaataagtttgaagagcctgggaactctagtctacttttggataaacctgttgcttttttgtagctagtggttaaaatcaaaggagtacttcgtgactaactgtccttatggaacattgagctggggggtgttttttcttgctttcctctaatttccaaatttatatcttaaaatcctggtaataaaactaatattaattctggcttcgtggcctaaatgaacataaattggaccctaacanangccaaaaggn

SEQ ID NO: 95885 - DNA, 541 bp, Triticum aestivum
  unsure (1)..(541): unsure at all n locations
  Clone ID: PAT_TA_95885
gtctggctctctccatcccaatcccgacctaccgcccgctcccgcaagccatggacgccacggccaccggcgccaaggggaagaagggcgccgccgggcgcaaggccggcgggcccaggaagaagtcggtgacccggtccgtgaaggccgggctccagttccccgtcggtcgcatcgggcggtacctcaagaagggccgctacgcccagcgcgtcggcaccggcgcccccgtctacctcgccgccgtcctcgagtacctcgccgccgagctgctggagctcgccggcaacgccgccaaggacaacaagaagagccgcatcatcccgcgccacctgctgctcgccgtccggaacgacgaggagctcggcaagctgctggccggcgtcaccatcgcgcacggcggcgtcatccccaagattaaccccgtgctgctccccaagaagaacggcgganaagganggccaaggcgccaaattcccccaagaaaggcgcaaatcncccaanaaaggccgcaancccnaaanaaaccttaaaaaaaatn

SEQ ID NO: 95886 - DNA, 189 bp, Triticum aestivum
  unsure (1)..(189): unsure at all n locations
  Clone ID: PAT_TA_95886
gtctcgattttttttttttttttgaacatcacaacatcgactttattattgggcaaatgaagggaatttttcnctcaaggccagtggcatccccaacancatcnccatcngaggaccnccaactctgcttgcttgcttgctgcancggatncaccnctancacgtgggtgtnctggccgtgcaaaagca

SEQ ID NO: 95887 - DNA, 514 bp, Triticum aestivum
  Clone ID: PAT_TA_95887
tctcgccggagtcccagcaaggagcgagcaagccaggaagatggacgccagcaagctgaagaaggtggccgggaagaagttcggcgggccgaggaagaagtcggtgaccaggtccgtcaaggccggcctccagttccccgtcggccgcatcgggcgctacctcaagaagggccgctacgcccagcgcgtcggctccggcgcccccgtctacctcgccgccgtcctcgagtacctcgccgccgaggtgctggagctggccgggaacgccgccaaggacaacaagaagacccgcatcgtgcccaggcacctgctgctggccatccgcaacgaccaggagctcgggaggctgctgtccggcgtcaccatcgcgcacggcggcgtcatccccaacatcaacccggtgctgctccccaagaagaccgccgagaaggccgagaagaacgccgccaagtcgccaaagaaaggcaacaagtcccaagaaggcacaaggctaaatcttataatgcgtgtggtg

SEQ ID NO: 95888 - DNA, 278 bp, Triticum aestivum
  Clone ID: PAT_TA_95888
cctcggtgcccgccgtcgccgccgggcccgccgagcgctaatcccattcctcggtcggcgtggcgctgctgctgctgctgcacagcgcttccgcgcctctgacagacatttaccctgctttgccgtagcgcgtttcagatccagtctcctggtctgtgagttgtactaatgatggtcgcaagcttcgcccgagagagtcgagagtctaatgtcgttctcatgctgtccccaactgttaagtaatggaccacttctaattccaggttaaaaaaaaaaaa

SEQ ID NO: 95889 - DNA, 534 bp, Triticum aestivum
  unsure (1)..(534): unsure at all n locations
  Clone ID: PAT_TA_95889
gtcgcgtgcttcaagcaaatcgaccaattcgagagcatggcgttcgcggcctctgcatctggtgacgtcatcgtcgccgctaactacgccgacagcggccggaccctgatctacgacgccgccgccggcggcgtctcccccgggccggagatgcgctccgtcaagcaccacctgttcctcgtcccggtcggagaccgcatgttcttcgccatgtccgcctactcgcgcctggacttcccccgggggggaccctggttcgaggctctgcagcagcagcccctcccctgcggcggcggcggccgctgggcctggagcgcccttcctgacctgcccggcatcgctcgtggccggagggaggacgtcagggcctacttcgtcgcgggcgcgcgcgtctggatntccctgcacctccanggcacctattcattcgacacggcgcgccaaaggtggcgcaangaaggcgcctgggaactgcccnttgagggccgggaatcctggngccgactttctgggcaacggccggnggtggtcttt

SEQ ID NO: 95890 - DNA, 464 bp, Triticum aestivum
  unsure (1)..(464): unsure at all n locations
  Clone ID: PAT_TA_95890
tccccaaccccccaccccccaccggcgccgccgcaccgcacctcgccgccgtccgtcctccgaagggaagggaagggaagggaaggaaaggggagatgagggagatcctgcacatccagggcgggcantgcgggaaccatnatcngggcnaagttctgggaggtggtgtgcgnggagcacnggatcgaccccaccggtcgctacgccggcgacaccgncctgcagctcgancgcntcaacgtctactacancgangcctcctgcggacgcttcntgccgcgcgccgtgctcatggacctcganccggggacacatggnctccgtctgctccggnactctacggcggcatcttccgccccgataacntcntcttcgggccagtccngganccggnaaacatcttgggncancggtcnactacaccgacgggcagcngngcttatcnactccgtcctccgatcgtc

SEQ ID NO: 95891 - DNA, 412 bp, Triticum aestivum
  unsure (1)..(412): unsure at all n locations
  Clone ID: PAT_TA_95891
tcaagattccacctcnccctcnacnaggcancggaacgaaaccctaagcaangagcatggcgctgctcccgcgcacggnccggttggncctcttctccgcatcgccncggacgtantcngccgcngntgccgcnggcgcctncccgacccnacnggcgccctacgcgggcgtgcctccgccggcggcggggtctaaggcngccgattatcgtcntctccanggtggacgacctcatgaactgggtgcgatcgggctcgatctggnccatgatcttcgggntcgcctgctgcnccntcnagatgatgcacgctggaatccgncngctacgacntcaaccgattcgncgtcancttcngcccggttntcngcnccagtccaactgcatcattgtcgccggcacgctcaccaaca

SEQ ID NO: 95892 - DNA, 449 bp, Triticum aestivum
  unsure (1)..(449): unsure at all n locations
  Clone ID: PAT_TA_95892
tgcaagaacncgcgcccaaatcnactacctccgagatcctcccgcgcccccgtccagccgccctccggatccgccccgccctcgcgcatggcgcacccggccgcggaccgccgcctccgctcaccgcagcgctgcgaccacgagcaccacggccgcttcctccgccccggcgcgctcgccangntccgcnactccaagatcgtcgcccgctccctccgctccgccgcctccgcgcgcctcntcccgccctcctcgccttctcccccgtcgcccgcgccggccgcnggcgccgtgccgcacttcttcntcgggggcgcgcggggcggtatgcggtacccgctcccggangaagatcgccnccgnccgcggtgtcgttgttcctgacnccnccgnccntgtcgacgngncgctctgnatgtctncctcggtngtgcttcgggagccgcgcc

SEQ ID NO: 95893 - DNA, 463 bp, Triticum aestivum
  unsure (1)..(463): unsure at all n locations
  Clone ID: PAT_TA_95893
ccctggtcgcagtccagaaatggccgccgccgcgaagctctccgtctccagccaggccttcgcggcgctcctcgactgctgcgggaccgccgccggggactgcgacgggctactcttcggccgtgncgcccgccccccggcccctcccccttccctcttcgactaccgcgccttcctccttgtggattcccgcctcttccccacctccctccaggtcgtcaacgtgggtcctggtttccggggccagtaccacaccttcgcggcggagtcgccaatgccgtggctgccgcgtccgccggcaaagggcttcagcatcagagaccagaaggcgatggatgggatgattgatgcgttcgggctgggaagggtggaggccttggtggcctcggccacggggcaatcaaccgaggtggaggagatgtattccgggatgctaaggaggctggagaggcttgctcgggaa

SEQ ID NO: 95894 - DNA, 548 bp, Triticum aestivum
  unsure (1)..(548): unsure at all n locations
  Clone ID: PAT_TA_95894
ccaaggccgtcaccaagttcacctcatcctaggcggcggaaaagaagccggtggccacggccgagaagacgacggcggggaagaagcccaaggcggagaagcgggcgccggcgtccaaggaggccggcggcgaggggaagcagcggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgagaagctcgccggcgagtccgccaagctggcgaggtacaacaagaagcccaccatcacgtcccgggagatncagacctccgtccgcctcgtcctccccggcgagctcgccaagcacgccgtctccgagggcaccaaggccgtcaccaagttcacctcatcctangcttcatcgtcgtcgttttaacgaatcgattgatgatgttctgtatgttagtttggcagtacgatgtacaatatttgtaaggattgtgctgcc

SEQ ID NO: 95895 - DNA, 223 bp, Triticum aestivum
  unsure (1)..(223): unsure at all n locations
  Clone ID: PAT_TA_95895
gagcagtanaggcgctgctctgtcctgacattgcacgcccttgtcgccgagctctgcattgcgtccgctagcagccatcctcgatggggttgccgggatgtatcgccgtcattgtgctccttctgatttcatgggagagaggntcaaggngcangngttcacggaacgtacatccagtannngatcatgcgnatttnncttttgncagaccanggccgncaaa

SEQ ID NO: 95896 - DNA, 543 bp, Triticum aestivum
  unsure (1)..(543): unsure at all n locations
  Clone ID: PAT_TA_95896
caaacaagaacacacaacatagatgcagaaaaggaggaggagttggaccacaacaccacagtgttgtgggaatgcttccaaagcttgtgggtgcttgacctgcgccacacggattgtgatcagatcttgtccgcgagggtgatggatctcatgatccagctgagggagctaaacgtgatgggagccaggaactgggacatgagccatctacagggacggctgcgtaacattcgcaagctccgagtaacaaagtccacctgctacttcaacaacaatgtgttctcagatatgtggaacatggagcttcttgatttttctggaaatatcatcaagacaaggcatgacaaccttatctgggccagaaagcaacaatagcctcaaaactgtgattattgggtgggatgttgatgggttaaagattatctcctttaggggatgcaaagaattgaagaacctgttccttgaaangatcantggggaatcctcaatgagctggactctcaagnacaagagtaaaaacactccacnttggnggggtgggaa

SEQ ID NO: 95897 - DNA, 541 bp, Triticum aestivum
  unsure (1)..(541): unsure at all n locations
  Clone ID: PAT_TA_95897
atcccctctccgngatctcaccgngaaaatcctcgaccgatcggnagacaagngcccctcacgctccttcaagatgcanatcttcgtgaanaccctcaccggcaagaccatcacccttgaggtcgagtcgtctgacacgatcgacaatgtgaaggccaagatccangacaaggagggaatccccccggaccanacagcgcctcatctttgccggcaagcanctcgaggatggacgcaccctggctgactacaacatccagaaggagtccaccctccacctggtgctccgcctccgtggaggcatgcagatctttgtcaagaccctcactgggangaccatcacgctggaggtggagtcctcggncaccatcgncaatgtgaaggccannatctangacaaggagggnatccccccgggnccaacagagcctcatctttgccggcaaacaagctggaagatggncgcaccctggctgaantataacatcataaagatctaacctccacctggggctcaagctccgtggaggcatgcagattt

SEQ ID NO: 95898 - DNA, 525 bp, Triticum aestivum
  Clone ID: PAT_TA_95898
aagtgtagaaaggttttgattcgcaaattttatcagtcaatctaagtatgattgggcgaattgctcatagtatattctctttagcccatttttggtgtttatttgtttaattcctaggattttgcttgtgtgttgtcttgtcttgctttgcttttgtggatctgcttggggtggtgtcatcttctcaaaccagtcagaggatcctcaatattttctcagtcctactggagttataatttggttttggttcgttaaaccatccaggtgctttagtttatgtggcccatgagctaaggttaaaaacatccaaagaaaacccttcggtatgattggttgtgtatgattatagtgaactgcatttgcttggaatgcaaaaaacgagctgataaacgatgggaacataatcacatttcctttcttaagctgttcccttgggtggtgtagggagattggagtcagctattacttgtcattatgttgaaacagccaactgctaaaacattagaagatacgtaataacttaaa

SEQ ID NO: 95899 - DNA, 554 bp, Triticum aestivum
  unsure (1)..(554): unsure at all n locations
  Clone ID: PAT_TA_95899
ccagatctcatcaacagcccctcaagatgccagccaccaagatcccaatcgtcaagaagagaacgaagaagttcgctcgtcaccaaagtgaccgattcaagactgtctctgaatcatggagaaagccaaagggtatcgataactgcgtccgtagacgtttcagagggaaaatgtccatgccaaagatcggttacggttcaaacaaaaagaccagacacttgatgccaaacggttacagacgtctggttgtctcaaacgtcagggatatggatctattgctcatgcacaacggatccttcgctgccgaaattgcccacaacgtcagctcccgtaagcgtatcgagattctagagaaggccaaggttctcggagtcaaggttaccaacgctagcgctcgtgttcgtgctgaagaggcttaaagatcagttcaagaacaaatctcaaaaattgtctctttttctggntctcaagttatctatccttttcctcgtaatgctgcgttctccggtctctctttttttccccttcgccatacttttcaatctccccccttn

SEQ ID NO: 95900 - DNA, 528 bp, Triticum aestivum
  unsure (1)..(528): unsure at all n locations
  Clone ID: PAT_TA_95900
ctctcttccgtttccagatacatagaaagcacaccacaccatcccccattccagccatggctagccagcaaaacttcttttctctctaggcgaagatctcttcaccttcggctaccattgaaacaatgttcgatgacttcaggaggtgtgtacttgtgtacaatagcatcgaggagatcatatgcacccaaattatcctttgccagagcaacaaaggtaagctgtggagctcgagctacggcactatcttgcactgatcgacatctgcaatgccatcctagagagcttttcttagctcaagacaagcactcaggaaattgcattggctctcaagaccaagatacagtccttcatccgtctgaccaaagatggcgccaaaacagtgggaagaagatnaacaagaaatctcccttaagctgacaaaggagggttgcaagggtgggcaaactgttnggtgggagcaaaganaaggccgttgcttcaaagggttcaatcaacccangcgggtcccaacngaagttaaatggc

SEQ ID NO: 95901 - DNA, 323 bp, Triticum aestivum
  Clone ID: PAT_TA_95901
cccacacacgcgcgtcttccaccggttacggcgaacggcgagctcccctccgaccaccgcggcgtgactgacttcgcatggcgcgggcgctctcctcccgggcggcggcgaccctgtcccggcggctgggggcccggcccgcggcgctcatgggccgccgcgccaaccacacgcggcgcccccgcgcgatggtgctggagctggacgcggcgggggcgtcgccggcggccgcggagggctccgcgggcgcgctcaagcgtcgcctcctcctcccgcggctacccctgctccgcctacttctcgacgggcagctttcagatctt

SEQ ID NO: 95902 - DNA, 534 bp, Triticum aestivum
  unsure (1)..(534): unsure at all n locations
  Clone ID: PAT_TA_95902
tctgcagtcacatacagtagtaattggcgcttaatccaatcgtgtaatttggttaaggtccatggcgatcaggtctttgctgctccctctggccctgctggttctcgcancanctagctcggcancggtggctcaactggagatnggcttctacagcaagacatgcccggacgccgagaagatntcggcgangagatggccaagatcatcgccgccgcgcccancctcgccggnccgctcctccgtctccatttccacgactgnttcntcaggggttgtgacgcctctgtcctgntcgaatccancgacggnaacgtggcggagaaagncgccaagcccaacaagancctgcgaagattcggctccgtcgaancgcgtgaagggcaagctcgaaggcgcgtgcccgggcatcntctcctgcgccgaagtgctcaacctcaagttcccgcgangcgtcctgctgggcaaagggcccntttggcaatggcgtttggaaagngaaacggaaggggtccaatntcaacgggggcaana

SEQ ID NO: 95903 - DNA, 523 bp, Triticum aestivum
  unsure (1)..(523): unsure at all n locations
  Clone ID: PAT_TA_95903
cccataatatctctctctcctctccccctcccctctctctcctccactcgtcgccgccgtccaatctccggcgagatcccctcccccgccggcagccatggcttccaccttcagcggcgacgagaccgcccccttcttcggcttcctcggcgccgccgccgccctcgtcttctcctgcatgggggcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcgcaacaacccaagctgttcgtcggaatgattctcatccttaacctttgccgn

SEQ ID NO: 95904 - DNA, 514 bp, Triticum aestivum
  unsure (1)..(514): unsure at all n locations
  Clone ID: PAT_TA_95904
tcagagctgttgtgttcgtcttttgtctattctttttacccctccctttctccctctctactctccaggcctggtgccatttaatacccactacctcaccgtcgacctttatacccacccttttacaataatccaattctctgtggccggtccactttcacgtaatacacagttctacttgctcgaaacgaactttcaaactcacaacgacaacgcaatactcgcaaccctttacgaaactctcaacacacagcttcttcagcaatcttgacgtctatccattagtttggcatcggacgaattcgaaagaaacgattacatcataataccaatcttaacaacagaaagaacgaaacaacatcacaatggccgctatccagcttaacttcactctccgcacttcctccaactgcaagaccgtgcacttgctcggctcctgggacggctaccagggtcaagctcccgctctccaaggaccccaagaagtccgggaggctgggtcggatgcttcaan

SEQ ID NO: 95905 - DNA, 523 bp, Triticum aestivum
  unsure (1)..(523): unsure at all n locations
  Clone ID: PAT_TA_95905
aaagctgcggcggcgcgcaggcgaatcagcagcggagccaagcaaccgacgccaccatgggtatctcgcgtgactccatgcacaagcgccgggccaccggtgggaagcagaaggcttggaggaagaagcgaaagtatgagctcggccgccagccagccaacactaagctttcgagcaacaagacagtgaggagggtccgtgttcgcggaggtaacgtgaagtggagggctctccgtcttgacactggtaacttctcatggggtagtgaggctgtgacccgcaagacccgtctcctggatgtggtttacaattcgtcgaacaatgagcttgtgaggactcagacccttgtcaagaatgccattgtgcaagttgatgcagcccctttcaaacagtgggtacctgactcattatggagttgaaatcggtangaagaagaaagctgctgcaactgccaagaaggaagctgctgaagggacaagaaggctganggttgctgcctgctgccacaagangnaacaaaana

SEQ ID NO: 95906 - DNA, 550 bp, Triticum aestivum
  unsure (1)..(550): unsure at all n locations
  Clone ID: PAT_TA_95906
gcccccgcccgccgccgccgccgcacagccgcaggtagagaaggcaaggaggaagggaagatgccngcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaaggtgcaaanaaggagttcctccaaagggaagctcaaacaacgacaaactgaaaggcggagggccaaanggtgcntggtgagggtcatcaaccaccaagangcaaccaagcaagccccaaacctgggttcaaggnggagggaacaccatcgagacggtcaccccatcccgtncgaagtcnncaacgatntca

SEQ ID NO: 95907 - DNA, 171 bp, Triticum aestivum
  unsure (1)..(171): unsure at all n locations
  Clone ID: PAT_TA_95907
aagcccccggctgcncctgttcncgccgcaaccaanccttccgcttccgcttccgcacggntggncatttcccatccccggaaccggagccggaacccccggaccttttctactcctctcccagaacccatncctctgacctctcccncctcccancgntcgcacgatcaa

SEQ ID NO: 95908 - DNA, 552 bp, Triticum aestivum
  unsure (1)..(552): unsure at all n locations
  Clone ID: PAT_TA_95908
ccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccaagccgccgcatgcgctcgcgggcgcgcgcgctgaataaaataaaaccancgttcgtgttccgtagttctgtatgcccctgtccgtgtgttcaacaantatgtcctcctctgcctccacttttaatg

SEQ ID NO: 95909 - DNA, 545 bp, Triticum aestivum
  unsure (1)..(545): unsure at all n locations
  Clone ID: PAT_TA_95909
gctcaagcccccagacgccgcagcgccgccactccacccgcagcggcaaccatggcggtcggcaagaacaagcgcatctcnaggggaaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcaggtcccttgtgaggaagtggcaagacactcattgaggctcatgtggatgtgaagacaactgacaactacatgcttcgcatgttcgccattggcttnaccaaananacgcccgaaccaagnttaacgcanttgctatgcccaancaagtcnnatttanacagtt

SEQ ID NO: 95910 - DNA, 553 bp, Triticum aestivum
  Clone ID: PAT_TA_95910
ggacgcggcctccctccctttctctctcctcccgcttcccgacttcccgttgctctgtccctccctccctcgtccgatctgcatctgccccggcccccttctctctccgccttctcgtttttttcttctcccttcgttcttggcagtgtcaagatttgtgtttctttcgtcggagcggcggcggtggagtggtggtggggcggcgggagattcagggagatctagctcgatccgcctcggttcttggagcttgaagacgcggggaggcgagatggcggcgcaagagcaggagcagcaggccaagacgagcaccaccagctcgctgccgtccagcagcgaccgctcctccagctccggccccaacaacctcaagaaaggaggcgcggagagcgacgaggagatacggcgggtgccggagatgggcggcgggtcggcgtcgtcgggcgcgggggacggcaagcagctgcagctggcggcggccgggggtgggcaagccccggcggggaagaagcgcgggcgcgccgccggggacaaggagcaaaaccggctgaaa

SEQ ID NO: 95911 - DNA, 373 bp, Triticum aestivum
  Clone ID: PAT_TA_95911
aacaacacaagagcatgcattctgcacatcgcttgtaacttcgattgagaaaagctcaagctcccccctgagaagcaacatgtcctgaaaaaaaagatggatgccctgcatgagatcacgaagcttcatggaaacttctccacgctcgcttacgaggcactatagaaggtcctggcgtcattcgaatctgccttcgacaattaggcgaccatagctcgtgcctctatcaagcactgagctttagtcattagcttttgttttagtgtcctagaacgtgtatcatgacactgtcgaatttccggccacctccattgcactcataccttttgcttagaaccatggaatttgtaccctggtttataaaaaaaaaaaa

SEQ ID NO: 95912 - DNA, 527 bp, Triticum aestivum
  unsure (1)..(527): unsure at all n locations
  Clone ID: PAT_TA_95912
ctccatcccgcgcgcgctcgcggcccggcggcgcatcacccgcttcggctggcggtagatcccctgctccggctgctgggggcctcgcgcggcgccaccctgccctcggatccaccgcggcggcgccctggtggctctcctgcgcgagtgtctatcgccgctcccatggcactcctcctccggcctgtcggcgacttcgctggccgtgtcttgccccctccgctgtcaccggctgcttcctggtgcagcgtggcctctccccaagatccacctcccgcagcgccaccccctgccccgaccttcagctgctgttgaccctcccgactgctcctcccagtggcccggccatgcctcctcctttcggctggctgtggatgcttctcgcctggccatgcctcctcttggttggctgtggatactactggtgttggcgattccgggtttccctgcccaaatctggccctcgatggatggtgggggatnaagtgcctgcaacaaggttggcgatggtgggattctaaggtggg

SEQ ID NO: 95913 - DNA, 538 bp, Triticum aestivum
  unsure (1)..(538): unsure at all n locations
  Clone ID: PAT_TA_95913
gaccctgcggaggaggcaccggtagcgagcgacgcggccgggaaagcgtccggcctgcctctcgccagggaggccggcgtccgggaggcggccggagcggggcgcaacttcgtcatctcgccgctgtccatccatgcggcgctcgcgatggtgaccgccggngcgcgaggcgacacgcgcagggagctcctgggtttcctcgggtcancgtcgctcgacgagctgcaccgctcgccggcgatcaagcttgtgggcaggctcaacggcctgacgcagacgtccttcgcctgcggcgtgtgggtcgaccagaggcgggcgctcaggccagaagttcacggccaccggcgcgtcgcggtacgccgccacggcagaatctgtggactttgtgtcggggggccganctggcgaagcggcgcgttaaacgccttttgtggcggacgcgacgaaccancgcatccatgacaataactccctcccggctccgttcaatcgtcaacggaggtcgtcctccccaaangcgctctaattnaaaaggang

SEQ ID NO: 95914 - DNA, 551 bp, Triticum aestivum
  unsure (1)..(551): unsure at all n locations
  Clone ID: PAT_TA_95914
ctccatcacctggatcgtaccctccacgaactagctcgagatagaccccagattttccttatcaaaaaggaaaaactcagaagctcagaaacctagctaaaagctatggccatggttatctcctccggtgttcaagctccttgctctctcctcatggcaaccttgatgctgctcattgtccaggcgcaaagcttcaccaggcactacaatttcaatgtgcaaatggccaacgtgacgaggctgtgcgccaccaagagcatcgtaacggtgaacggggagtaccccggcccggcgctcgtggcgagggaaggcggccgcgtcgttgtccgcgtcaccaaccatgtcgcgcgcgcacaacatgacgctgcactggcacggcgtccggcagctgcgaaacggctgggtcatcgtcgtctatggcgtcgtcatcgtcgtctatcgtcgtctatggcgtcaacttcacttctccgggcancgtggcacgctgtggtggcaccgcacattcgtggcaacgtctaaggngtcancgtcgtccnttccaaacaaggggn

SEQ ID NO: 95915 - DNA, 540 bp, Triticum aestivum
  unsure (1)..(540): unsure at all n locations
  Clone ID: PAT_TA_95915
agcaccaccgccgccagctccacacctcgagagggacacctcgtcgccggagaagcaagaagaagatggccggaaggaagggcggcgagaggaagaaggcggtgacccgctccgtgaaggccgggctccagttccccgtcggccgcatcgggcgctacctcaagaagggccgctacgcgcagcgcgtcggctccggcgcccccgtctacctcgccgccgtcctcgagtacctcgccgccgaggtcctggagctcgccggcaacgcggccaaggacaacaagaagacgcgcatcatcccgcgccacctgctgctggccgtccgcaacgaccaggagctgggcaggctgctcgccggcgtcaccatcgcccacggcggcgtcatccccaacatcaactccgtgctgctccccaagaaggccgccggcgccgccgagaaggagtccaacaagtcgcccaagaagaanggcgccaacaagtccccaagaagaagancgcaancaacaaaggagtaaccgttcccatccccatannctaagcaat

SEQ ID NO: 95916 - DNA, 525 bp, Triticum aestivum
  unsure (1)..(525): unsure at all n locations
  Clone ID: PAT_TA_95916
agaagctcgatccatcgtctcccgcagctcaggcagggccctcgccgccctgcaagagcgagctagggaagacagaggacatcattaaggagatggcaaaggtgcaccccgacgcggtcgtggcgctgccagaggcgccggctgctggccactcgcggcccgtaggagctggggccgaggaggaggagccgccgccggaggccatggcgctgaccgtgtggcgcaagtcgctgctcttcaactgcgacggcttcaccgtcttcgacgccaccggcggcctcgccttccgcgtcgactgttacggcacgtccggtcgcaggcgccgccacgcggaggacgtcgtcctcatggacgccgcagggttcccgctcctcaccgtgcggcgtagaaggctcagcctggcanagcactgggtcatctacgacggcgacggtggcgaagtcgacgctccgaagccgctcctctcggttcgccgctgccacgccggcttgttgcgcaagcccaacgcgttctcgtcctncaant

SEQ ID NO: 95917 - DNA, 541 bp, Triticum aestivum
  unsure (1)..(541): unsure at all n locations
  Clone ID: PAT_TA_95917
ccacactccacaacaccccatcatcaacaccatcatccacaccgttcaacacactttccacacactcggaagcataccaagaagaaaattcagcaccgcccgcctaccataccgtcgtagaccccaccctccccatccccaatatgacaaacccgtacgacccccaagaagaagactgcgacacgcaagaaacgcaagacgacacacccgaaatcacaatcaacgccgcaacacagatccggggccacggaaacatcatatccattgcgcagatggatagcgtgaggatagcgaatctcattgctactgtgctcagtggcgagactattgagacggggaagataggggaggaggatggtgcggctggcaggcctcttacaccagagagtccgacgacgcaggcgacggcacgcggggagtgtacgtctacgacgcaggttagaggcgtgaagcggtactccaacatcaacatcacggtgaactgcggcgcgaacatcatcggtgataaggatatcntgggaaccggactgggcgatatcnc

SEQ ID NO: 95918 - DNA, 513 bp, Triticum aestivum
  unsure (1)..(513): unsure at all n locations
  Clone ID: PAT_TA_95918
agatggaagatcctggaaaatccctcaataatccatctcctgactatgaagatgaggtctccagacagtattccgaggataaggaagaggagtataaagatctgaacagtcaggacgaacatacttccactcagcctaatgatgactcagtagctggacatcatgaacagaaggcacagaccgaaattgggcaggaggtggaaatggaggagttgcccattcaacagggagaacgagtcatncttgcaagtnctggcgcgngcctttncccaacaancaagggcccnttttnnaggggtcgccattctctgttccgtcagcagcgccgtttggtggcaccaaaggagagccccctacacgtcgccctgacagcgataatgaaacggtagaaaagaaattccatgagcggttccttgtcagagaagctccaggcagcggcgtcatgacttggggggaaatctcttccctgaagacatggaactggttggnataacctgatgaggcccccncngg

SEQ ID NO: 95919 - DNA, 528 bp, Triticum aestivum
  unsure (1)..(528): unsure at all n locations
  Clone ID: PAT_TA_95919
gcacctgcgggagaagctctggcagcagctcggccgcacggagcgtgccgtagagcccccatagctcagcggcgggcacatcggcctcgaactcgtgaaccttgttcctcctcatcgccatggacttgatggactgtaatgcttggcgccgaaagcaaattcccttgcctactctaattctctctggaaaagcatggtcatgctctcaaaattgagcatctcccagaggccagcagagtgctccattcaccgctagcgcgcctttcaccgctgctggcatgtccttgatggtggcgacggccggtgaggaagatggagccagcggccggcgatcatcggcatgggatttgttgctgcacgctatggttatgtatttgtttttctttttgggggaaagggttttatccctggtttctttacaaaatcatagatgttcttacaagaatatgttaaacgggaacaattttgggaccatctgnttcaacagtgtgacaaaatttancaatatcccagttnaaaaaaaaaaaa

SEQ ID NO: 95920 - DNA, 557 bp, Triticum aestivum
  unsure (1)..(557): unsure at all n locations
  Clone ID: PAT_TA_95920
ctcgcccgtgctctctacccatcagatccgcccgcccacgggtgtgtccgtggccgagctgccggagtaactgcggccgccgccgtccctggggccctctgacgcgtccccgagcaccgccgtgccccgctacatcttcccctgcccgaactcgagctcgccgcctctacttcgaccccgaacgttaccgtctttctccctgggctgccgcacgccgtcgatggctccggccaactcgagtcgtcctcgggccgtcccancaacggnaatgacggnttccaagagncanacgacgccantgatgactactactacccggaggatgccaactactacatgacgaccgctgacgattgggatagtatganggtcccaagcaagaggccttgcctttcgatcgttggtgctttgtgctancttcttaaggnaaactgtctaactaagtttgnaccanatatggtgcttccgctgaccctgngtttnaactaagtatcgagcctccaggcctggctgtaaanaaactggatattaaattnaaaaaaaanaaaaaaaaaaaa

SEQ ID NO: 95921 - DNA, 456 bp, Triticum aestivum
  unsure (1)..(456): unsure at all n locations
  Clone ID: PAT_TA_95921
caaagcngctgccgccgccgccccgcaccacgctttaaacccctctaggagatcaccgagcccancgcgcgcanaggacagcaggcgccgcgatctcncgcaggancgganatggggctcacgttcacnaagctgttcagccggctcttcgccaagaaggagatgaggatcctcatggtcggtctcgatgnggctggtaagaccaccatcctctanaagctcaagctcggagagatngtcaccaccatcccacaatcggngttaatgtcaaactgtanagtanaaanaanattaatttnacctttnggatttcgnggtcaggacaagatcangccctgtgnangcatattccaagaanaccaatggtctaattttgcatgtnagnatgacagtaagtgttgttaggcacnatatangttaaccgctttgatangttaacncctgatnngtctgttg

SEQ ID NO: 95922 - DNA, 540 bp, Triticum aestivum
  unsure (1)..(540): unsure at all n locations
  Clone ID: PAT_TA_95922
tcctcctcccccccgccgccgctccccagatcctgccaccatgtcgacggagaagaagcagctgaaccccatgcgggatatcaaggtgcagaagctcgtcctcaacatctccgtcggtgagagcggagatcgcctcacccgcgcctccaaggtgctggagcanctgagcggacagtcaccagtgttctccaaggctaggtacactgtcaggtcgttcggtatcaagcgtaatgagaagattgcgtgctacgtgactatcangggtgagaaagggatgcaactgctggagaatggcctgaangtgaangagtacaactgctcaagngggacttnaacgacaacggtgctttggctccngatccaaggagcacacnctntcgnatgaagtatgatcatctaacggatctacggatgggctcntgtgggggtcanactggtggtacggtctccgcgcgnaagtgaaggcccgtcgttcacaaaggtacaaggggcncatnaatggtcangtcaatanaggggacccaaaatccatcnggtnaa

SEQ ID NO: 95923 - DNA, 426 bp, Triticum aestivum
  unsure (1)..(426): unsure at all n locations
  Clone ID: PAT_TA_95923
ccggaagaaggccatcgaggtcgggtcccgcgtggacgcgctgcagaccggcatgaccaccatggtcgccgcgcccgcgcaccaccgcgagcggcagcggctccaccaccaccaccaccacgcggagccgcacggcgaggagctgcaccgccacgtgaagcagcagcggacggcgtggaacgggcgcgccaagaacccggatntcaaacangcgccgagcccggacaactccgacgccgaaggcnantgaagcanctaggnatcaaagagaagcaacggttncantccaagcatccacaaccggcggccatgcagtagctatctccngggagccccanccgggtgtgttaatcaaggttaanaaaaacagtcaatccaatccaacaccaactantgttcgcctgtctcctaaaaactcncccggtg

SEQ ID NO: 95924 - DNA, 299 bp, Triticum aestivum
  unsure (1)..(299): unsure at all n locations
  Clone ID: PAT_TA_95924
caaacccaaagaggaggaagaacaccaagggactcaactancaaggcctcctccggnattcaaatccccccnggaaangtcttgggttgatccccttcctcctcgaccggctcccaagcttttgccaatctcaanangggatttnaagnccggtcttgncnntcaaattccaactgnctttgacccctttgncgaggcgaatgctggggacgctggtgcanctgccggntnaaaagactacgttcangttcgcatncanacancgtaanggncccaagagcctaccaatgtccangggc

SEQ ID NO: 95925 - DNA, 182 bp, Triticum aestivum
  unsure (1)..(182): unsure at all n locations
  Clone ID: PAT_TA_95925
gccacacaacagcaggaccttaaccagttacccggtcacctatcattnacacaaaatgggaaaattacntagcgctccctgcnaanttccttgacantcnggctggcaaatgntcctcctgtncgccgccggtccggcggtcgcgcaaaaatgnaaanttncccgcgggnannttttttatc

SEQ ID NO: 95926 - DNA, 227 bp, Triticum aestivum
  unsure (1)..(227): unsure at all n locations
  Clone ID: PAT_TA_95926
caaacgcgagcagagagcgcaacacgaagatggcgacgatgtccctcgccgcggcctcacccctcaccgcctccaccccccgcggtctcgccgtgcccgcgccccgcgcgccattcctcggcctccgcncaatttggcncgtcggccaacgcggtncccggggttggcggtggcgcngcggcgntccgtggaaggggnnaatncggcnntgttaagntnggcaaaca

SEQ ID NO: 95927 - DNA, 333 bp, Triticum aestivum
  Clone ID: PAT_TA_95927
cggcgatgaagaacgcaagcctactcaccgatgacaactacgggtcggtcaagaaggtatacgtggtagccaaggctgatggatccagcaccgaggagatgcagcgttggatggtgatgttgagccctggcacggaggtcgaggagatcgccggagctgaccacgccatcatgagctcgaggcctagggaactctgtgatgctctgggtcaagatcgccaatagcttaaatacttgctaaagtgtgcaatatatatccctgggaaatcaatgtatgtgtgtatatgattttcatctaaaaaataaatatgttcagtgatacgattaatcaaaa

SEQ ID NO: 95928 - DNA, 517 bp, Triticum aestivum
  unsure (1)..(517): unsure at all n locations
  Clone ID: PAT_TA_95928
ggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctgggtagggagaagtttgctgcggttccatctgggtgggtggtggtgntggccgtttcaagctgctgcccctgctgctgggaggtgctgctgcccctgcagctgagtcaaagaaagaagagaagtcgttggagaaggaagagagtgatgatgacatgggcttcaatctgttcgactaagttgtgggggnacttgtgtctgaagtatctatcctgggcaagaaactagatcaatgatgtttaacctttattaactagttgtgaaacacgggaagacatgttttgatatta

SEQ ID NO: 95929 - DNA, 486 bp, Triticum aestivum
  unsure (1)..(486): unsure at all n locations
  Clone ID: PAT_TA_95929
aatccccacccgccctctcgaagcagcagctagcgatggcccccaaggcggcggagaagaagccggcggcgaagaagcccgcggaggaggagccggcgacggagaaggccccggccgggaagaagcccaaggccgagaagcggctgccggcggccaagacggcggccaaggagggcgaaggcaagacgaggggccggaagaagggcggcaaggccaagaagggcgtggagacgtacaagatctacatcttcaaggtgctgaagcaggtgcacccggacgtcggcatctcctccaagggcatgtccatcatgaactcttcatcaacgacatcttcgagaaactcccggncaaggccgcaagctcgccgctacaacaagaagccacatcactcccgggaagtcaagacttcgtccgctctctcccgggaactcccaaagaagcctctcgagggacaaggctcacaagtnaactctcgtaattcatcnt

SEQ ID NO: 95930 - DNA, 154 bp, Triticum aestivum
  Clone ID: PAT_TA_95930
tggacatggtcaattgcaagacccccgagcagatgcaccagatggaggaggaagacatgtgcacatggttctctggacttactcccttttctgagaaggggacggcggcagcggagggggcaagaagggggagaaccgttggtcaacggccggc

SEQ ID NO: 95931 - DNA, 542 bp, Triticum aestivum
  unsure (1)..(542): unsure at all n locations
  Clone ID: PAT_TA_95931
acctctccccgtccaagtagcagcaaccaacggcatccatggcccccaaggcggagaagaagccggtggcggagaaggccgagaagaccacggcggggaagaagaccaaggccgagaagcggccaccagcgtccaaggagggcggcgagaagaaggggaagaagaagaacaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgagtccgccaagctggcgcgctacaacaagaagcccaccatcacgtccagggagattcagacctccgtcgcctcgtcctccccggcgaagctcgccaagcacgccgtctctgangggacaagggcgtcacaagttnactcctcttaatagctgctcttgtgtctctctgaatgtttgacttctctggctgtttgtgaatccattgtctcngtagtagatgtcaanaccacatttttg

SEQ ID NO: 95932 - DNA, 525 bp, Triticum aestivum
  unsure (1)..(525): unsure at all n locations
  Clone ID: PAT_TA_95932
ctgttgcagcagctgagaatgccagacttatcgatcctgggaatgcagaagttgggatgattctaaataatgtgaggctagttgcaagagctcgagcccaagggaacgaactcttcaaggctgccaagttttctgatgcttctatagcctatggtgaaggcctcaagtacgatccttcaaatccagtgctccactgcaaccgagcagcttgctggtggaagctagacggttgggagaaagccgttgatgactgtaatgaggcgttgagaatacagcctacttacacaaaggctctcttaaggcgaagcaatgtcctattccaagctcgatcgttgggctgattgtgtgcgggattatgaggcgctccggaaaagacttcctgccgatactgaggttgctgaagcantgtttcatgctcaagttgccttgaagacaactcgtngggaggatgtacaaacatgaagtttggagagagttgaatggtaacantgtaaanaacttatctgcaacccgtngcctggggat

SEQ ID NO: 95933 - DNA, 167 bp, Triticum aestivum
  Clone ID: PAT_TA_95933
ctcccacctcccactctcccaatcctatcccctttgcttctcgcgtgggagctgggattcctctcttcggcagccatcttatttagttccaccatggtgccgtcccggatccgcttcgcccgccaaatccccctcccctgctgctctgacaccgaagaggaggaagg

SEQ ID NO: 95934 - DNA, 515 bp, Triticum aestivum
  unsure (1)..(515): unsure at all n locations
  Clone ID: PAT_TA_95934
cccaaccctcccagcgctcccccctcctcaacaacctcccggcgcatctccgactccatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacacaacctctgcgccatccacgccaagcgcgtcacatcatgccaaggacatcaagtcgccgcgcatccgtggagaanggctaagtctgtcgtctctctgttatctctcttagcanatggttaacggtgaaattngcnt

SEQ ID NO: 95935 - DNA, 537 bp, Triticum aestivum
  unsure (1)..(537): unsure at all n locations
  Clone ID: PAT_TA_95935
gacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgaggctgtgacccgcaagacccgtctcctggatgtggnttacaattccgtcaaacaatgaacttgtgaggactcaagaccttgtcaagaatgccaattgtgcaaagttgatgctgcccccttcaagcaatggtacctgactcaatatggagtcnaaatccgtangaaagaagnaagctgctgcaactgccaagaaggaactgctgaagggcaagaggctaagntgctgctgctccacaanaggaacaaagaagagcaacaantcaaangaacttnagaancgcaacaaggacgtaactggnctcccacattnggagna

SEQ ID NO: 95936 - DNA, 477 bp, Triticum aestivum
  unsure (1)..(477): unsure at all n locations
  Clone ID: PAT_TA_95936
gaagctcctagccaacaccaatcaaagcctccatccaatcccaagcaacctcgaggatgtcttgctgcggaggaaactgcggctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcagctgctagatctatcatcggtcatgcatgcaccgcgcgcatcatatctatgatctatctacaatctacttaccatgttacgccacctgatcganggtctttgtaagtatgtaagcactgccaacatgagcagagcaagtgcactgccatgcatgttaaccgaccctaaataaatctcccgtgggttaacaaa

SEQ ID NO: 95937 - DNA, 533 bp, Triticum aestivum
  unsure (1)..(533): unsure at all n locations
  Clone ID: PAT_TA_95937
agaacatgatcaccggtacctcccaggctgactgtgctgttctcatcatcgactccaccactggtggttttgaggctggtatctccaaggatggccagacacgtgagcacgctctccttgctttcactcttggagtgaagcagatgatctgctgctgcaacaagatggacgccaccactcccaagtactcaaaggcgcgttacgaagaaattgtgaaggaggtctcttcctacctgaagaaggtcggctacaaccctgaaaaggttcccttcgtccccatctctgggttcgagggtgacaacatgattgagaggtccaccaaccttgactggtacaagggcccaaccctgcttgaggcgcttgaccagatcaatgagcccaagaggcctcagacaagcccctccgtctcccctcaaggacgtttacaagattggtgggattggaactgtgcctgtggccgtgttgagactggtgtcatcaagcctggtatggttgttactttggnccaatggnctganactgaggcaatcntg

SEQ ID NO: 95938 - DNA, 478 bp, Triticum aestivum
  unsure (1)..(478): unsure at all n locations
  Clone ID: PAT_TA_95938
ggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctgcagctgcaactgagccggcgcccaggaggccggccggcgaggcgagcacgaggatgaggaggacaactggacaagcaaccaccaccaccaccaccaccatcactagccgctgcatgcgcccgcccgcgcgcgcgctgaataaaataaaccgtcgtgtgttccntaactctgtactgtacgcccgtgttttcaacaacaatgtccttgctcatgctcaactctaatacatggcgcctctct

SEQ ID NO: 95939 - DNA, 506 bp, Triticum aestivum
  unsure (1)..(506): unsure at all n locations
  Clone ID: PAT_TA_95939
gtctgaatcagtgacgaaaccccactccccactctcctcgctccccgatccccttctggatcggggcaacaacctcggcgcctggcgccccgctgcctaccccgccattcccccgtcgcctggcgctcgccggaccccgtctgcgccgtcccgtcatctcttcctcgcccaaggtcgcgcccgaaggccgcagacgccgcggccatcgccgccctgcttggacctcgccggacgccatcgccggactgcctccccatcgtcctcttcgtcgcctactcatccccgtcttcctcctcaacagctccaacgagcctcgccgcccctcgtccctgcaacatggatgctggagtccaggagccagacgccaccgttgatgacgactactactacttgggaggtgcctactactacgtgcagccgctgacggcgacaagagtagttaagaggtccaagcangaggctgcgctcttcgatcgtatccaanttgtgcnaccttctaaggaaat

SEQ ID NO: 95940 - DNA, 492 bp, Triticum aestivum
  unsure (1)..(492): unsure at all n locations
  Clone ID: PAT_TA_95940
gggctgtggcggtggttgcggcaatatggccagtgaaggcaccaagagtggtttcgccaagtcaggcggttgcggttcaggctgtggcggtggttgcggcagcatggtcattgaaggctccaagactaccttcaccaagtcaggcggttgcggttcgggctgtggcggcggttgcggttcgggctgtggcggtggttgcggcaacatggtcattgaaggctccaagactgccttcaccaagtcaggcggttgcggttcaggttgtggcggtggttgcngcagcatggncattggctccaagactgccttcaccangtcaggcggttgcggttcgggntgtggcggccgttgcnngttgaaggctgtggcggtnggntgccggtancatgtnntggnaatatccctagaggcantaataaattgtataataganttcaactcnacanagnttaanttggcggnagacttaactgagatttatgtttgggtttc

SEQ ID NO: 95941 - DNA, 520 bp, Triticum aestivum
  unsure (1)..(520): unsure at all n locations
  Clone ID: PAT_TA_95941
gcgaaagcacttgaactgcaactgtctgaagatgtgaaacggcgattgcttattgagcgggcaaatgctgagcgggagaagtgggtccaagcaataaatacaacttttgagcatataggaggtggtctccggacgatattaactgatcagaataagctagtagtagcagttggaggcgcaactgcacttgcagctgggatttacacaacaagggaaggtgcaagagtagtctggggttatgttgaccgtattctgggtcagccatcactgatcagagagtcatcacgagggaagtatccttggtcaggtgtcccttcacgtgctatgagtactggtgactagcaaactgaaaaatgggagcaatctggggaaaggatgggaaaaggtttggtgatgtcatcctgaatccactcctcagaagagagtgaaccaactagcttatgccaccgcaaacacaagctcacaaagcccctttaggaacatcttctatgggctcctgcacaggaaaacatggnacaag

SEQ ID NO: 95942 - DNA, 537 bp, Triticum aestivum
  unsure (1)..(537): unsure at all n locations
  Clone ID: PAT_TA_95942
tcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgaagccggcgcacangaggccggccggcagaggcgagcacgaagatgaggangagaagcaagcaatcatcatcaccaccaccaccaaccagcgtatcaatacactagccgccgcatcgctcgcgcgcgcgctaaataaaataaaaccgtcatgtgtccttaagtctgtacgacagtgtcctcccaancctcanttctaatgaatatatggcgctcaacttgaacatc

SEQ ID NO: 95943 - DNA, 457 bp, Triticum aestivum
  unsure (1)..(457): unsure at all n locations
  Clone ID: PAT_TA_95943
agcaacagcaagtgatcaacgtgagtgtgatggcagaacaaagttctcgtatttcgcattcagacacctccccttacaacgcttcgaacttggagaaggacagtcatgatgggcaacagctccccgaccagcagcagaaggagacgaccgaggctgagaagaatacagaaaatgccaagaaaaggaagaaaatgccaagaagagaaattcctgttaacaatgaagagaatgaagagctacttgccaacctagaggatgcgatacttcaagaattgtctgatctgagcgttgctaatgctaagtccgggtacaagtgctggtgtccacatcaccattgatgacatccgaatcataatcctggggaatagcagaagaacatcaaagtgtgccgccaacccgccaaccttaaggaanatctcaantcatctcagtcgccctcaaagatacttcatacttt

SEQ ID NO: 95944 - DNA, 448 bp, Triticum aestivum
  unsure (1)..(448): unsure at all n locations
  Clone ID: PAT_TA_95944
gacacggcggacaacgaagggtgccagggcgggctcatggacaacgccttcgagtacatcaagagcagaactcccccgtggtggtgcacatcgacgggcaccaggacgtgccggccaacagcgaggaggcgctggcccaggcggtggcgaaccagcccgtgtccgtggccgtcgaggccagcgggaaggcgttcatgttctactccgagggggtcttcaccggcagctgcggcacggagctggaccacggcgtcgcggtggtcgggtacggcgtggcagaggacggcaaggcgtactgggacggtgaaagaatccgtgggggcgtcgtggggggagcaaggctacatcagggtggagaangatcccggcgccgccgggcgggtctgcgnatcgccatggaggctcctacccntnaagaccgacaanaagnccagccaanccgacgccn

SEQ ID NO: 95945 - DNA, 464 bp, Triticum aestivum
  unsure (1)..(464): unsure at all n locations
  Clone ID: PAT_TA_95945
cccctttcgttgtccttccccgtcccattccctccgctccccagtccgcagcagttccgcaccgacaccctcaccctccccaaagccctaaccgctcgcccgctccgccgccatgaggtccaaggccaacggagacaccgcgttcaaggcctccggcaagaacaagacggccaccggcggcgtcgccaagccgaaacgcgcccccacccccttcttcgccttcctggctgagttcaggccacagtacatggagaagcaccccgaggcaaaggcgtcgccggccgtcaccaaggcggctggggaagaagtggcgcagcattccggatgaggagaaggcaaagtatggcggcaagaaggcagatgccccagcaagcaaggcggtgaacaagaaggagagcacaagtccaagaagaccaagactacgctgacaaanaagttctgacgttgaggatgatangaggntt

SEQ ID NO: 95946 - DNA, 467 bp, Triticum aestivum
  unsure (1)..(467): unsure at all n locations
  Clone ID: PAT_TA_95946
tatanatgctgttccaaanggttgtngctgatacccaaaaagctcctcagtagatatgatcctctccagcacatcacttggtggatctanaggggcaaccatcagcttatgaaaaagggaaaataaattgcctgctattgttccttaccaagagnaatttccccagtgcctaacttacaatttgatttgttgcatcatgataagatctccatgatgtgcatatgcatgantatttttacattgaattccgttttcctatatattttacatgcatgccgttcacatattagaggacaaatatgttncaagctcttatctacatgcatgaatgtnaactctgtatccaatggtaaagcgggctttacaagtgacatgggcgggacttttccacatatatacttcattaagttncacaagtatatactttgccagcatctttgtanatngatnaacggatantcaatcna

SEQ ID NO: 95947 - DNA, 455 bp, Triticum aestivum
  unsure (1)..(455): unsure at all n locations
  Clone ID: PAT_TA_95947
tagtagcatgaggtggtagcgggagagagagcagagacttgaagcttgtcctgttcattcatcttgttctccttctgccattgctggcgtacgtacgcgcgtcttgttttttctgttcaaaggttcagttcaagttgcttgttccttcttccattgctggcancgaatcgatcttttttcgggtttnatcttttgctgtnnaagaaggncaanttncttgcncttttcgatcttcttgggaggtgtttgttcttgccgaggtccgagtganattgattcagcagcatcaatgctactgtttggaagacaaagactgcttcctgcagtgtcaggatttgtgatctcttgcttgcaagtcaaccatggcgcttcanatagcctccnagggtctgaaccaaagctacaagatcgttcaagcattgggagctgaccccaagctgtccnctgcaactcaa

SEQ ID NO: 95948 - DNA, 456 bp, Triticum aestivum
  unsure (1)..(456): unsure at all n locations
  Clone ID: PAT_TA_95948
cccacccattcccctcaccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaaccgggtacctcaagggcgtcgtcaccgatgtcatccacgacccggggcgtgggtgcgccgctggccaaggtgaccttccgccacccgttcaggtacaagcaccaagaaggagtcttcgtcgccgccgagggtatgtacaccggcattcgtctactgcggacgccgcgccacgctctccgtcggcaactcctcccgtccgtccgttccctaaggaaggctcatctgcaacgtccaacacaagtccggcgaccgttgtgtctcncaaggctcgggngctacgcatctcataann

SEQ ID NO: 95949 - DNA, 460 bp, Triticum aestivum
  unsure (1)..(460): unsure at all n locations
  Clone ID: PAT_TA_95949
gctaggtctgcagtacaaaggtagccactacagctcgtggtgtaccggcggtagagcagagcagcacgatggggcagctcagcaagaagcttctggtggcgtccatggtggtggcggtgctggccgtggcagcagtggagctgtgcggcgccatcccgctcgaggacaatgacctggagtcggaggaagcgctgtgggacctgtacgagcggtggcagaccgcgcaccgcgtgccccgccaccacgctgagaagcaccgcccgcttcggcacttcaaagtccaacgtccacttaatccactcccacaacaaagcgcggcgaccgccctaccgcttcgcttnaaccgcttcggcgaattagcaagnccgattccgcgcactttnnccggtcccgctcancgacgcggccgcnacggcccgccaagcaacgtccgncccggggtcaattncccgccgttaan

SEQ ID NO: 95950 - DNA, 229 bp, Triticum aestivum
  unsure (1)..(229): unsure at all n locations
  Clone ID: PAT_TA_95950
tatccccgtctgatgaaggcacggtcttgaataatgacttgatanagaaaacagatggctatctctctgatnaacattcatttgagcacaaccaaaatgcagattcaaatggtgatatgtctactacagcntancanttggnagacttgaccatacatganggaaaanagtcnaaaacnancttnatgattanccnagctntaataacccnaggcnaccttnaggtttc

SEQ ID NO: 95951 - DNA, 518 bp, Triticum aestivum
  unsure (1)..(518): unsure at all n locations
  Clone ID: PAT_TA_95951
atccanacgacggcgtccaagttcagcagcatggtggcgcatccgggcggaggaggcggcgccatcgcgccgccgccgttcgcgcagcgcgcgctctccgcggtgtaccggaggctgaggaancggatcacgggcctgatcgtggnggtggcgcagaggtccggcgggcacggggagccgtcgtcgctggcggacaaggagcggagctgggagtcntccttcatccagaagcactgggcgctgcagcagctccggcgcggcgaccagcagtcgtggcggcccagcgcggcctgccggagaanccgtcgccgtgctcaaagcctggatttcgagaattcctccgcccgtacccgaaagacacganaangacatgctggcggcgatgagcggactgagcangagccaagtctccaactggtcatcancgcgcgcgtccggcttnggagccgatgatcnangaatgtcgacgagtcaagaggantcgngcgcgcgacccgacatcaagagcacanagactg

SEQ ID NO: 95952 - DNA, 491 bp, Triticum aestivum
  unsure (1)..(491): unsure at all n locations
  Clone ID: PAT_TA_95952
cacacacgaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagattcatcatcgatcatgcatgcaccgtgccgtgccgtgcatcatcgatcatatcgatctactactaccataccatgttaccgcaacctgatccnanggctttatgttacgcacctgactgatcaacatcaagtgcatgcatgattgtaaacangccccctaaataaactccctggattactattaaaaaa

SEQ ID NO: 95953 - DNA, 537 bp, Triticum aestivum
  unsure (1)..(537): unsure at all n locations
  Clone ID: PAT_TA_95953
gagcacctctccccgtcgccgccgccgcagcagcatccatggcgcccaaggctgccgagaagaagccggcagagaagacccccgcgggcaagaaacccaaggcggagaagaaggtgccggcgtccaaggagggcggggcnngaaagaangggaagaagaagtccaagaagagcgtggagacgtacaagatctacatcttcaaggtgctgaagcaggtgcacccggacatcgggatctcctccaaggccatgtccatcatgaactccttcatcaacgacatcttcgagaatctggtcggcgagtcngccangctngcgcggtacancangaancccaccatcacgtcccgggagatccagacctccgtccgcctcgtcctccccggngaactcnccaagcangccgtctccnanggcaacaangcntcacaaagttcacttccgccttgattcnggctgatggttgattcaccctgtagttcctgttcgtgctctgtcctcntgtactgtctngctgtgtgggattacatccatgatt

SEQ ID NO: 95954 - DNA, 402 bp, Triticum aestivum
  unsure (1)..(402): unsure at all n locations
  Clone ID: PAT_TA_95954
accaagcaaacccgatggcccgcacgaagcagacggcgaggaagtccaccggcggcaaggcgccgaggaagcagctggccaccaaggcggcgcgcaagtcggcgccggccaccggcggcgtgaagaagccgcaccgcttccgccccggcaccgtggcgctccgggagatccgcaagtaccaagaagagcaccgagctgctcatccgcaagctgcccttccagcgcctcgtcagggagatcgcgcaggacttcaaagaccgacctgaggttccagtcctccgctgtgtccggcgctgcangaggccgcccgaggcatactggtggggctgttcnaaggacaccaactctggcgccatcaacgccaaagcgcgtcacatcatgcccaangacatcaactcgcaa

SEQ ID NO: 95955 - DNA, 501 bp, Triticum aestivum
  unsure (1)..(501): unsure at all n locations
  Clone ID: PAT_TA_95955
ccaatctccaaagccagatccccagcccctccatcccaatggcccgcacgaagcagacggcgcgcaagtccaccggcggcaaggcgccgcggaagcagctcgccaccaaggcggcccgcaagtcggcgccggcgaccggcggcgtgaagaagccccaccgcttcaggccgggaaccgtcgccctccgggagatccgcaagtaccagaagagcacggagctgctcatccgcaagtccccttccaagcgcctcgtccgtgagattcgcgcaaggacttcaaagaccgactccgcttccagtcctccgccgtctccgcgctcaagaaggcgccgaggctactcgtccgggtctccaaggacacaactgtgcgcatcaacgcaacgcgtcacattatgcccaaggaatcagtngccgccgatcgaagggaacngcnaagttcncttggncccgtaanacggcaatactgtctttctgtatccggttttccgngctngttgttgtt

SEQ ID NO: 95956 - DNA, 443 bp, Triticum aestivum
  unsure (1)..(443): unsure at all n locations
  Clone ID: PAT_TA_95956
gcatgccagtttgctctcgctgctcttgaacaagttgatagcattgttgatttggacaatggaagtgaagtcgaggatctcccagagactacagcgatgattaaaggacggctatgggccaatgtattcaagtacagcttagatttgaaaaacttccgtgatgcatattgtgctataatctcaaatccagatgatgatagcaagtatgtctgcttgaggcgtttcatcatagtctttgtgagcttgggcgagactaaggcatttgcaatggtgagataccgttcactggtttggtggaaaaggtgggagcaagagctcttctggaaggctgagcgctcaagatctaccttctaaaccaaatctatacaaaancctttatccattngaagcttataaggacaattggaggaagnaactggatcaagtacaagnatttggtagat

SEQ ID NO: 95957 - DNA, 507 bp, Triticum aestivum
  unsure (1)..(507): unsure at all n locations
  Clone ID: PAT_TA_95957
gatccagcgcaaccgccgccgacaccacacctcgtgagtcctcgtcgccggagaagcagcaagcaagatggccggaaggaagggtggcgacaggaagaaggccgtgacccggtccgtcaaggccgggctccagttccccgtcggccgcatcgggcgctacctcaagaagggccgttacgcgcagcgcgtcggctccgggcgcccccgtctacctcgccgccgtcctcgagtacctcgccgccgaggtcctggagctcgcaggcaacgcggccaaggacaacaagaagacccgcatcatcccccgccacctgctgctcgccgtccgcaacgacaaggagtcggnaggctgtcgccggcgtcacatcgcgcacgcgggtttatccccaacatcaatccgtgctgctccccaagaatccccgccgccgccgagaaggaggcaagtcgccaagnagaaactcaacaatcccccaagaagaaacgcgcacaaggatanctcccatactacca

SEQ ID NO: 95958 - DNA, 528 bp, Triticum aestivum
  unsure (1)..(528): unsure at all n locations
  Clone ID: PAT_TA_95958
actattttcacaggtactgcctcatcgaccaaggatctacggcgacagcggcaccagcgaccccatggaggcggcaccgaaaccctggttgctactgctctcccctgagtcccctcctcatctcctccctcacgcggtgtcttctctctctttctctctcgctctctcaagctaattttaatctgactccatcttggggtgctactgtgcgtgcaatacatgctctgcttggtcttcttttcttagacatccctcgatcagttaagttggacaagcaaaaaatcttacatatctcagctttgtcaattaagctcatttgattgatgtctttatcttcacaagtcttgctgaaccttgagataggcaaaaacattcaagttcagagcctgatagtttgttgctataatantaatacctacacttctacattacaattgccggtcctggagattcaaattcaagatatgaaaaactatatagggttttcaantcccctggggaatggttggctacatnttcctttanatg

SEQ ID NO: 95959 - DNA, 576 bp, Triticum aestivum
  unsure (1)..(576): unsure at all n locations
  Clone ID: PAT_TA_95959
ggtgattctttgaacttgaagttcacaaattttgcaagtacatttatgttctccatacattgactaaaccaatgctccccaaaattttgttcacctgattccatttgcgattaacttcattataagtatatatgtatttttaaattatagatggtgtgtttgcttgagggtgtgggtttccagaaggctttccattcatttttggttcttcttatagctctttatgtcgtgtatattaaaatgcagcagcatacatgtttcaaaatatcagaagatttacatcctgtggcacttgtaactgacaatgatgcacanaaattggnacatttaaactttaaacgtactgaatatatgctttccaagttagaactttgttttgtgaacnacgttgcatgggctatcctggcctgcaatttttgnattttaanacaatgcaggctccaggctggnccctgtncanggggatcaaactggccccaaacancgtataangctggattacagaaatgggaaggctttggccctttgntacccgccaacctaaangggccacnncccccttgngngcctncccag

SEQ ID NO: 95960 - DNA, 589 bp, Triticum aestivum
  unsure (1)..(589): unsure at all n locations
  Clone ID: PAT_TA_95960
agcgaagatatattgcaccctacagctgatcatctccacgtcgtagccatagcagctttagcttcacatacatacacacacatacatacgtaggcatgggcaccagcaacgcccggcggctgatggtcgtgtcgtgcctggccgtcctggcgctcgcggccggggcgcgccggccgagcgtccaccacgccgccgcaccaagcgctgcggcgccggctcccagcaacggcggagtagaggcgaaggtcggcgggttcgcgagggcggacggggcgcggttcacggtgggcggccggccgttctacccgaacggcttcaacgcctactggctcatgtacatggcgtccaaccccggcgaccggagcaaggtgctcgccacgcttgaccaaggcgtcccacgtcggcgcgacggtcatcangacgtgggccttcaacgacggcgggagcaaccgggcgctgcaaatnaaccccggcgtctacagcgaaggacgtgttcctgggactagatttcctgatcgccgaancgaaanaaacgangnccnctacttgatcctgagcctggcaaacaactgggggtgactttggcggg

SEQ ID NO: 95961 - DNA, 514 bp, Triticum aestivum
  unsure (1)..(514): unsure at all n locations
  Clone ID: PAT_TA_95961
gttgctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcaaggtgtaatgggcgacgatccgtcaagctggtgctcaagctcatccatccacgttggagttgaagcgcgcaagctctatccctatgtagnaanggtcacn

SEQ ID NO: 95962 - DNA, 520 bp, Triticum aestivum
  unsure (1)..(520): unsure at all n locations
  Clone ID: PAT_TA_95962
tggtaatgtgattagttgtatgtttatgtgggaggcttcactgcttaaccagcttgctgttagaattgggatagttctgtgttgatttgataccaataattttatcattcctgtctcagcttgtttgagatctgtgctgttgtagtatatgtagcctgcctagtataaatatgagtgacgtcccaaccattttaaccatgattggtagtattattactttataaatttgactgaaatcattatattgatggtgagctttgttaactgcattctaatgctctcatatgtaagcaatgcatggattaactttattgattgaccttcttttaattactgctttggatgttctgtgttccatctttagtattcctgcaataaaacattatgtcagtttgaattgtaatactctattatggaattacatatctgcatggaatttctacctgtattcctagtagtttatttttgatccngtaatgctgtaagnttggctgtcctcaaatctttttgngtacaagcn

SEQ ID NO: 95963 - DNA, 171 bp, Triticum aestivum
  Clone ID: PAT_TA_95963
cggccggccggagatgggcgcgagcctcctgcaggcggtggcggcgctggtgagcacgtgcacgcggcggctgcagcgcgcggcgaagaggatgggcagcggcaggccggccgtggcgccgtggaggaaagccttctcgctgccgacgggcaaggggagggcgttgggctg

SEQ ID NO: 95964 - DNA, 565 bp, Triticum aestivum
  unsure (1)..(565): unsure at all n locations
  Clone ID: PAT_TA_95964
gttaattgctcgtttgagaaggaataagtcgacgattaatttgggtggaggactagcatgcataatcttcaatccaatgataaaactgaagatggagctcaatcttcaagtgaagaatctcaagctccattgtaggaccctcaagtccaaggtggaactcaagctccaagtgaagaaaacaagttccatgtaatatcaagattctgatcaagctccgccgctgccccccaatagttcatactagcggcctcggtgccattgtttgcttagttgtgacttgtccggttgctgcttttgttcgaaaaattaaggtgactttgtggttcaggtccgtgtcgagatttagtataaaaatcctgatagtatctgggcatattaacaactcaacatgaaagcatgcatgatccaagtctgcatgttctgaacgtattggtatcaatgcatattagtataacaagctctcatanataatataggagattttttaattttaaaaaaggaggatgacccggctcgcaatccgggcgatgcatngcagccataaatagtatangagatggtgacg

SEQ ID NO: 95965 - DNA, 564 bp, Triticum aestivum
  unsure (1)..(564): unsure at all n locations
  Clone ID: PAT_TA_95965
cggggaggataggtgaggcgagagaattgttcgacagaatgcctgaacggaatgtggtgtcttggaatgtgatgcttggtgggtatctgcggctttcgcacatggatgaagcctatagattgtttgcggagatgccagataagaactcaatttcatggacgacaatgataagtgcattagtgcgtgctgggaagctccaagaagcaaaggatatgctgaacaagatgccttttgacagttttgcagcaaagactgcactgatgcatagctatctgcagagcaagatgatcaatgacgcacgccacatctttgatgcacttgaggtccgagatgcagtgtgctggaatacgatgatatctggctatgtccactgtggaatgctttgacgaggccaaggttttgttccaacaaatgccaaacaaggatatggnttcctgggacaacctgattgctggctatgcccaaagagggtcaaatgcgcaaggcagtaagtatattcaaggaagatgagtcagaggaatgcantatcntggnantcagttatctccgggtttggtcaaaang

SEQ ID NO: 95966 - DNA, 234 bp, Triticum aestivum
  unsure (1)..(234): unsure at all n locations
  Clone ID: PAT_TA_95966
antcancaagatgacntagncagatannangatctcnaaganaagatngnaaggtangaaaacgancagagttcaatgcatgtggaagaggttgacggnaccacatcaaancaggaggtggagaatagcggccgcagcagaaaancttgcacnagtgncaggagaccatgttgattcttggtcgtcaactgcaatctatgcgtcctccagcagaggtcaatgggtgcctcgcca

SEQ ID NO: 95967 - DNA, 568 bp, Triticum aestivum
  unsure (1)..(568): unsure at all n locations
  Clone ID: PAT_TA_95967
gagaaatctcaatctccatctccaaaccgtagcagcagcagcacccctccttgccgacgaccccccagccccgatggcccgcacgaagcagacggcgcgcaagttcaccggcggcaaggcaccgaggaagcagctggcgaccaaggcggcgcgcaagtccgccccggccaccggcggcgtgaagaagccccaccgcttccgcccgggcaccgtcgccctccgtgagatccgcaagtaccagaagagcacggagctgctcatccgcaagctccccttccagcgcctcgtccgggaggtcgctcaggacttcaagaccgacctccgcttccagtcctccgccgtctccgccctgcaggaggccgccgaggcgtacctcgtcgggctcttcgaggacaccaacctctgcgccatccacgccaagcgcgtcaccatcatgcccaaggacatcaagctcgcgcgccgcatccgcggagaacgcgcctangctctgcacgcgccccgtcgccgcgctttggttgctaactgttttatgactccgtagttgtttgcctcccttgaagtcctgggg

SEQ ID NO: 95968 - DNA, 567 bp, Triticum aestivum
  unsure (1)..(567): unsure at all n locations
  Clone ID: PAT_TA_95968
tctctccccaccactcgccgtcgccgccgcccaatctccggcgagatcccctcccccgccggcagccatggcctccaccttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacgggctcatcatcgccgtcatcatctccaccgggatcaaccccaaggccaagccctacttcctcttcgacggctacgcccaactctcctccggcctcgcctgcggnctcgcgggcctcgccgccggcatggccatcggcatcgtcggcgacgccggcgtcagggccaacgcacaacaacccaagctgttcgtcggnatgatctcatcctcatctttgctgaaaccccttgccctgtacggctcatctcggaatcatctctcctcgcgtgccggcaatccgcgccgactaanaanaaa

SEQ ID NO: 95969 - DNA, 582 bp, Triticum aestivum
  unsure (1)..(582): unsure at all n locations
  Clone ID: PAT_TA_95969
gaaatgtgcaactcatggatgactgaagaaaaacagcaaccaggacttggagtagcactgcactacaaagagataagattgattcttaagctacatgtatgggtgctgctgctgctgataatgatcatgatggttgaagaaaaccttcagtacactgcatgcagtcaaattgcactcacgtaagcacaaccttttgaagagtcagcagaactttatttgtcaatagtggcagctaatttaggtcgttacctgcttaactgtgacatcacacgatgcaaattccatcccattttgatgagggatggctggttcatcttcagatggacaaagaaatttcactggctatcaggattagtctttgtatataagatggtgatggctacagaagtcttgctggttgtgaagatagcatgaaagttccataacccttctttattcattgnttcagtgatataccatgtggaacaatacaattgctttgatatgatttacttgagtatccttctagctccttcatgttctgctttagtggtatagcaacagagacgctctgtgatcacatgaacataatcaaatatcttn

SEQ ID NO: 95970 - DNA, 550 bp, Triticum aestivum
  unsure (1)..(550): unsure at all n locations
  Clone ID: PAT_TA_95970
cccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccgggcaaggtgaccaggctcaggaaggagtgccccaacgccgactgcggcgcgggcaccttcatggccaancactttcgaacggcactactgcggcaagttgcggctcacctacgtctacaancanaanggttagaggttgc

SEQ ID NO: 95971 - DNA, 561 bp, Triticum aestivum
  unsure (1)..(561): unsure at all n locations
  Clone ID: PAT_TA_95971
ctcccctccctccagcaaactcacgcatcccaccaccgaagctcccaaccccacccgaagcggcagccatggcccccaaggcagacaagaagccggccgccgagaacaaggtcgagaaggcggcggagaagacccccgcgggcaagaagcccaaggccgagaagcggctgccggcgggcaagacggcgtccaaggaggccggcggcgagggcaagacccggggccgcaagaagggcagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggggagtcggccaagctcgcccgctacaacaagaagcccaccatcacctcccgggagattcagacctccgtccgcctcgtcctccccggggaagctcgccaagcacgccgtctccgagggcaacaaggccgtcancaagttaactctcctagactgaagatgcgccgcttgttgtgcaaatgtt

SEQ ID NO: 95972 - DNA, 544 bp, Triticum aestivum
  unsure (1)..(544): unsure at all n locations
  Clone ID: PAT_TA_95972
cccacatcctgctccgcttcatccccatggctgcgacgacggcggcggcggcggctgctgctgcggctcacctgctcacctccccacctgtcgcgtctccgcggcccgtacctcgccgtcaccgccgcaccggggccgccaggcgcctctcctgccgcgcgtcgctgggccccgacgcccccctacccgcgctcgccgtccccaggccgtcgcccgctcgggggaggacgtacctgcgggagcactcctgcctcctcttcccacccccgcgcggcgcccgcccgctcgccgtcgtcaagttcctcgnggcgggccttcatcggcgccgcccccgaggccacctacggctacctgctggagctcctggcgcaagaggggttcctcgtggtgtgcgtcccgtacaacgtcaccttcgaccaagcggncgccgcgcgggaggtcttcgagangttcacggctgctaagaagcgctccgaacgtcgggcctgccggaaggccggggctaagggctctggacatccgggctcccgntctantccgttgg

SEQ ID NO: 95973 - DNA, 581 bp, Triticum aestivum
  unsure (1)..(581): unsure at all n locations
  Clone ID: PAT_TA_95973
ctanctcgttgcacangaattccncccaccctcgcngtctcgccgccgtcaccaccgcagctagataagaganaaanagagagagaagaactcgtcgggagggctcgagatctgtgttcggagaggggaattcttgangtcggaatcggaacaagcgggcgcgctcgggatcggggttaccatacaatttttcccannaacctttagtgantgtgctaatggagtcaaagggtggtaaaaagtctagcantantanttcccngatgtacgaanctcccctcggntacagcattgangacgttcgacctgctggaggcgccaagaagttctctgctgcatactcgaactgcgcgaagaagccatcctgatatcgtttttggcatccccttcccgtagtttaggatttttactgcaattttaatctgactcttttcncncagcaatctctctggcttgctgcttcacgataatcgancanntctcgaagtcnttctncctcagttcctctctgcnctgctttctgactcanaactgcaanaatggctgccccgaactcngcnatcggcttgagggtacaagan

SEQ ID NO: 95974 - DNA, 606 bp, Triticum aestivum
  unsure (1)..(606): unsure at all n locations
  Clone ID: PAT_TA_95974
gagagagagagaggcacacccacacaacacaagcagccactgagcatccaagggttgcaatggccggctgcggagagaagagcgacgccggcgttggcctgtacgccgtgctcggcgttgcgagcgactgctccgacgcggagctgcgcagcgcctacaggaagctggccatgaaatggcacccggacaagtgcggcagcggcagctccggcggctcggaggccgccaaggccaggttccagaagatccaggcagcatacgctgttctgtcggaccccaacaagcgtatcctctacgacgttggagcctacgcgtacgcgcgctcctccaagtcctcctcgtcgtcgtccaagataagtgccggcaagaagtagctcccaagatgaatgatcttcgcatgtggagatggtcgtgttgtttctaaaagaaatgatcttcgtacgtggagctgcagctggctaatttcatccacggcagatgactctgaagaagagcatctccgcggaggcgaagagangcaatcgccaagattaatgttgaagtcntcagcatagagcatagcctagtcactaagaagaatttattaaggtggcatgcggatgacac

SEQ ID NO: 95975 - DNA, 583 bp, Triticum aestivum
  unsure (1)..(583): unsure at all n locations
  Clone ID: PAT_TA_95975
caaatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaagctccgtggtggcatgcagatnttcgtcaagancctgaccggcaagacatcancctggaggtccagtctctganacaatcga

SEQ ID NO: 95976 - DNA, 539 bp, Triticum aestivum
  unsure (1)..(539): unsure at all n locations
  Clone ID: PAT_TA_95976
gagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaangaagagagtgatgatgacatgggcttcagtctgttcgactaaattgtggggcaacttgtgtctgaaaaaccctgggcaagaaactanagtcaatgatgttttaacccttaattaactganttttgnaacnctggnaaaaaaatggttttgaaanggtaattcanccccnggttgcnggttaanta

SEQ ID NO: 95977 - DNA, 557 bp, Triticum aestivum
  unsure (1)..(557): unsure at all n locations
  Clone ID: PAT_TA_95977
natctcnccacccaatcatcactanctaanacggtgcactgttagctacanaccatcaagtgatcatggnccgcgctcaggtaatgctcatggncgtcgccttggagctgatgctcgcggcggtcacgcgcgctgccgtggncancgantgcggccacgttgacancttggtganaccctgcctganctacgttcagggcggncccancccgtctgggcagtgctgcggcggcgtccanagcctccataaccanncgcaatccaatnagcgatcgccaagccgcttgcanctgcctcaaggggatcgctcntggcatccacantctcaacgaggacaacgcccgcagcctcgcccccaagtgcggtgtcaacctcccataccanatcagtntcnacatcgactgcaacagtgtgtaatgagcgacgattcgtcaagctggtgctcaactcatccatccacgtggnnttgaagcgcacaacctctagccctatgtngtangggcactagattatgcnaagtttaaactgaatatgaatangaactctctcccgctggn

SEQ ID NO: 95978 - DNA, 186 bp, Triticum aestivum
  unsure (1)..(186): unsure at all n locations
  Clone ID: PAT_TA_95978
gagagaactagtctcgagttttttttttttttttttgcttcaccaatacaatcttcttgcttccttccgcgatagcatgtccggtagcgccctcncacncancggcagnaaccaaaactcgaacgttcgnattcncnagcggtnccnntcgaaancaaccaccccgaagantncccgttgatgagg

SEQ ID NO: 95979 - DNA, 532 bp, Triticum aestivum
  unsure (1)..(532): unsure at all n locations
  Clone ID: PAT_TA_95979
cgtggccgcgccgatgcctgccacggcaccggccatcgccgtggcggccatccggcggccctccccggcgacccctcgcctataagaccggcgcctcttcccacggcgcctggaaccctaatccccattcgcccctctccctctcgcacgagccgccgcccgtgcgttgctgtcgtcgcgtcttcgtcgtcaccgcgcaccggggcctccctgagcttcacgacgatgtccaagagcaccgcctccctcctctacttcgactacatctaagggatcgagctgggcgcctcttcttcgccgggatcgaacgcctcttcctcttcggccaccgacgcctctccgtcaaatacactacggctgctgctcctaaactcccaacgggccctcgtgcgcctactagatgctggagtccaggagctagagatccgangatgattctagtggagtttcgnttcaaggatantnagaggtccaaggaaggaggccttgccttttcattgtngcaactttgggcaacctcctaaggaatctg

SEQ ID NO: 95980 - DNA, 567 bp, Triticum aestivum
  unsure (1)..(567): unsure at all n locations
  Clone ID: PAT_TA_95980
cttctaagtagtactagtacgtgagcttctctatcactagtgcacgtgtgcgtgtgtccactgattcaactacatatatgtgcagcagctgcatcttctctctttgctgctctccaattctcttcgcttgatcctgggaagctagataccctgtagtctagctaacaggctggaccatcgtgatgcatccaatccgaggtggtggtggtgttaatggagagttccgatccaatcattccgacgacggctggtgcaaagtgacgggcgaacacacgcgtggacggtggttgttaccggccgccgcatgtcgcgctagttggtcgtgtgggactagggacctgtgtagttgacgccgaagtcgaagtanaggtgcgcaaaggtgaaaggacggcggccgaccatgcaaatcaaattttcttggggacttacaaggtcagaatctaacatgcaacaccttccagaaccattctgttagtaaactgaaccaaaatactaaatacactgaccatgctaggaatccagactttaatagtgcgcaaaagctccttgtttcttgtgcatcaagca

SEQ ID NO: 95981 - DNA, 567 bp, Triticum aestivum
  Clone ID: PAT_TA_95981
cagccacccaacactatcacaaagccgcacaagctagactatctcctcagtagaactaccggagcctcccagttagcaatatggcaaagtgcctcgccgtcgcgctcctcctactggtggcgctcgcgtactgcgacgggagggagctgaaccagaaggatcaggcactagcaacggcacgcggtgccggtgctggtggtgctgtcgacgagtccaaagcactagggctgccagacctgccgcttgtcggaaccgttaccggtaccagcaccattaccggcccgctggtggtgcttcctgggatccctgctcacccatgatcatctcgtgttcatgtgcttacaagatgaagctcaccttgtggctttagactttaggctgtagctagcaccgtccggaggaaaaatgccggtgtttccctcatgtccatgctccttaatgggcgtctgtatcaaccagcctgtcatctgtatttctttgcagttctttgttccagtagttttcgttccttgatgtgccacatgtatcatcaaagtaataaatactactcctttgtcagaaaaaaaa

SEQ ID NO: 95982 - DNA, 538 bp, Triticum aestivum
  unsure (1)..(538): unsure at all n locations
  Clone ID: PAT_TA_95982
tcgagttttttttttttttttttagcacgcgaccaagaggtccagtcccgctaatatataaattactcactcctggtagatttatacagtaaaacgtcattaggtaaaagtgtgtgattggtgctattcgcgctgatgcccaagcaacacttaccaaaatggatcaagcgcgagcacccataaatacatgccaggcttactaataataccaaaagaggcatcgcctaactctgcttctctaccttccaactctacttgcctagtctcccagctacctcttgtgatggaaacgcaccttcagcaagaactgcatcttcacctgggatgtgttgtagacgatgtactcattgtacatgagttcagagctcctaattgatgatggcaccggcttgccgcagggaactacgacatcatccctccacttcacaaactctgactccagtggcacggttttgcctaatcccttgggtccgaatgcttccctcntggagggtttgtccaanggacgtggctttcctttaantcaanaaagtcccct

SEQ ID NO: 95983 - DNA, 519 bp, Triticum aestivum
  unsure (1)..(519): unsure at all n locations
  Clone ID: PAT_TA_95983
agttgctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccaagagcgatcgccaaagcgcttgcaactgcctcaaggggatcgctcgtgggcatccacaatctcaacgaaggacaacgccgcaagcatcccccccaagtgcggtgtcaacctcccatacaacatcaagtctcaacatcgactgcaacaagggtgtaatgggcgacgattcgtcaaagctggtgctcaagctcatcaatcaacgtggagttgaagcgcgcaagcctctatccctatgtagtaagggcan

SEQ ID NO: 95984 - DNA, 541 bp, Triticum aestivum
  unsure (1)..(541): unsure at all n locations
  Clone ID: PAT_TA_95984
cgcaggcgaagcacccactcaaaccctagcctcctccccactccatctccgatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatagcgcaggacttcaagaccgacctcaggttccagtcctccgccgtctccgccctgcangagggccgccgangcgtatctggtgggggctcttcgaggacaaccaacctgttgcgccatccaacgccaaagcggcgtcaacatcaatgcccaaaggacatccaaacttcgcccgccgcatccgtnggggaagcgccgcctaaggttttgggccgttacaagttcgtggtcntggcatctggttgtactnaaggaaatttgctngggg

SEQ ID NO: 95985 - DNA, 532 bp, Triticum aestivum
  unsure (1)..(532): unsure at all n locations
  Clone ID: PAT_TA_95985
ccgccaactagatgcgtcccaaaaactaccctagttcgcaccaactctcacagccgccgaccgatccacggctccacgcacctgcacgacctcacgctcgcgccgccgccgctcttctcagccgccaaccaggctcgcggctgccgtcgtctacctgtcgcgggccgccgccgaggagccgtccaccgaccgccgccgttccaccacttccccagaccccagcccccaggcagaggcaggcccctccgcggctccgccccaggctgctcccctagacccggtctccgcaactgttcccgggcgcggtgcgccgttcgccgccgtgcgtcgttccctacttccctgccttaccaaaataaaagttgaggaataagatgagagatgattggctgaatcacaggatggttcgctatattgaccgagatgtanttgaaangtattgatgatggtgctatacatatcgctttaatcaatatagtcttgcaaaggggcttttacctccgtcnaaantgtgttnggntaaccnaccgtt

SEQ ID NO: 95986 - DNA, 428 bp, Triticum aestivum
  Clone ID: PAT_TA_95986
ggcggcttcaactcctgttggacaaccgcctgcttggaaccctaacatgcaggcccctggttttgcatctgcatcgacagcgtaccccaacccaccattaatggccaactccacgccttactatcctgctattggatcaagttcaggtgccccgccggtatcgtttcaggcttcacagcagaggccacagtatggcatgccccctggtgctccaccgcacgcaccaccagctggccaaccaatgtacttccagaaataagtggtttcgattcaatgttatcaaagagcattcacgcatattacctgcaactattgttgtccgcaaatgccatctggaatttttttggaagtgcattgtaactcttgtaacttacgagcgccctacgcaagaataccccaggctggctggctattaaaccgtcaaaaaa

SEQ ID NO: 95987 - DNA, 564 bp, Triticum aestivum
  Clone ID: PAT_TA_95987
gctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgattcgtcaagctggtgctcaagctcatccatccacgtggagttgaagcgcgcaacctctatccctatgtagtatggtcactagttatgcgagtttatactgaatatgaataagaactctctccagctggcttgctggtactcctctggaggagatcagtatct

SEQ ID NO: 95988 - DNA, 568 bp, Triticum aestivum
  unsure (1)..(568): unsure at all n locations
  Clone ID: PAT_TA_95988
tctcagtctccatctccatctccaaaccgcagcagcaggccatccctcgccgccgcccgcctcccgcagctccgatggcccgcaccaagcagactgcccgcaagtccaccggcggcaaggcgcccaggaagcagctcgccaccaaggcggcgcgcaagtcggcgccggccaccggcggcgtcaagaagccccaccgcttccgcccgggaaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgcgctccaggaggccgccgaggcgtacctggtggggctgttcgaggacacaaacctgtgcgccatccacgccaagcgcgtcaccatcatgcccaaggacatccaagctcgcccgccgcatccgcggggagcgcgcctangctctgtatccgccctgtgtcagctgccttgaatcccgctagatgtttatgactctgtagttgtctgctctccttaagtttn

SEQ ID NO: 95989 - DNA, 572 bp, Triticum aestivum
  unsure (1)..(572): unsure at all n locations
  Clone ID: PAT_TA_95989
tagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggccgtttcagctgctgcccctgctgctggaggtgctgctgcccctgcagctgagtcaaagaaagaagagaaggtcgtggagaaggaagagagtgatgatgacatgggcttcagtctgttcgactaanttgtggggcaactttgtgtctgaagtatcctatccttggcaaggaaaactaagaagtcaatggatggtttaanccttaattaanctgaagttgtgaaacaacnggcaagacaatggtttgntaaggtaattcagcccctgggttggcnggttgaattaacgg

SEQ ID NO: 95990 - DNA, 586 bp, Triticum aestivum
  unsure (1)..(586): unsure at all n locations
  Clone ID: PAT_TA_95990
ttccactctcctcgcgacctcgccgaaacctcccaaccgaaactccccgaaccccgaaggcgatccatggcggcggcgtgttggctccggcgagcggcatcagcggcggcgttgcatcgcctgccttctggaatcaccctcacgccaacccctcccccgctgctctctccgaggctaagtccctcgtgttccccggccttggcgccgtcatcgcccctgctatgaaactcatggccgtccccaagaagaaggtctcgtcgcttttcgtccccgttatattccgtgtttgcccccgtcacttacatgtgcgtgctctgttcttgatgatctcttgggcattggtgtaacgtggtaccaagaggacgcactctaggtgttcggtgaattgcctggtggtagaaactggtctgtgcgacctttcgaaatgtttcacaagtggaacataatcgataggattatggtgcaggtcacctgctctttgattacttggtaggtcagtgatagatatcgtgtttggcgtttaagccggtttcagttagagcatagagtcttattcatgggctatgttggnttatactgctgtttg

SEQ ID NO: 95991 - DNA, 246 bp, Triticum aestivum
  unsure (1)..(246): unsure at all n locations
  Clone ID: PAT_TA_95991
atcaaatcgagcctgcccttctcgctcgcgtctccactccatttccctttcccccgaggaggccgccgccgtgacctgagagcacacgcacgcaccatgtggcgccgcctccaaaccctagcccccgccctcngccgcgctgccgccgcagccggngcggccccctccncggccanngctngggcagctcacctctccacggnaagncgcnaggcttccgccnnacngggctcntcatctctgcgg

SEQ ID NO: 95992 - DNA, 304 bp, Triticum aestivum
  Clone ID: PAT_TA_95992
gtcggacgccatcgaaggcatcacccattcgatctgcaccctggagttcgagagccatcgtccgctctacgagtggttcctcgacaacctgccggtgccgtgcaagccgcgccagtacgagttctcgcgcctgaacctgaactacaccatcaccagcaagcgcaagctcaagcaactggtcgatgaaaagcacgtgcacggctgggacgatcctcgcatgtcgacgctctcgggcttccgccgtcgcggctacaccccggcgtcgatccgcaaaaaaaaagcaacaaagacgaaaaaaaaaaaa

SEQ ID NO: 95993 - DNA, 548 bp, Triticum aestivum
  unsure (1)..(548): unsure at all n locations
  Clone ID: PAT_TA_95993
ttccgcagcaaccgcagccgccgccgccgtccgccatgggcacggaggtggtgcccgtggtggaccttggcgcgctgtcccagtcggagctcgtggcgctcgcggccgcatcgccctacgccgtcgacccccgccgcgggcgccgcgacgccgacctcctcccgccccctaagatcgatcgcgccgtcttcaacgagagtgccggctcccgcaagcagaccttctcccgccgccgcgccgccaccaatctctcccacaatctcacccctagcaccgcttcctcctccgccgtcgccgtcccccccgaggaggattccgagaaccgcctcattgtgttccacctccagcagctctttgcgcgcgacgacccctcctatctgccaacaccaccgccgattccactccaacaagctacccccgatacccataccgcacccaacataccggtgccgcacccccgtggctccgtgccgattcaacaactcccgggaccaaaacgggattgacgaanccgaaggggtggctgttgatttggtaaaatcccgggt

SEQ ID NO: 95994 - DNA, 567 bp, Triticum aestivum
  unsure (1)..(567): unsure at all n locations
  Clone ID: PAT_TA_95994
caacctcgaaccgcgaccaagtacccatcactaacccggacaacagccaaaatgaagttcctcaaggtcggacgcgttgtcatcatcaccaggggccgctatgccggaaagaagtgtgtgatcatctcaccacttgacaacggcaccaagagccaccccttcccccacgcgctcgttgccggtatcgagacctacccatccaaggtcacccgccgcatgtcaaagaccaagcaggccaagaagagcaaggtcaagcctttcgtcaagcaggtcaactacacccacatcatgcccacccggtacaccatcgagctcgagaacctcaagggcgtcgtttccgccgacacattcaaggaggtctcgcaacgggaggaggccaagaagaccgtcaagaaggncttcgaggagcgataccaagtccggaaagaacaggtggttcttcactcccttacagttctaggctttccttcggttacggctgggcgcanatgggcatgatttgtacgggagatgtgcatgancggtgggtatcataggagncaaggcccaaaagtnggctgcatccaa

SEQ ID NO: 95995 - DNA, 571 bp, Triticum aestivum
  unsure (1)..(571): unsure at all n locations
  Clone ID: PAT_TA_95995
gatccacctcgtcgtgcgcccgcatcgccggccatctcgtcctaccgcggccaccatgcccccccaccgcctaggaccgcgtccgtccgcttcgtcgtcttcctctgcatcaactggtgccacccgttggagctcctcacgctgcaacgccggatcgaagcttcttcctcctcgggtcgccgacgaaccacgacgacgccggccacctctgctgctcctaagccactcgatgggcctccttgcgcctgctcgaccctgagaccggcgctgatgccaccgagtacgactacgtcaccgacgacccttctccctgtacaacagagcttccagatgttggagcccaggatccaagacgccaccgtcgatgatgactactactctcgaggtgcctactactacgtgcaagccgctgacgatgaccaaggagtagtttaggaggattccacgcaagaggcatgcgcctctttcaatctgtanccaatttgtgccaaccctccntaaaggaaacntgtttaacttaaggtcngtactcagataatggtggcttcngctgaatcctccaaagatngaa

SEQ ID NO: 95996 - DNA, 536 bp, Triticum aestivum
  unsure (1)..(536): unsure at all n locations
  Clone ID: PAT_TA_95996
caggagctcttccgcctctctggacgagatccaccgcctactgaggcctttatccagcccagctcatgaggaagccgcgggaggaggagctcaatcgggcgtcaccgaccagagaaggaggagaggcgcggatgccagccaaggaagcggattggcttgcctccgccatgtcatgagcgccgccgccgcctctgcatccgccttgctctgcatagcaccatgtgtgcggcggcggggacaggcaaccacaggctgattttggggagcaagcatcaagcaatggccgatgccatgggattatagcaagcaaccgtcgctgagttcttttttcttgcataaaatttttctactgattcctcaatgctctgttcatgactttcttcntgttttattatttttttactttccaatttcgatgtaatggatattgattgtggtaatccaaatatccccttgtaatcctttggntttaataaagtaaactnnancaagggaatgtgcaagttcaaattataatgatttggggaacgaaaaaa

SEQ ID NO: 95997 - DNA, 554 bp, Triticum aestivum
  unsure (1)..(554): unsure at all n locations
  Clone ID: PAT_TA_95997
tgctcatctctccacccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcagggcggccccggcccgtctgggcagtgctgcgacggcgtcaagaacctccataaccaggcgcgatcccagagcgatcgccaaagcgcttgcaactgcctcaaggggatcgctcgtggcatccacaatctcaacgaggacaacgcccgcagcatcccccccaagtgcggtgtcaacctcccatacaccatcagtctcaacatcgactgcagcagggtgtaatgggcgacgatccgtcaagctggtgctcaagctcatccatccacgtggagttgaaagcgcgcaacctctatccctaagttagtatgggncactagttatgcgaagtttatactggaatatgaattaagaacncc

SEQ ID NO: 95998 - DNA, 405 bp, Triticum aestivum
  Clone ID: PAT_TA_95998
agcaaacattgaggcagctaaggaatggagggataagagggaggatttcaagaaaagggtcaggcgcatcgtgcggaaatcacaggaaatgttatgaagaaaatggaatactggggaagtcaaccgtgccatgtcaggctacgagattttgctttcaacctcaaaatgctcatctgacatcttgtgtattttccatttagcgtctgttcattggtgcaccagaaatgcattgggacgtggtgtatcgtgtggcctgggctctactaatgtttgacaatcctgaagtgccaccagtggtgaacctggtataagcaggcgccattcatgtcagctaatcgttgagaaaacatatcagtgaaatcgtgcaactgttagtgtaatgaggcagttcctgcttacaaaaaa

SEQ ID NO: 95999 - DNA, 514 bp, Triticum aestivum
  unsure (1)..(514): unsure at all n locations
  Clone ID: PAT_TA_95999
caccggcgaagcacccacaccctcacccacccctcttctccgatggcccgcacgaagcagacggcgcgcaagtccactggcggcaaggcgccgaggaagcagctggcgaccaaggcggcgcgcaagtcggccccggccaccggcggcgtgaagaagccccaccgcttccgcccgggcaccgtggcgctccgggagatccgcangtaccagaagagcacggagctgctcatccgcaagctccccttccagcgcctggtgagggagatcgcccaggacttcaagactgacctgaggttccagtcctccgccgtgtcggcgctgcaggaggccgccgaggcgtacctggttggcctgttcgaggacaccaacctctgcgccatccacgccaagcgcgtcaccatcatgcccaaggacatccagntcgcangccgcatccgcgggggaccncgcctaggttttcgttgccgcccgttgacgataactgggtagtaacctgctcctgtctggggttttt

SEQ ID NO: 96000 - DNA, 539 bp, Triticum aestivum
  unsure (1)..(539): unsure at all n locations
  Clone ID: PAT_TA_96000
ccaaatcccaacaccttccggcggcgaagcaacccacccacccttctctccctcccgaagcagcgatggcccccaaggcggagaagaagccggcggcgaagaagcccgcggaggaggagcccgcggcggagaaggccgagaaggccccggcggcgaagaagcccaaggccgagaagcggctgccagccggcaagaccgcctccaaggagggcggcgagaagaagggcaagaagaagagcaagaagagcgtcgagacctacaaaatctacatcttcaaggtgctgaagcaggtgcaccccgacatcggcatctcctccaaggccatgtccatcatgaactccttcatcaacgacatcttcgagaagctcgccggggaggcctccaagctcgcccgctacaacaaagaagccaacatcacctcccgggagattcaaacctccgtccggctcgtcctccccggggagctcgcaagcaagccgtctctgaagggaacaaaggcctcaacaagntcaactcctctaaattgcgtcgcctgnnnt

SEQ ID NO: 96001 - DNA, 457 bp, Triticum aestivum
  unsure (1)..(457): unsure at all n locations
  Clone ID: PAT_TA_96001
agcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcacgcgtgcggctgctcctgctgcagctgcaactgagccgggcgcccaaggaagccggccggcaagaggccagcacgaagatnaggaggacaagcaagcaanacatcacaccatttacaacaaccagcgtttcatcacaaccgcgcatcgctcgcnggcgcgcgcgct

SEQ ID NO: 96002 - DNA, 388 bp, Triticum aestivum
  unsure (1)..(388): unsure at all n locations
  Clone ID: PAT_TA_96002
acagaacagtctgtagtaatctgtaactaacgcaaacttctggaacgtgaaaaattcaaccaaattaggaagttctagacaatttgtttattggtctacagaaaaaataaccaactaaaaagcacgttcctgtgatttatgaaaactaatctccgtgcacgcaaagttctgttttctgcagctgaatcaaataactattaccgtaggttatcctaacggtttacttgggcacaaacgctaatttaaaacacaaaaacgaatctaaccaagaggctagacaaattattattccctaaacaagaagcaaaaaacaataaaataaaataaaaancccccngggggggggcccggnaccaatntncccaaaaaggngnccanttaaccgcca

SEQ ID NO: 96003 - DNA, 329 bp, Triticum aestivum
  unsure (1)..(329): unsure at all n locations
  Clone ID: PAT_TA_96003
gcgccttccacgcggacttcgagctggacaccgagggcgacgtccacaccgcggacccggcgggccggtgcnaggccaacctcgcggcgtaccacgccgtggcggcgctgacctgggaggaggtgctcatccacgggacgaagcactacagcgacnggctgagccggttctgcgangccaacatgagcgaggtggtgtcctccctcgggtgggcgcgcgcccgcccgtggncggagccgctgctgcangccttnttcctggnnggncaagggcattttgnncgggtgcgcctcctggcgctgttcgttcaccnnccgctngccgtnctg

SEQ ID NO: 96004 - DNA, 256 bp, Triticum aestivum
  unsure (1)..(256): unsure at all n locations
  Clone ID: PAT_TA_96004
ganatcttctccactcntattctactcaacncctcgccgccgccgncgcagatcgcaccaccgancgaccgaacngatggtcgcctccacngtcgcgtccaggggncgtggccgtcctcgncgtcntgtcggtcgccnncttcnccgtcgtcgccgctcangaggccncggcgccgagccccgtatcggtcgccggcncantggcaccgtccctcnncgagcncactngtcgcntcnggtgccgctttcctcttcc

SEQ ID NO: 96005 - DNA, 481 bp, Triticum aestivum
  unsure (1)..(481): unsure at all n locations
  Clone ID: PAT_TA_96005
ttttttttttttttttttttaccatnaatattctctaatttaagcatttgtgttgccccctttcaacaactggttacacagtttcttaaatcgtacagttcgtcatggaaaataacacaaacaggatcatatcgctactgtcccggtaaaaagggggaggcattgtgtatctaaaattgtcaagtatggagaacaggggtacaaaatttgtaatgaccaagtattcatctgttgtgtaaagaatgaagatactatattttgcatacctaatacagcaataacaacccagtgcatctcatctaaggtagccatcaaggtaggccttccaacttgaacagtggnatccgatctgtgtatccattctgctacnatggcacnacaacagaatgggggctcggactgtatgtgtttggatcaaattaanaagtgacaacactccttccatatcccctaacttcaacagngtgggacgttctctaaa

SEQ ID NO: 96006 - DNA, 449 bp, Triticum aestivum
  unsure (1)..(449): unsure at all n locations
  Clone ID: PAT_TA_96006
cttcggctcattctcctccattcattcccaccatcgctcgagtgagcgatcagtggcatggcgttcatggcgagcggcagggtggcgatcgctccgaccagagcaaggttcgtcactccccgcagcctcttcaactggggcagaggcgcaaaagacgccgagacgccgcngcgcaatttcaantacaacgggttgagcccccttttccanatctctcnctgggnaananacactcaagaggacgccgagtcanctgctgtacaaggcacncctttangggttaacgcaanngntttcaaccgggggtgcganttnaaanggccctggtcctcctccgntanacgggggaagnccttcaagttccggnggttnaacccggangggtaccgcacacggacatactacaacgtcgagcttctctttantnggccgggaannccggagnaacc

SEQ ID NO: 96007 - DNA, 464 bp, Triticum aestivum
  unsure (1)..(464): unsure at all n locations
  Clone ID: PAT_TA_96007
ctcccgatggcccgcacgaagcagacggcgaggaagtccaccggcggcaaggcgccgcgcaagcagctggcgaccaaggcggcgcgcaagtccgccccggccaccggcggcgtgaagaagccccaccgcttccgccccggcaccgtcgcgctccgggagatccgcaagtaccagaagagcaccgagctgctcatccgcaagctccccttccagcgcctgggtgcgggagatcgcgcaggactttaagaccgacctccgcttccaagagtccgccgtctccgcgctgcaggaagccgcccgaggctactcgtccgggtcttccgaggacaccaacttctgcgccatccacgccaagcgcgtcaacatcatgcccaaaggaatccagtcgcccgccgatccgtngcgaaanggctaagtgttcctaaaacctaatgccnatttggcccnagggttaaatcntcnat

SEQ ID NO: 96008 - DNA, 198 bp, Triticum aestivum
  Clone ID: PAT_TA_96008
gcaaagtgacgaatcagtgttacatagaccttccgtcatgccttgctgagtgcaacaaacctgcaggcatggtggcgatggaaacccctccttcacctaccctattcccgtcaaattgaacttttgattggataaataatgtatgatgtgcaaaaaaaaataaaaataagtatctctgttgtcgttaaaaaaaaaaaa

SEQ ID NO: 96009 - DNA, 417 bp, Triticum aestivum
  unsure (1)..(417): unsure at all n locations
  Clone ID: PAT_TA_96009
gtctcgagttttttttttttttttttttttttttttaacggcancacctanttatttttgctgcaacaacatttggancaaccgganccnaaacggnctccccaacaacaaaaaatcgaccangcnatacaataantgacantgacacaagtaanacgaatatatatcnaattaaancgtgaacccangtcngaaacataancagcgaatgtccctcctaactctcnccagatatcatgaatgaagtattacacttgntgcgncgctantcccctgcctcccccaaganctcnttaaggttttcncctttttccggggaaaaatcncaaagaggcggaacangctcctngttcaagganaagntttccngcaanaagctccttccggatccgtccctaaaaggaactggaaaaagga

SEQ ID NO: 96010 - DNA, 454 bp, Triticum aestivum
  unsure (1)..(454): unsure at all n locations
  Clone ID: PAT_TA_96010
ctcccgatggcccgcacgaagcagacggcgaggaagtccaccggcggcaaggcgccgcgcaagcagctggcgaccaaggcggcgcgcaagtccgccccggccaccggcggcgtgaagaagccccaccgcttccgccccggcaccgtcgcgctccgggagatccgcaagtaccaagaagagcaccgagctgctcatccgcaagtccccttccagcgcctgggtgcgggagatcgcgcaggactttaagaccgacctccgcttccaagagctccgccgtctccgcgctgcaaggaagccgccgaaggcctactcgtccgggtcttcnaggacacaaactctgcgcatcaagcaagggntcacatcatgccaagaatcaattgccgcgattcttgcnaaaaggctaagtntcctaaancaagtctattgcncaggtaaatcttacattctatacctt

SEQ ID NO: 96011 - DNA, 459 bp, Triticum aestivum
  unsure (1)..(459): unsure at all n locations
  Clone ID: PAT_TA_96011
actatatcttaacatctattattagaaatcacacagcaccctccactgagccatgtcatctaggctcatcatctttgccaagtccacaaccagatcaaagccatggaaccatcgttcaaggagtacctcgagaagctcaacacatccctcgacgagatgcacaccaatcagtgttccaacacaaatctcatcaagagttggtcctccaagatcgacgacttggtggcatgatgcctcaatctcaagaagtgtgtggcagacctccgcatggtggcggccacgctccaccaaaggcgcttgacgtcgacaacaacttcatcaggtgaagaggttaggggttgatgtcgtcacacccccaaccttgagactctcgagtcctcttcagcatctgcgacgacgtgccatggtccctatgggtcatggatnaagactcgcaatctactacggggtggngttggg

SEQ ID NO: 96012 - DNA, 444 bp, Triticum aestivum
  unsure (1)..(444): unsure at all n locations
  Clone ID: PAT_TA_96012
ggaaaggttaactaagaagcaatacttcaatggccacccttgttgttcataaccaaacttcttctgctcaagatgctgaggctctccaacaggctttcaaaggatggggggctgatgacaaggccattatagcaatactgggtcacagaaatgttcatcagaggcaagaaatcagaaaagcttatgaggagatttaccaagaggatctcatcaaacgccttgagtccgagatctctggtgactttgagagagctatgtaccggtggatgttgcagcctgcggatcgtgatgctgttttggtgaatgtggcaatcaagaatggcaccaaagactaccatgtgattgcagagattgcttgtgtcctaacagctgaagactcctggcagtgaggcgggcctacaacgccgctacaagtgttccntggaggaagatgtgcaactaaca

SEQ ID NO: 96013 - DNA, 472 bp, Triticum aestivum
  unsure (1)..(472): unsure at all n locations
  Clone ID: PAT_TA_96013
aatccctcaccggcgaagcacccaccccctcccacctccagctccgatggcccgcacgaagcagacggcgcgcaagtccaccggcggcaaggcgccgaggaagcagctggcgaccaaggccgcccgcaagtcggccccggccaccggcggcgtgaagaagccccaccgcttccgccccggcaccgtcgcgctccgggagatccgcaagtaccagaagagcacggagctgctcatccgcaagctccccttccagcgcctcgtgagggagatcgcgcaggacttcaagaccgacctcaggttccagagctccgccgtctccgccctgcaagaagccgccgangcgtactggtggggctgttcgaggacacaacctgtgcgccatccaagcaagcgcgtcacatcatgccaaggacatcaactcgcccgcccatccgcgggagccgcctagttttgggtcccgccgtgaaactgg

SEQ ID NO: 96014 - DNA, 388 bp, Triticum aestivum
  unsure (1)..(388): unsure at all n locations
  Clone ID: PAT_TA_96014
gcccgccgcgctaccacatcaagatccgggccctccagctcgcccctgatccctccccggacgccacggcaccgtccgatccgtgatctgagggtctcggcgtctcgctcgctctgcctgccgtattctttgattgccttgtgcagccagccgcctccgtctctttctcctttccctcgaatctcctccaaagtcgctcgcttggacccgaaggaaggaatgaaacagactggttgattcaacttgattgggatccagatttgctttgtgatatttcttaagcggaattattggtcttgacttggttgcgttgtgggactgaangtcaaaaagttgtgtactgttcangtctgaaaanaacccntaataaaaaatctcctnggggggg

SEQ ID NO: 96015 - DNA, 458 bp, Triticum aestivum
  unsure (1)..(458): unsure at all n locations
  Clone ID: PAT_TA_96015
cctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagtccggcggntcgagacggccggggagaccggcggtgcgactgcaccacctgcaaattgcggaccgcctncggtgntcctgctgcaactcaacggacccgggcccaagagccggcngcaanagcgacacgaggattaggaggacaagcaancaanacatcacaacattnacacaaccaacgacataacaaccgcgatgnctcncgggcccgcctgataaataacacttcgnttcaaaaaaaaaaaa

SEQ ID NO: 96016 - DNA, 523 bp, Triticum aestivum
  unsure (1)..(523): unsure at all n locations
  Clone ID: PAT_TA_96016
aatctccatctccaaacagcagcagcagcaacccatccctcgccgccggtcggccccagcagctccgatggcccgcaccaagcagacggcccgcaagtccaccggcggcaaggcgccgaggaagcagctggccaccaaggcggctcgcaagtccgccccggccaccggcggcgtgaagaagccgcaccgcttccgcccgggaaccgtggcgtccgggagattccgcaagtaccagaagagaacggagtgctgattcgcaagtccccttccaagcgctccntgcggaaatttgcgcaagactnnaagaccgacttccgntccancctccgncgtctccgcctttaaggaggcgcccgaggctattttgtggggtctttcgangacacaactgtgcgcatccangccaaggcgtcacatcatcccaaggaatcaagtnncccgcgntttnaagggaaccnctagnctgtagctccgtgtccgctgtctgggtctgctaaagttataattgtantgttgccccctg

SEQ ID NO: 96017 - DNA, 458 bp, Triticum aestivum
  unsure (1)..(458): unsure at all n locations
  Clone ID: PAT_TA_96017
cgcagcccctggtcacccctctctctctctcaccgcaagaccggaaggagcggagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcaagaaccttggcatcaagtgtccccatgatgtcatcttctccattgtttgccaatgcaccacctgagaagaaagtgtcaagaactttgcaattgacttcctcatgggaagagtgtccgctgcagtttcaagactgcgcaactcctantgagcgtgttaagctgcttatcagaaccaagatgagatgat

SEQ ID NO: 96018 - DNA, 522 bp, Triticum aestivum
  unsure (1)..(522): unsure at all n locations
  Clone ID: PAT_TA_96018
gttggatcccttaaccattatgccaaaaggcgtttacctggtctgaatcggcgcaaaagcattagcgatgtcagtaactgcctttcagtgtcaactttaaccgccatgccttctgaagaggagcaaaggtatcttcttgaggagattgataggctgttacctttccaaaggggtgttacatcttgcaagctgttatttgggccttctgcgcacagcgatcttccttaaagccagtcatcctgcatgtccaacttggagcgtccggataggttgcagcttggataaggcactcctggaagattttcctaataacaaacatgtctgaacctaatggaaatgctcctaagatgtggatgccttacataaggatccttggacatttccttgggaagggntcaaagaacgggtggantctcctggcatnggcgaagatgggactatggttctcaactctaatgccgatacaaggtgcaatttatcgacgntactactaattcacaaatcaactaaatncaaattcgn

SEQ ID NO: 96019 - DNA, 487 bp, Triticum aestivum
  unsure (1)..(487): unsure at all n locations
  Clone ID: PAT_TA_96019
tggtgacggagaccgcgtcgccgccgccgccgcctgccgctggttcggccccggtgcgacggcgtaaacgaacggcacctctcgtcactgcggcgggtgatctcgctcctgcggacgctcgcctcgccccggtaggtcgtctcttccactgcaggtctacaagatgccctggaagaatcaagaacctacaagcatatgcgaaggaggaagcacaagtnagagagcaaaggctcctcgcctcgcaattctgaccgagaaatctccgcctcggcgccaacgtaattttattccgaatnttggaagacaanctaacnttgancggcaacnattgtaacgtttnantttcaaccngttgaaacaagtttaancttttatccaaagagtcttcccccgtaaccnangccatggttatgggnatccttgggaacnttgntttntcaaaattnatgtcataantaanaantaatatgttacttnatcatgccct

SEQ ID NO: 96020 - DNA, 528 bp, Triticum aestivum
  unsure (1)..(528): unsure at all n locations
  Clone ID: PAT_TA_96020
ccgttccagtcgacttgagagcttaaaattttccctttttagctagtagggcagaggaatctgacatatatatcggggatcgatcgaacgtcctaatggcggagatcgtagcttccgcggccgtcagcgaggcgctcagcaggatctcctccttcctcatcgacaagtaccgtgaccggaatagctcaagcgagagagatgacgccggagaggctgggagatggcgcacatcaagatgggaggccgcgctgggaggcgttcggcaagtgggcaacccggcaacggacgtcccgctcctaacgctgggcgggaacaagctgaancgcgcngcccaacaantgcangccttcttccgccgatcaagcgccgaacgttntaagaccaaggggtaaggnatntccncctttgcaaagcggtttctcangccngaatcttcttccctngncctctctcccctctggannaacaanggaacctncaattacngtccgaacctctccggagnacaaangtnccgacggggccgna

SEQ ID NO: 96021 - DNA, 483 bp, Triticum aestivum
  unsure (1)..(483): unsure at all n locations
  Clone ID: PAT_TA_96021
cgcgtgttgaaaatgttgtcgcagagttgacccttgttctcgggataaacgagggggtgatcccagttatcaaagatgcagctgcattggctatgtcagatctttccacttcaattgttacaagaatttacttcactcgctggaattatggcacgccattatgctttaagggatggtcttccagaagagaagcactgtttgagataacacttccaaaggttctctgggcgatgttttcccaaaaacagatgctggtatagtccttgcggttgctgatagattggacagcctagtgggtctgttcggagctggatgtcagccaagttcttcgaacgattcatttggactgagaagatccttaaggattggtcaaatattggntgagaataagaagaacttgacctcacnaaggcttgaccttggtggnaaagtgcaacctataagaatagacaatgacttataaatgaagtantcaattntaca

SEQ ID NO: 96022 - DNA, 373 bp, Triticum aestivum
  unsure (1)..(373): unsure at all n locations
  Clone ID: PAT_TA_96022
cacggtcaagtccgtgagctctgcgcagattgaagctgaggaggangangatgnttacncgaggatcttctacaactatnagacggncatccatggcttcgcggctcgcctcgacgangacgaggctgagcggatngccnaggcggccggcgtgctggncgtgctcccggagacggtcctgcanctgcacancaccagaagccccgacttcctgcgcattggcccngaggtcagnaacatnatctgngcctccgncctcgcngaccangacgtcatcctcagtgtgctcnncaccgncatatnncccgacagccccaacttcagngananggggctcngcccgtgccgtccaantggaaaagctnttcacacc

SEQ ID NO: 96023 - DNA, 417 bp, Triticum aestivum
  Clone ID: PAT_TA_96023
tttttttttttttttttttttttttttttggaggaaagtctaattgcaaatttgacactgaaacgtgtacacatccactcctgccactggctctcctactactcgccttcatcagagtgaaacgaatactccctgtgtctcaaaatgtaagaccttttttggcactacgatggagtaggaaacacaagagcagaggcagagtatatggaaattacaaaagtgccccagccttccatcgatccgtagcgctacttcggtccgcatcctggttcaccgagttaatatattgatgaaacaacaagggcgattccatactattcaagtagccattgttgcccacgggatgtcttcaaggaatcatagctcccgcaacacagcctcaatgtcaggactccacgggtccaacttggggggggg

SEQ ID NO: 96024 - DNA, 515 bp, Triticum aestivum
  unsure (1)..(515): unsure at all n locations
  Clone ID: PAT_TA_96024
cagacgaagactatgagttcctgtcagagatcgagctgctgtcgcggctgaaccactgccacgtggtgccgctgctggggtactgctcggagcggcaggggcggcagctggagcggctgctggtgttcgagtgcatgaccaacggcaacctgcgggagtgcctggacgacctcaacaggaagcccatggactgggcgacgcgcgtcggcgtggcgctgggcgcggcgaggggctccgagtactccacgaggcggcgggcctcgcatcctccaccgggacatcaatcaaccaaatcctgctcnacgacagttcaaggcccgtatcacnggcctgggcatggcaanncctcatgaacgacggcgtnacaactgtcaattcgccgggnccaatctggnacttcgggtattncccccggataancaatcttcggnaagggtccccaantcggactnttcaacttcggcttgtggnctggantcataacggccggaacccttcaaanaggggggccgggc

SEQ ID NO: 96025 - DNA, 509 bp, Triticum aestivum
  unsure (1)..(509): unsure at all n locations
  Clone ID: PAT_TA_96025
ctcgcctccaccgcctcctgtcccctcgcgcgttccgcctcccanttgcggctccggtcgttcccctcctcctcggttgctgagatggccggtcgtgggaaggcaatcggcgccggcgcggccaagaaggcgacgtcnaggagctccaaggctgggctgcagttccccgtnggaaggatngccaggttcctcaaggccggcaantacgcccagcgcgtctggagccggngcccctntancttgccgccgtccttnaatactcgccgcttaagtccctggagctntgccggaangcccccngggacaacaagaaaaacgtatcgtgcccgcanatcaanttgcctttcgcaagacnaagagttacaatttctccggggngccacatcgccagcgcgttttatccaaatcaacaanactctccccanaaagtcttctccaaggtcacctcnattacacacactangctnacttcctnctcaacgccgcacttggaaaattgataaaaaann

SEQ ID NO: 96026 - DNA, 483 bp, Triticum aestivum
  unsure (1)..(483): unsure at all n locations
  Clone ID: PAT_TA_96026
gcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctaacgcgagggggcaagcgtcggcaccctcgggggcgtgctgcagcggggtgaggaccctgaacgccaaggcgtccaccccggccgaccggaaggcggcgtgcaactggctcaagaacctggcggggtcgggcatcagcatgggtaacgccgccaacatccccggcaaatgcggcgtctccgtctctttccccatcaacaccaaaaccaactgcaacaaccttcactaagttatctaccaagcatcatcatcacacaagctagctagcccatcggtgtcnactgttgctgctctctgggtgtgttcgttggtgttttctcatgtgttcanctccatctg

SEQ ID NO: 96027 - DNA, 490 bp, Triticum aestivum
  unsure (1)..(490): unsure at all n locations
  Clone ID: PAT_TA_96027
gcccccctccgccgccccccgccccgcctcccacccatggcgcccagcggcaagcccagcccctccgccgccgccgccgccgccgcctcctccacggcggaccgcaagccgtggcggcggccgcagatgaagtcgaaggcggcggggaagaagaaggcggcgcangcggcgcacaacaagaagcccaagtcgggcgggttcgagtccatggggctctgcgaggaggtctaccgcggggtgcgccanangggctaccgcgtgcccacgcccatccagcgcaaggcgatgccgctcatcctcgcgggcctcgacgtcnccgccatggcccgcacnggctccggcaagaccgctgccttcctcgtgcccatgctccagcgcctccgccacngcnaccccggngncggcatccgcgccctnatcctctcncccanncgcgacctcacacgcatacttcanttcaccaacantcngaantctccgatttaaaatt

SEQ ID NO: 96028 - DNA, 495 bp, Triticum aestivum
  unsure (1)..(495): unsure at all n locations
  Clone ID: PAT_TA_96028
tccgatcccgcaccgccgcccacgcatctcgagtagtttccagctcgccggagaagcagcaagcaagatggccggaaggaagggcggagacaggaagaaggcggtgacccgctccgtcaaggccgggcttcagttccccgtcggccgcatcgggcgctacctcaagaagggccgctacgcgcagcgcttcggtccggcgcccccgtctactcgccgccttcttcgattactccgccgcttaagttttggagctttgccgggaangccggccaaggacaacaagaaacccgcattattccgngccaattgttgttcgccntccgcaacgacaagagtncggaagttgtccccngggtttacatttcccanagngggttnttcccaanataatcctgttggtcncccaaaattccccnccccccccaaaaaggggaatttcccaanaaaattttcaccaattncccaanaaaaaacnccccccaaggnttncccccn

SEQ ID NO: 96029 - DNA, 486 bp, Triticum aestivum
  unsure (1)..(486): unsure at all n locations
  Clone ID: PAT_TA_96029
gcccacaaaaccctagccgtcgcctcacagctcgccgccgacgcagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtacgcgtgacgccgatgcgcacggagatcatcatcagggccacgccggacgcaagaacgtgcttgggtgagaaagggcgcaggttnaagggagtcactccgttcgtccagaangttcaattcccggagaacgcgtttgacttttacccgagaagtctcaaccgtggctctgcgccatcgcccaagctgancatcccgctacaantcctccgtgggcttgccctccgcaaggatgtaggtgttcttccctttgttatggaaatggngctaaggtngtgaggcatttttaancgcaaactn

SEQ ID NO: 96030 - DNA, 490 bp, Triticum aestivum
  unsure (1)..(490): unsure at all n locations
  Clone ID: PAT_TA_96030
gggaaacctccgatctaagcgaagccaaggctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatnaagcagcgtctcatcttcgctgggcaagcagtcgaggatggccgcacgctgggctgactacaacatccaagaaggatccacactccaccttgtgctcaangtccgtttgtggcatgcaattttccntcaaagaccctgactgggaaagacatcaccctcgaggttnaatcctccggacacaatcgacaactcaaagctaanatccaaggacaaggaggattcccccggacaacacnctcanctttgctgggaacactccaggatggccgcacctcnctgactanaaatccanaaggatccacctcaactggtcttaaggt

SEQ ID NO: 96031 - DNA, 482 bp, Triticum aestivum
  unsure (1)..(482): unsure at all n locations
  Clone ID: PAT_TA_96031
ccttccccttcctactctctcctactccttccccttcctactccactgacgcggccttcttcttgtcttcctctccccttccccatcccgccgccgccgccttcctccgccgcgcgaggctggttcagctactaaccgcgnncggggggaaggagaaaaggccgcctcttgtccggccacctttcggctgggttcaagcccacgcgggagccggattgagagatggagtccggccgccggcgacgggtgggcagcatgcgancgttgcttgccatcctccaatnggtggggttcaacgtcaccgtcatcatcatcaaaanggttctccaagaagtggattcaattccccctgacgttcctgcgtccattcaaatgtcctcgatagggttactcgcattcaacgtgctcaaagggaaccgctattaagtcaacccgaggacgctggaaagntnttcccatgtatctttcngaaganatntgcn

SEQ ID NO: 96032 - DNA, 487 bp, Triticum aestivum
  unsure (1)..(487): unsure at all n locations
  Clone ID: PAT_TA_96032
gcgccactcgcaccacagtcatccactcacaagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgttgcctgcagtacgtgcagcagggccggttccgccggcccggggcttgctgcaccggcatccagaaccttgctgggcggaggcaacaacagcccgaccgccgcaccatctgcggctgcctcaaagaacttcgccaacggcgcctccggcggccctaaataaccgggcgcggggtcccctccaatngcaantcnccttcccctaaaaattaacccaaagntcaatggaatctttcanntgaacaaatgancccttggcgttntcaantantctcnttcaagatccaattccn

SEQ ID NO: 96033 - DNA, 511 bp, Triticum aestivum
  unsure (1)..(511): unsure at all n locations
  Clone ID: PAT_TA_96033
ctcacccctccttcttcacctccggccgccgccatggccaggccgacgtggtggtgcgcctccgcgccatccatcaccagcaccaccgcaccccagcgcgccaccaacacctccaccatcaccctgcgcctccatccaccaccatccacagcgccgcctcatcacctcgcgccgccgcccatccatatccctgctgctgctcaacctttcttcttctcctaaccttcttcccgcatccccgctgcccttcttctttcctgaacctgctgctgctacctcctcttctttcttctccttcacctcgctgctcctttaccacgctgctgctcttccctctcatctctgctgctgtccttccttgcgctccctgctgctgcttttcctccctccgctgcttgttgttctcctttatcctttngctgctctcttctctcaagcgtccctggcgtcccaattgctgaactctctcgaactctccctngtcccnacgctacgnatcctctngcgctct

SEQ ID NO: 96034 - DNA, 464 bp, Triticum aestivum
  unsure (1)..(464): unsure at all n locations
  Clone ID: PAT_TA_96034
cagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggangcgcgcgtcaccatgcgcaagaccgcggccaaggncaagccggtgtcgtcgggcancccgtggtacggntccgaccgcntgctctacctcggcccgctatccggcgaccccccgagctacctcaccggtgagttccccggcgactacggatgggacaccgcggggctctcggccgaccccgagaccttnccaagaaccggganctggaggtgatcactgcccgtgggcatnctgggcgcgctcggntgcgtcttcccggagctgctcncccgcaaaggcgtcnaattcngcgaggcgtgtngtcaaggcggtcca

SEQ ID NO: 96035 - DNA, 402 bp, Triticum aestivum
  unsure (1)..(402): unsure at all n locations
  Clone ID: PAT_TA_96035
agcttctcctcctcctcctccccccgccccgaaatccgcacccatattccgaaatcgagaggtcaaaatctccgccgggaacgaaattccccgattgtttgtctcgtacgcgcctggaacggattccgggcctgggagcttccgctggggagattcgattccggagccggaggggatgtcaagggccctccgaccgattaaccaaggcatctttttgaaggatttacacataatggatggaaaagaaagagagcagnttcggatgccagacaactcaagnaaggagagaaagnaagactaaatacctcccttcaaagaaaaagnaattttacgcaagggaacaattccnaacattcccctaaaggaggangaagcaaaaagaagaatgacatcagatttcca

SEQ ID NO: 96036 - DNA, 437 bp, Triticum aestivum
  unsure (1)..(437): unsure at all n locations
  Clone ID: PAT_TA_96036
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtccgacgtctgcgacgacgcccaccccaagtgtccccaagggctgctcggcgtgccgcgtggtgtccgacgaccccgaaatgtggcgctgcgcggatatgaaaccaccgttcgacggacctgcggtgggaccctgcaagaanactgatncggttaatgccggcatatatnttccgcctaaaataaataaantcaagggaaattacaacncacctncctagctttnttttgtggcaacatgttatacatagtc

SEQ ID NO: 96037 - DNA, 503 bp, Triticum aestivum
  unsure (1)..(503): unsure at all n locations
  Clone ID: PAT_TA_96037
gagggcacactctccagcaccagcaggccggcggcaagcagcgcaagcacaacaaccaaatggccaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgacccctgccgccgccgtccgcggggctggcgctccctactcgccgccggcggcgcggtgaccgcgttccgcggggccggcgctggcgctgggtccacgagcggatgttcgacgggagggcaccgggctnagcctgggggctnagcaacaactgctgggttgggtttctcctgggcgtcttccggctcatctggtcgctctacaccgtctacactcccggctccaacgaagacgaagatcccggggctctcgctctaaactacaatatttcctcctctctcaatttnnccgctcncgaacatnc

SEQ ID NO: 96038 - DNA, 300 bp, Triticum aestivum
  unsure (1)..(300): unsure at all n locations
  Clone ID: PAT_TA_96038
tgctcccaccaccccgcccccggctcccccgacgcagcctccgcccgctcccaccaccccgccgccgtcgcccccggncaccccgcctccagcgcccgccaccccgccgccatcaccgcccatgtcgccaccacncgccacacctcctccgatggcnaccccgncggctatngcncccatnacctcccnnaccgtcgncccgactanatcnctcaccgcnacgccctcnatgtctnccgaccagtcctatgactatctcttntttnttctcacngacttcgtctctcacgcttgtagcac

SEQ ID NO: 96039 - DNA, 496 bp, Triticum aestivum
  unsure (1)..(496): unsure at all n locations
  Clone ID: PAT_TA_96039
tcaagctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcttctgcaacngggtnaggacccctgaannccaaggggtccaaccccgggcgaccggnaagnggggtncaactgcctcaanaactgtgcggggtccggatcaaatnggttaccccccaaatcccccgggaaatgcggtcncctnttctttcccantaaacaccaaaacnactgnaaaaacttcactaantntctnccacanatcatcacacaaggtttctnnccacccgntncanggtgccnccccnggngtttcntgttgttcccnagtttcaccc

SEQ ID NO: 96040 - DNA, 512 bp, Triticum aestivum
  unsure (1)..(512): unsure at all n locations
  Clone ID: PAT_TA_96040
ctggttcacgatgaagggcgccggggtgatcgtgctggagccgcacggcgggttcatgtgcggcgtgcccgaggacgccaccccgtacccgcaccggcgcggggtgctgtacgtgatccagtacatcgcgtactggatgagcgccgacggcgggccggcggcgacgagctggctggacgggttctacgggttcatggcgcaccacgtgacgaagcacccgagggaggcgtacgtcaactttccgggaccttggacatccgggcaagaacgcgctggaggacgacttcggcgccgcccgagaacccannttcttggggccagcgctactttcctcaacaactacganaactccccaaggtgaagcgccgtttattccaacaactacttncaaggaacgacaaacatcccgcccatggcaaacaaccacgccaatnaacaaanaagttncacgccaaggcaaggatcatccgtttaacaaataacatcatggccgacnatgttactggtgggta

SEQ ID NO: 96041 - DNA, 393 bp, Triticum aestivum
  unsure (1)..(393): unsure at all n locations
  Clone ID: PAT_TA_96041
ctggttnaanattaaagggccccggggtattcttctnggaccncaacgggggttcaangttcngggttcccnaagacgccaacccgttcccgcancggcgcngggtgctgtacgtgatccantacatcncgtactggatnaacnccnaccgcgggccngcggggaacaanctggctggacgggttctaanggttcaatngggcaccacgttncgaaacaccccagggaagggttactnaaaattccnggacctnggaantccggnaaaaaacccttggggaaaaattttgggccccccnaaaaaccaattttttngggcaaanttatttcttcaaaaattttcaaaaatccccccaaggnnaagggnccntttttttcccanaaatttttggg

SEQ ID NO: 96042 - DNA, 406 bp, Triticum aestivum
  unsure (1)..(406): unsure at all n locations
  Clone ID: PAT_TA_96042
acgtgatgatcttatccccgctaccttgcccagctgagctatctttatccaaacccaacccattccgtccttcacatcatcgtcatcatcaccagcactgactcccgatccacccgatatttccggctcgtgccatccgaaaccaccgagctcccgctataaaacacgcgcccatctccatcctcaacctccattccattcgccgttcccgttctcctctccccctgtcgcctccatagcancagcagttccagntcgagcaagaaagaantaantttgatctgtgaaaatgttggccatcttccanaancacgtggngcacgcgccgcangagctcaacancccgcgcggnagaaacgccatgccaagtaacccggactngatctcngcaantnaatgggccanc

SEQ ID NO: 96043 - DNA, 424 bp, Triticum aestivum
  Clone ID: PAT_TA_96043
gaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacgttcgacctgctggaggcgccaagaagttctctgctgcatactcgaactgcgcgaagaagccatcctgatatcgtttttggatccccttctcgtagtttaggatttttatgcaattttaatctgactcctttctcc

SEQ ID NO: 96044 - DNA, 525 bp, Triticum aestivum
  unsure (1)..(525): unsure at all n locations
  Clone ID: PAT_TA_96044
ccggcctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcataacccaacggaggctgagctccaggacatgatcaatgaagtcgacgctgatggcaatggcaccattgacttcccagagttcctcaacctgatggcccgcaagatgaaggacaccgactcagaggaggagctcaaggaggcttcagggtgttcgacaaggacaaaaaggnttatctctgctgctgaactccgcaantcatgacnaactccgggaaaanntaacgacaaggngntggccanatgttcgtnaagccgngtcgacgtgatggcanattactatgagga

SEQ ID NO: 96045 - DNA, 207 bp, Triticum aestivum
  unsure (1)..(207): unsure at all n locations
  Clone ID: PAT_TA_96045
gcaccatgcgcttcctcgccgccgccgccgccgccgcgctcaaaccctaaaccctccaccgaaaccaatggcgtccctcctctgntcccccgcctcaaaatcgctctccgtcaccacctccacantcttcttctcctcgctcgcgtcgctcacccccgccctcccgtcatccccaccggcgtcgccatagccgccaccatcgtgggg

SEQ ID NO: 96046 - DNA, 257 bp, Triticum aestivum
  unsure (1)..(257): unsure at all n locations
  Clone ID: PAT_TA_96046
aagaagttcgagaccctgtcctacctgccaccgctcancacggaggcctcctcaagcangtcgacgacctgatccgggtccaaatgggtgccttgcctcnagttcancaangttggggntcancctccntgnagcanaangcatcccctgggtactacaatngccggtactgganaatgtggnanctgccnatgttcnggtgnaccgacgccacacaggngatnaacnangtggaagaggncaanaaggaggtaccc

SEQ ID NO: 96047 - DNA, 547 bp, Triticum aestivum
  unsure (1)..(547): unsure at all n locations
  Clone ID: PAT_TA_96047
ctaccgtgttaattttatggccactcccgaatcacaggatgagaacacacttttctttgctgaattctgggtttcatatcctcagccgccaaaaccaaatttctgctgccctttgcaacagccatatagtggacgttgctactttggcgaggcttctgcaaggaagattgtttatccgtgttccacagagtactttatgtctgacattactgcatatggaacaaaggacgcagaagacatactagacaccaattttgtctattttgactctcggagggacctgaagtttgcaaccgatgtgaacagctactatgcaccagggttccctgtgctatccgangccgattgtcttggccactgacgaggagctaaagatgttgggcccataactcagtgagtttcaacagccagagttgaataagactattgcatgcttgtcagatttatgtcagacaaacaagtcagaaaaagcttgtcaggataccttgcgttagtacatgctgaatccttgtaggagtctgcatttattaatgacnaagcactgacn

SEQ ID NO: 96048 - DNA, 551 bp, Triticum aestivum
  unsure (1)..(551): unsure at all n locations
  Clone ID: PAT_TA_96048
aaacgcaccccgccacaagcaggcgtcaagacctgcctgcagatcttctctatcagagtcgtggaaatcaacggtgcttatcttgagtggccactggaggtctacggcctggtcgccacccgtgactcgatggatcataatcgtaacattatcttcagactcaggagggacgcctgccaactcctcactcaacaggatccatttttggcgctgaccggcccggctcatgcgattatcttcaccgggccagtcgacattgagatccaactcaaagtcaagggcagaaccacagagcatgaagacaaagatttcatctccaaagtgctggtatacgaacgtgatcccaagtgacaaacttgccgacgcaggcataggcaaccaagacatcatgcgtaccagctgtttcggcgagttgtgctccctacagattactccgccctgatcgccgaagcggtggaggcacatcatctctgctgaagttatcganggactatggncccaaagtcaggaatccgttcgttccggtacgcagatagacaggacttgtacgg

SEQ ID NO: 96049 - DNA, 538 bp, Triticum aestivum
  unsure (1)..(538): unsure at all n locations
  Clone ID: PAT_TA_96049
aagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcantgcgtcagcttcatcgccttcaagccancgggctgcgaagagtccggcaagggctaaacagctcactcaacacgggccacatataaagtgccaatgcggtttttcaaatctgacattgcnttgggtttccctctccaattancttcttgtttgtcccaaaaatagtgtatgtccatgttatgttcaacatgtccnanaaagatgtcctttgtgaatcanaaaaagggggggccgg

SEQ ID NO: 96050 - DNA, 417 bp, Triticum aestivum
  unsure (1)..(417): unsure at all n locations
  Clone ID: PAT_TA_96050
ggcaagaccatcaccctggaggttgagtcctcggacaccatcgacaacgtcaaggctaagatccaggacaaggagggcatccctccggaccagcagcgcttgatctttgctggcaagcagctcgaggatggccgcaccctggcagactacaacatccagaaggagtccacccttcacctggtgctcaggctccgtggtggcatgcagatatttgtgaagaccctcaccggcaagaccatcaccctcgaggttgagtcctcggacancattgataatgtnaangncaagatncaagacaaagnnggtatcccancggaccaacaacgtctcaacctcnctggcaaacancttgaggatgggcgcaaccttgcagactacaacatccagaangagtccaaccttcanttggtgctcaag

SEQ ID NO: 96051 - DNA, 518 bp, Triticum aestivum
  unsure (1)..(518): unsure at all n locations
  Clone ID: PAT_TA_96051
tgaagacactgcagaaaaagaagccaaagccttcaaaaggaaaacatgatgctcaaggagaggaagcctttgttattgtagaagcatccaagttcaagagggttggaagtaagaccacattgcggcaggatttggccaatgcccttgatataanggccttcnagaggacaacaaagcttggccactgtgatgctgagcttctgaggaaagagatgaatgagactgatgtccccgtatcctactcangcactggnatcccaaagaantccatnaggnaagcanctcctgaggntantcctcccaagntcctanccttcctcaagccaaatancttccaagggggtgtcaaagnnatgnaccaaaagaaatctccccgnccctnaagcntccnggtctngccccttgatcnttggaaggtccttgcaataatgngccaancggtctngncccgttgntangggcaaacgtgtctcctccntnaatctttgggtccncnaacnaagngggaagggcantta

SEQ ID NO: 96052 - DNA, 321 bp, Triticum aestivum
  Clone ID: PAT_TA_96052
acatcatttgtccatttttcgacatgatggttcagtgcaattctaaaacagacacggcacatacaatgccaatagtatgggacggcgttgctacaccatgatactttgaattccgctccaaacaaatccctgcaggccagctggcattttgacaaaacgcactcacggccgtaagcagcagctagatccttgcatgtttttctttgcgggtgaactagatccttgcttttatcaatatgaatggaatttcctaggtgcacaagcaccataaggcaaagaagaatagctttcccttccataagagaagacacaaaggggggg

SEQ ID NO: 96053 - DNA, 560 bp, Triticum aestivum
  unsure (1)..(560): unsure at all n locations
  Clone ID: PAT_TA_96053
ctgtttttcgcgggcccgttgagtcggacaccttcgacaccctcatttcccaggcactgttcggcgacggagcgggcgcggccattgtggcggctgaccccgacgcccgggagcgccccctgttcaacatggttgcggcctcgcaggccgtgataccggacaccgagcacgtacccaggatgcatctcgggagtggaggcatcgactggaacatttcgaacggactaccaaggctggcggcaggcatcattgagcgttgcttgctggatgcactgggcgaccagcttaccaccgtccgtcggaggtgtcgtcgactggaatgatctcttctgggcggtgcacccgggcagcggcgggatgctgggagcgcatccgcaagcactccggctggccccggagaactgggcggtagcagaactgtggncaagagagtacggaacatgttgggcgcaacgtgatcttcgtgctcnatgagncaagggccnnaagaataanccgaaagtgctggactggactggctaatgaagatgggggtgatgatggatcggacaaggtcactg

SEQ ID NO: 96054 - DNA, 577 bp, Triticum aestivum
  unsure (1)..(577): unsure at all n locations
  Clone ID: PAT_TA_96054
ccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcatttatctctcacatgaagcgctacatcaagaacctctctgccaagcttgaaggggatgacctaaatgttttcaagaagaatgttgagtctgccacaaagtatcttcttaacaagctcaaggacttcattcnttgttggcgagacatgcatgatgatggcggctgtgttcgcctactacaaggaggagctgctgatcaattcctgtacttgcaatgggctgaaagaggcaagtgcnatccacgt

SEQ ID NO: 96055 - DNA, 578 bp, Triticum aestivum
  unsure (1)..(578): unsure at all n locations
  Clone ID: PAT_TA_96055
tgcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagcgctgctgctgctgccccaaagaaggcggtggcaaggaggtggaggaggaagatgaggaggagtccgacaagtccaagtcggagatcaatgacgacgacgatgatgaggtancgatgaaggacgaggacgacgacnantgaagaagaccatcttgtcaaggctgctggctccggcgganaaaggcgggaacggtnctcccnanaacgacntaactgttncggtggttcanaaggaccttccatcncantagattnccaatttactcanatcggatgttgtttacttttttctgngnctc

SEQ ID NO: 96056 - DNA, 564 bp, Triticum aestivum
  unsure (1)..(564): unsure at all n locations
  Clone ID: PAT_TA_96056
cccacgcagcaagccctccactcccgatggcccgcacgaagcagacggcgaggaagtccaccggcggcaaggcgccgcgcaagcagctggccaccaaggcggctcgcaagtccgccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgaganggcctagtatgcttcctaaaatctagtgtctgatctgttctcaagtgtagaatgtgttagttcttataagccgtgtcgtgtataaggtcctgatggtngcttatggtgtgtgtagtgatggnacatctggtatn

SEQ ID NO: 96057 - DNA, 243 bp, Triticum aestivum
  unsure (1)..(243): unsure at all n locations
  Clone ID: PAT_TA_96057
gtnccgttggtgttcncatcaggatcattnngcccggaanaccacacnaccngacgtcgatnntgtnaccccnaacagaaccncaacaggcttcnacaacnacacataacntctactcnactcaccaccatcgcnggtagttcctcttctatggaaggagatcttacggctgtgagcacacgatctgtggggcaatcaaactnacgatcatgacaacggtacatcaatctancncnctggcac

SEQ ID NO: 96058 - DNA, 570 bp, Triticum aestivum
  unsure (1)..(570): unsure at all n locations
  Clone ID: PAT_TA_96058
gagccgccgagccgggaagagccaccaccccatcttcctcgcctccgcttccgaagggtcagagatggcggaccgtgctaaccacccgtctgtcatgcagaagtttggtggacagttccaccttgcctccagcttctctgagggtgttcgtgctcgcaacatctgcccttctgtgccatcctatgagaggcgcttcaccacaagctgctacatgactcaagaaccttgggcatcagtgtccccatgatgtcatcttctccattgtttgccaatgcaccacctggagaagaaaggtgtcaaagaactttgcaattgacttcctcatgggaggagtgtccgctgcatttcccaagactgctgcagtcctattgagcgtgttaagctgcttatccaagaaccaggatgagatgatcaaaggctggcagctctctgagccatacaagggtattggtgactgctttgggcgcacatcaaggatgaagtttgggtcattgtggagaagaacacgctaactcatccgttactccaactaagcttgaacttgcatcaaggatactnaagangattcac

SEQ ID NO: 96059 - DNA, 554 bp, Triticum aestivum
  unsure (1)..(554): unsure at all n locations
  Clone ID: PAT_TA_96059
ataatatctccctctcccgtcccctctctccccaccactcgccgtcgccgccgcccaatctccggcgagatcccctcccccgccggcagccatggcctccaccttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcccactctcctccggctcgcctgcggctcgcgggcctcgccgccggcatggcatcggatcgtcggcgacccgggtcanggcaacgcacagagccaagctgttcgtcggatgatctatcctcatcttgctgaagcctggcctgtacggctcatcgtcggatatcctctctcgcgtgcnggaatc

SEQ ID NO: 96060 - DNA, 555 bp, Triticum aestivum
  unsure (1)..(555): unsure at all n locations
  Clone ID: PAT_TA_96060
ctccactcgttccccactccgtcgcctgctcctccccattatatccctccttcgtcgcccacgacgacggcagagagagcgtcgctggacgccggccgagatcctgggggtcaggttcatgggcgtccccatctcgaagccgaaggggcgttcgtgcatgggcacatcgtcgcggggttgacggtgggcggggtcgccgacttccccgcgcgtccaacgacggcctgggatccaccggaggccggcgccagttcatgggcatccccatcttaaagccggaggagccgttcgtgcgtggacacatcgtcacgggatcgacggtgggcggggtcgccggcttcccgcgcgtcaaccgccggctnttggattcaacggaaggccgcgcanngtcttggatcatggcgggattaccgaagggggaaggcacagccggcttcgaaggcttgggaagacgcatcctaccggcctctaaaggaatttgggtacttggnctgatgatganctatggctatcgcaancctagattatggaagnnaagaaaactatgtcaaaaca

SEQ ID NO: 96061 - DNA, 564 bp, Triticum aestivum
  unsure (1)..(564): unsure at all n locations
  Clone ID: PAT_TA_96061
ccagacgccgcagcgccgccactccacccgcagcggcaaccatggcggtcggcaagaacaagcgcatctccaaggggaggaagggtagcaaaaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcanaacgatgaggaccaggcctacaggaagatcagactccgtgctgaggatgtgcaagggatgaatgtcctcacaaacttctggggcatggacttcaccactgacaagctcangtctcttgtgaggaagtggcagacactcattgaggctcatgtggatgtgaagacactgacaactacatgctccgcatgttcacattggcttcacaaanagacnccaaacangtgaagccactgctatccaaacaatcagttagcaatcgcccaagatgttgagatatggcaacaagctnaagcttnacttg

SEQ ID NO: 96062 - DNA, 556 bp, Triticum aestivum
  unsure (1)..(556): unsure at all n locations
  Clone ID: PAT_TA_96062
cctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccangaggccggccggcanaggcgagcacgaggatgaggaggacaagcaagcaagcaccatcaccaccagttcaccaccaaccagcgtatcatcancagccgccgcatgcgctcgcgggcgcgcgcgctgaataaaataaaacaccgttcgtgttccgtagtctgtatccctgtcgctgtgttcgacaatatgtcctcctcgtgctcacttcaatgaatatatgngctcacttga

SEQ ID NO: 96063 - DNA, 550 bp, Triticum aestivum
  unsure (1)..(550): unsure at all n locations
  Clone ID: PAT_TA_96063
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaaagaagtactgatcggttcatgccgggcatgatatgttccgcctaaaataaaataaaagctcaggcgagatgagcagcgtcatcgtgcctatgcgtgtgtgtgtggncaacaatgcttatacagtatgtcgtctcttcgtcgctgtgttttctctctcgagaaaagttggtgttgcttgttgttanctatccggatatctcgtgataaacacttaatgattgtctggctg

SEQ ID NO: 96064 - DNA, 551 bp, Triticum aestivum
  unsure (1)..(551): unsure at all n locations
  Clone ID: PAT_TA_96064
gcagctaccacaaagacaagtcaacctcaccgaggagaaggaaggagaagggagaagatgtcgggccgcggcaagggaggcaagggactcggcaagggcggcgccaagcgccaccggaaggtgctccgcgacaacatccagggcatcaccaagccggcgatccgtcgtctggcgcggcggggcggcgtgaagcgcatctcgggtctcatctacgaggagacccgcggcgtgctcaagatcttcctcgagaacgtcatccgtgacgccgtcacctacaccgagcacgcccgccgcaagaccgtcaccgccatggacgtcgtctacgcgctcaagcgccagggacgcaccctctacggattcggaggctaggccgccaccaagattagctagcctgtgtctagggttcgtgtcttgatgtntcncaacatctcgctgctgtttgctatcntctgtagaatgggantgaatggaaantcaactatttatcctngnaaanaaaaanaaaaatccaggggggccggtaccaatnccctatatgagtctataccncc

SEQ ID NO: 96065 - DNA, 546 bp, Triticum aestivum
  unsure (1)..(546): unsure at all n locations
  Clone ID: PAT_TA_96065
cctcactcctcacagtcgcagcatcctctcagtcctcaccttcctcccctcgccaccacccaccaaggaaaggaggatgtcttgctgcggcggcaactgcggatgcggcgccggctgcaagtgcggcaacggctgcggcgggtgcaagatgttccccgacgttgaggccaccgccggcgccgccgccatggtcatgcccaccgcctcccacaaggggagctccggcgggttcgagacggccggcggggagaccggcggctgcgactgcaccacctgcaagtgcggcacggcctgcggctgctcctgctgcagctgcaactgagccggcgcccaggaggccggncggcgangcgagcacgangatgaggaggacaactggacaagcaaccancancaccaccaacancatcactanccgctgcatgcgcccgcccgcgcgcgcgctgataaaataaaacgtctgtgttctaatcngttcctgtacgccgtgtttcaacagcatgtccttgtcaagctcaactctaannaatgggctcctcnaaaaaa

SEQ ID NO: 96066 - DNA, 275 bp, Triticum aestivum
  Clone ID: PAT_TA_96066
gcgagagcttgtcacccaagcgggggctttgaggtggtgttggacggtgttgtggtgctgtgggcctggtccagttgtgctgttgttggcccgcccgttccaagttgagtagtcgtccggcggggcttatgcgaaagctgggcttcacgggccatgatgtggcaggcacggcgtgaggctggcctaacggtggaaggataacgggccgcttgggcctcacagcctactactccagcgaaccaccattttaaataagaaagaagaaaaaaaaaaaa

SEQ ID NO: 96067 - DNA, 530 bp, Triticum aestivum
  unsure (1)..(530): unsure at all n locations
  Clone ID: PAT_TA_96067
gcaaccgccgccgacaccacacctcgtgagtcctcgtcgccggagaagcagcaagcaagatggccggaaggaagggtggcgacaggaagaaggccgtgacccggtccgtcaaggccgggctccagttccccgtcggccgcatcgggcgctacctcaagaagggccgttacgcgcagcgagtcggctccgggcgcccccgtctacctcgccgccgtcctcgagtacctcgccgccgaggtcctggagctcgcaggcaacgcggccaaggacaacaagaagacccgcatcatcccccggccacctgctgctcgccgtccgcaacgaccaaggagtcggcaggtgctcgccggcgtcaccatcgcgcacgcggcgttatccccaacatcaatccgtgctgtccccaaagaancccccngccgccgccgaagaaggaggcaattcgccaagaagaaactccacaancccccaagaagaaaccgccgcacaaggantaccncccatacctaccatgttcctattattgntnttgn

SEQ ID NO: 96068 - DNA, 519 bp, Triticum aestivum
  unsure (1)..(519): unsure at all n locations
  Clone ID: PAT_TA_96068
ggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgatccatctacggcgagaattcgccgacgagaattccgtccacaagcacaccaacccgggatcctctccatggcaacgccgggccaacacaacggtccattcttcaatctgcacgntccctgcaattggtcnacggaacactngcttccgcnagtctccangnatggactctcaagacaccagaagtggtcccgnacggactgn

SEQ ID NO: 96069 - DNA, 522 bp, Triticum aestivum
  unsure (1)..(522): unsure at all n locations
  Clone ID: PAT_TA_96069
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccgggcggcgatccatctacggcgagaattcgccgacgagaattcgtccacaagcacaccaacccgggatctctccatgggcaacgcgggcccaacacnaacgtcccattctcatctgnacgtcccctgcattggtccacgnaanactggtcttcggnaagcctccaaggatggctctcaagacaccagaaggngggtccncaacgga

SEQ ID NO: 96070 - DNA, 352 bp, Triticum aestivum
  unsure (1)..(352): unsure at all n locations
  Clone ID: PAT_TA_96070
atgcncanagcatccttgccatctgggcctgccaggtggtgctgatgggcgccgtggagggctaccgcgtggncggnggcccgctgggcganatcgtggacccgctctaccccggcggcagcttcgaccccctgggcctcgccgaggaccccgaggccttcgnggagctcaaggtgaagganatcaagaacggccgcctcgccatgttctccatgttcggcttcttcgnccaggccatcgtcaccggcacgggccccctcgagaanctcgccgaccaccttgncgactccgtcaacaacancgcntgngccttcgcancaacttcgtnccgcngnaatgtnagtgcagtcag

SEQ ID NO: 96071 - DNA, 542 bp, Triticum aestivum
  unsure (1)..(542): unsure at all n locations
  Clone ID: PAT_TA_96071
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttcccgtgagcacaacgcatctcctgggtactacgatgggccggtattgggacaatgtggaactgcctatgttcgggtgcactgacgccacacangtgatcaacgangtggaggagtcaagaaggatacctgacccgtatgtccgcatancnggntcgacaacatgctcaagggaatgcgtcaacttaacgcttcaagcaacgggtgcaagatccggcaaggctaaaagtcatcacnaangcn

SEQ ID NO: 96072 - DNA, 546 bp, Triticum aestivum
  unsure (1)..(546): unsure at all n locations
  Clone ID: PAT_TA_96072
gccgcgcccggtgcctccctgcagctgcaacctcgagccagcctgcgccgtcgatgtggcctaccacgctcaacgattcctgtgcgcacaaangcagtaaaaggggagataccagtaacttctgctaaaacatgcaaacgcgtgtgaattctgagctttcaattgctatgccaggcccaggcgtctggttcggaagctcgggagcatgaggtgcacaaggccgccggtcccctctgataaggcgctcagagtcatcttgtgcctgcagttcctggaggtcagtgctttctacggggtctacctgaacttgatagtgtatcttcaggatgttctccatggagacagcgcatccaatgtgacggccgtgaattcctgggctggggtcaagctacctcatgccccttctcggcgccgccgtcncggactcctactggngaaaatgcaagacngttttgatcggcctctgcattctgtcgtcngaatggcatggcacatgtcagtacctgccgtccgncgctgcngcgtcncccggnggttcgngcacgg

SEQ ID NO: 96073 - DNA, 183 bp, Triticum aestivum
  Clone ID: PAT_TA_96073
gtcacgacagcatgctgtttttggaatgacgcaaagttttctggttgaatgtacacgtgattgttatttgctggtagtttctgccgttggttactaaaaaataaaccagaaatagttgtcctgcgaaacaattttatgaaaccattcgttggcataaaaaaaagcaaccgcaaaaaaaaaaaa

SEQ ID NO: 96074 - DNA, 522 bp, Triticum aestivum
  unsure (1)..(522): unsure at all n locations
  Clone ID: PAT_TA_96074
ctcangccancggcactcacactacactcatccactcacaagctaatctancggcgtanctcacttcagtccantcggcatggnggntccgangggcncggaactggtgctggcgatggtgctcgcggagatgctggtggcgccgccggcgacggtgcangccatatcctgctccacggtgtacagcacgctgatgccgtgcctgcagtacgtgcagcagggcgggtcgccggcccggggctgctgcaccggcatccanaacctgctggncgaggccaacaacagccccgaccgccgcaccatctgcggctgcctgaagaacgtcnccaacggcgcctccggcgggncctacatcacccgngccgccgcgctcccctccaagtgcaacgtcgccctcccctanaagatcagccccancgtcgactgcaactcgattcactgaangaactgaatcgccctggccgtgtgtcgtcgacgtagtctgccgtgtgangagtccatgtctggagaananatggtgcn

SEQ ID NO: 96075 - DNA, 509 bp, Triticum aestivum
  unsure (1)..(509): unsure at all n locations
  Clone ID: PAT_TA_96075
gcccaacccggattgttgctctctgctataagaaggaagggtagtcggctggaatctccatcatgtcaattttgcacgaaacatccaatgtcttcgccgagttcgttggaggaagaagcatcgagttcgccggaggtacaagaacatccgtcgagcactccaatgtcacctgcagcggctacaccagaggtccttaagatgagtgatgaacatccgtcaagccatccaatgttgcatgtggcggctacaccagaggtatatatccccttgaaagctaatcagttcatagaagcccctatttaagttaattgtttcttaatgggtgcctctgtttcatgttgacaagagcaacaaaaagttagaatttcatggtgatgagtgagcataagatgttatgagaatatgtttgcttgattgtacagatgtagtttccgtatacttgtttttctgatcattcatgtataggcgtcctgttaacaagnanagttcaaggcatattaattntcaac

SEQ ID NO: 96076 - DNA, 518 bp, Triticum aestivum
  Clone ID: PAT_TA_96076
tccgaggggaacaaggcgaggttgccttcctcaagtcgatcttcccaaaggtgctggagactgcggtgattataatggccaacccaagcttcactccattttcagtagccgtggcgttctccgaactgaaggaggcttctgaggtcataaggtgctgccaagtgctgcttcttaagagtgcagggcccgaaggaggcaaagcatggagttttaaagaaggaagtgatttttcatgcgaggaccctttttcaacagtggagagcagcgtattcactccggagcagtcgaattttattggatttgatgaaagtaggaaacaggcatgacatctgcttcaaaatgcctgtgaggagtggaagatttttggatgtgctgaactatgaatcatccatggtatctgcttcttttggtagccgcccctgactttgggtggccttacatcgcaaactttgcgttaaatttgtggtctgattgatatctggtgggaaacagaaatactatgaactggtatttgctgc

SEQ ID NO: 96077 - DNA, 502 bp, Triticum aestivum
  unsure (1)..(502): unsure at all n locations
  Clone ID: PAT_TA_96077
ctccccaatttcntctctcncaatcaatctccccctccgncgccggngcancgtcctccccgcgactccgatggccancaagtgggtcaggcccgaggtgtacccgctgttcgcggngacgggcgtcgccatcggnatctgcgccttcancctcctccgcaacatcaccggcaacccanaagtcagggtcaacaagatgggganggcancgggagtgcttgagaaccatgaggagggcangggctacgccgagcatggnctcanagcctatgtgcangacaagacccccgagatnatgccaggaatcaacaagttcttcaccagcccgaaatgaagcactttagcctgtcantggctcnctattagtaactgttgtggncaagtgcaaactatttcaaagcattcagtaatgttgtcgcgtccaaaaatcagaggntatcatcaagtgcctcctattgaaagaacatgtgatgtttgatggcttgctanaaagtgatgggtg

SEQ ID NO: 96078 - DNA, 334 bp, Triticum aestivum
  unsure (1)..(334): unsure at all n locations
  Clone ID: PAT_TA_96078
gacctgctgcatcggcctggagaacaagctgcacgacctccggcgcgtcgtcgaggactggaggcgctacgtgtcgcgcccggagtgggagcgccgggccggcaagatcgggtggaggttcgagggaggcaagtgcatacattgattgatcgatttgttgattgattgagatcgacgacggggaccgatcgatgcgggaatgctcattgagagagaccgatggtgcatggaagattgcgagcgagcttccggcctgtcgttgctgtgtttcgccattctgttcatatttcaagaaattaactagttacaacacgcacaaaanaaaaaaaaaaaa

SEQ ID NO: 96079 - DNA, 486 bp, Triticum aestivum
  unsure (1)..(486): unsure at all n locations
  Clone ID: PAT_TA_96079
gacaggtcaacctcaccgaggagaagaaaggagaagcgagaaggatgtcggggcgcggcaagggaggcaagggtctgggcaagggcggcgccaagcgccaccggaaggtcctccgcgacaacatccagggtatcaccaagccggcgatccgtcgtctggcgcgtcggggcggcgtgaagcgcatctcggggctcatctacgaagagacccgcggcgtgctcaagatcttcctcgagaacgtcatccgcgacgccgtcacctacaccgagcacgcccgccgcaagaccgtcaccgccatggacgtcgtctacgccctcaagcgccagggacgcacctctacggattcggaggctaagccaccaacgccgccagattagagtgtctaaggtcgtggnctttgatgttatcgcatactcntgttgtttgcnnctcctgtagaatgggattgaatgggaatcgaactattttcctttgaaaaaaaaaaaa

SEQ ID NO: 96080 - DNA, 558 bp, Triticum aestivum
  unsure (1)..(558): unsure at all n locations
  Clone ID: PAT_TA_96080
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgattaacgaagtggaggaagtcaagaaggagtacctggacgcgtatgtcccgcatcatccgattcgacaaatgcgccaagtgcattgctcaactcatcnccttcangcnacgggctgcangatccggcaaggctaann

SEQ ID NO: 96081 - DNA, 512 bp, Triticum aestivum
  unsure (1)..(512): unsure at all n locations
  Clone ID: PAT_TA_96081
gcttgacatcccagtaaacacgctatctctctctctctctgtctccaccatcaagccaggatgaggtcgttgtacaagatgctactactttcgcttgcccttgtagcgctgctatcctcagatctgacgatccaggcgacggctaatggtggcggctcgctaatccctgaagactgccggcagacccttgtcatccgtgggccctgtaaccccaaggcttgtcaacgcaactgtcaaaccaacgtcggccccggtgccgttggcgactgtgatgccggtggatgccggtgcacatactgtactccatctcaagtgggaattaagcagtgattgttgcttaattgctccccgttccgataatatgcaaaacttagtttttccttcctgtctggctacctgtcaaataccctacttgggaaaccaaacaagaatgtcaagaattggttcatccnaggggcggtgccttataacatgttgctgtgattacacactaaaaataaagngtggcctcc

SEQ ID NO: 96082 - DNA, 376 bp, Triticum aestivum
  unsure (1)..(376): unsure at all n locations
  Clone ID: PAT_TA_96082
aagcagcggagctacctacccaccccctcgaggccggagcggagganatggngtcgcnggagccggtgagcccgtcgtcgtcgtcgtcgtcgtcgggggaccgggagcagcagcagcgccacggggcggcggagcggncgtcggagacggcggcnctgcgggcgctggtggagcggntgcgcggcngggaggtggaggcggcncgcgaggtgcggcgcctcacgcgggcctccgcncggcaccgccgcaagctggcgggcgccgtggagcngcncntcgtcatgctccggtcnggnggcggcgccggcgangncgcnctgctggngctgcacaanctcgncgtcanggacgacaggnntaacatcnatnatactgc

SEQ ID NO: 96083 - DNA, 348 bp, Triticum aestivum
  unsure (1)..(348): unsure at all n locations
  Clone ID: PAT_TA_96083
atcnccacccacctttccctgccggnttcntctcaggtagcagcagcanctnganttcttgcgggtctgcgggtgcgaancccagtctcntatcaactcnaccaggnggnggagaagcagggggaagatgtccaaggcggngntgacactggaggaggtgtccaagcacannaccaacgacgactgctggctcatcatcgccggcaangtatatnatgtgaccangtttttggangatcaccctgcaggtgatgangtantgttgtcctcnattgccanggacncaactgangactttgangangtcgggnacagcaccancgnccgtgcgatgctggcgnagtacta

SEQ ID NO: 96084 - DNA, 521 bp, Triticum aestivum
  unsure (1)..(521): unsure at all n locations
  Clone ID: PAT_TA_96084
cagaaacgcgaaattttccccagactcgcgcccaccggccgcctcccgctccttaaaaccaccggatcccctccccgtcttcctcatcctcatcccagcccccaagcagttcccctcctcaacccccgagagtccgccgcgcccacccgccagccccgatggcccgcacgaagcagacggcgaggaagtccaccggcggcaaggcgccgcggaagcagctggcgaccaaggcggcgcgcaagtcggccccggccaccggcggcgtgaagaagccgcaccgcttccgccccggcaccgtcgcgctccgggagatccgcaagtaccaagaagagcaccgagctgctcatccgcaagtgcccttccagcgcctggtgcgggagatcgcgcangactncaagaccgacctccgcttcaagagttcngccgtgtcngcgctccaggaggccgccgaggctactcgtggggtggtcgaggacacaactctgggcatcangccaagcgctcacataanccaangaatg

SEQ ID NO: 96085 - DNA, 528 bp, Triticum aestivum
  unsure (1)..(528): unsure at all n locations
  Clone ID: PAT_TA_96085
ctgcctcctgcgcctccacttccatcgcctccccaagatcgcagatccgctccggtgagaatccgtcgccatgtcttccagcgaggtcgcctgcacccttgccgccctcatcctccacgatgacgggatccccatcacttccgagaagatcgcgacggtggtgaaggctgccggaatcaaggttgaggcctactggcccgcgctcttcgccaagctcctgggagaagaggagcgtcgatgacctcatcctttccgtcggatctgggtggaggtgggtgctccagctgctgctgctgctgccccggctgctgggtgggtgctgctgccgctgaaagaagaagaaggaagaaaagaaagaagaggccaaaggaagagagcgatgatgacatgggttcagcttgttccactaactgttcaattcaattctcctgtggggtctcctaagcgaaaacttgtctaagtgctttaaggcnaatttgaaattaataagttaagcntttgagacaattatcgtgcaatgagtacggn

SEQ ID NO: 96086 - DNA, 398 bp, Triticum aestivum
  unsure (1)..(398): unsure at all n locations
  Clone ID: PAT_TA_96086
gcgactccaagtttccctcggtaggcagcttccatctcatctccggcgatgtctgggcgcggcaagggcggcaaggggctcggcaagggcggcgccaagcgccaccggaaggtgctccgcgacaacatccagggcatcaccaagccggcgatccggaggctggcgaggaggggcggcgtgaagcgcatctcggggctcatctacgaggagacccgcggcgtcctcaagatcttcctcgagaacgtcatccgcgacgccgtcacctacaccgagcacgcccgccgcaagaccgtcaccggccatggacttcgtctacgccctcaagcgccaaggcgcacctctacggtttcngcggttgacgcgtttagtccccggttacctgcttttcctgctngttc

SEQ ID NO: 96087 - DNA, 343 bp, Triticum aestivum
  unsure (1)..(343): unsure at all n locations
  Clone ID: PAT_TA_96087
gagttattaaatgaatgaagtatgagggcttttctgtaaaactagtaactctggataaatggacaaattcgttcgtcaggagaaaaaaaggaaacgggccgaaactgctagcccaccagaaggggaaaaaggcgctggggggtggcctcacattgggcctggcccgaacgtaatggaggccgcaggagggacgctgggcctcgggtgggtcaagaagcagggcgcgcggtcaacgtgcagtgatacaggggggttcggggcgctcgttctcctctacaactgcttccgatgcaagagaacccggcgatgcangtggccacggcagcgaacttggcgtcngctg

SEQ ID NO: 96088 - DNA, 354 bp, Triticum aestivum
  Clone ID: PAT_TA_96088
gggcgggcgtgctgggcgggctggcgctggcgggcggggcgagctacgtggagaacaagatcgaggaccgcgtgacggagcgcgtggaggaggacatgtaccgcggcggtgggtacgacgactacggcggcgacgacgactactagactagccgatgatgattgatgaaggacggtggtttgttcctgttgccgtggccatgaattaatggatccttctatatatgttttcggtgctgccgtacaagtatgctcgggagagttgaaaagaaagatattttcttgtgcgtatcatcaagatgaaactcagattgaatacatgcaggattgttatccccggttgaaaaaaaaaaaa

SEQ ID NO: 96089 - DNA, 563 bp, Triticum aestivum
  unsure (1)..(563): unsure at all n locations
  Clone ID: PAT_TA_96089
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagacctgtcctacttgccaccgctcaacaanggaggccctcctcaaagcaagtcgactacctgatcgctccaagttgggtgccttgcctccaagttcaacaaggttgggttcatcttccgtgagcacaacgcatcccctggggtactatgatggccggtacnggacaatgttgaaactgcctaagttcggtgcaccgacgccaaaaaatgatnaacaaggtggaggagtcaaaaaaggataccctgaccctatgtccgataacnggttcacaanatggccaagtgnatgntcaagctnatcgccttaaacaccnggctgcaaggatccggaanggctaaaangtcaccccgaag

SEQ ID NO: 96090 - DNA, 535 bp, Triticum aestivum
  unsure (1)..(535): unsure at all n locations
  Clone ID: PAT_TA_96090
cctctccctccctctccccctctctctctctcttgcgcgcttgcttgcttcccttctccgtgtgagcgaggccaccagcggaggagggctgtgctgaagaaggctgcgccagcgagagcttggtgactggttggccttttcctacctactggacctgcagtactttgaacatgctttttgcatatcactgcattaaggatgaataaaatgttaagcaccgactgtttagggacgcaggagtttcatacattccacaaaaccactgaaatactgggaagactcgcaatctgaagagattacattccgcgaaacagcgctggggtcaacgctagtagatcatcaaaatggtgactgaacatcatcctggatatctggattaatgtaatatangtatattaagataatacgaaatcggaatccantctactngccgcagtatcaacaagagacactggnatggctgaatcaacttgttgcaatggtgaatctgacaatcaactaccggtttacngcatgtcatcctggtaancatccc

SEQ ID NO: 96091 - DNA, 528 bp, Triticum aestivum
  unsure (1)..(528): unsure at all n locations
  Clone ID: PAT_TA_96091
ccaagagctcgcactcccccaccccaccccagcctctcgtcccgatggcccgcacgaagcagacggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctccgcttccagagctccgccgtctccgcgctgcaggaggcggccgangcctacctcgtcgggctctttgaggacacaactctgcgcatcaagccaagcgcgtcacatcatgccaaggacatcaactcgcccgcggatccgtggcaaaaggctaaaacgctccaacttggtggaggttaagggttactccganccgnttgcttggggaancgggtttggaaaggtcccgttcntcacn

SEQ ID NO: 96092 - DNA, 546 bp, Triticum aestivum
  unsure (1)..(546): unsure at all n locations
  Clone ID: PAT_TA_96092
cccaaacccaacccgccgccgccactgccgtcgccgccgcagcgcgcggaggcgaccaccccaccgccgccaagatgcagatcttcgtgaagaccctgacgggcaagaccatcacgctggaggtggagtcctcggacaccatcgacaacgtgaaggccaagatccaggacaaggaggggatcccgccggaccagcagcgcctcatcttcgccggcaagcagctcgaggacggccgcaccctcgccgactacaacatccagaaggagtccacccttcacctggtgctccgcctccgtggtggcgccaagaagcgcaagaagaagacgtacaccaagcccaagaagcaaaagcacaagcacaagaaggtgaagctcgccgtcctccagttctacaaggtcgacgacgccaccggcaaggtaaccaggctcangaaggagtgcccaacgcggagtgcggtgccgggacctcatggcaacacttcgacggcactactgtggaagtgcggctcactacgtctacaacagaagcttaaagtggttgctttgc

SEQ ID NO: 96093 - DNA, 342 bp, Triticum aestivum
  Clone ID: PAT_TA_96093
tttaatttcgtagctaatagcagtacaataactactgcttataattgcgcagcagtatataatcggagtatagaaatgtatatggaggatggtccaataatccggccaagctcacatgctcagctcatatccgtgccatgggcccatgtggtgatccgagatagctaggactaggagatgacgcatgcgttggggttctcgtcgctgaacatctgcggcggccgctccatcatgtagctgctgccgtagttgtagctgttgtacatcggcatgcccggaggtggcggcggcggtggaggcgcccactgctggtgcatcatggtcatggcgtaagggttgtgg

SEQ ID NO: 96094 - DNA, 521 bp, Triticum aestivum
  unsure (1)..(521): unsure at all n locations
  Clone ID: PAT_TA_96094
ctgccgccgaccacactccttcgactaaatccccgccgcagtacgtactgctggcagccatgggtggcgcaagcgtggccgtgagcttggtctcaggcaagggaggcagcctcgtcttctctcccccgtcggtctcaggcgtggccgctgccctgcccgtcgctggccatggctccaccgcccgtcgccggccgtggttactgaagaaggtctggcgccatggacagccttgtcttcgaccggagacttgccaggttctcctccagcggacggcttccatggatgagctggacgctcgctatcgcggtcacgtgctgctcccgacggntgtgacnccttcggcttttggcggcatgganatattgcgggtctngcctcaaaagtcaanaatcaaagttgcttgtgaatggacaangcatcnnacggaaactnanatctggaatgcggacggccatgtcgccaaggacaaaaaacttgattancctgtttgggtangtcaggaanaangggaggactcaccn

SEQ ID NO: 96095 - DNA, 528 bp, Triticum aestivum
  unsure (1)..(528): unsure at all n locations
  Clone ID: PAT_TA_96095
cgaaaacaccaccacacctctccccgtcgacgcaagaagcagcagcggcatccatggcccccaaggcggagaagaagccggtggcggagaaggccgagaagacgacggcggcgaagaagaccaaggccgagaagcggccgccggcgtccaaggagggcggcgagaagaagggcaagaagaagtccaagaagagcgtggagacttacaagatctacatcttcaaggtgctgaagcaggtgcacccggacatcggcatctcctccaaggccatgtccatcatgaactccttcatcaacgacatcttcgagaagctcgccggcgagtcggccaagctcgccaggtacaacaagaagnccancatcaantncaagggaantcaagacctccgtccgcctcgtcctccccggcgagctcgccaagcacgccgtctctgagggtacaaangccgtcaccaagttacatccgcttagatacctgctcctgtgttttctctgaatgtgttgatttcnctggctgttgatgaatcat

SEQ ID NO: 96096 - DNA, 432 bp, Triticum aestivum
  Clone ID: PAT_TA_96096
gtaaacctgggttccaccaagacccaggacaagaagtcatccaagaccagtaaaaagggcaagagcaaagagacctgactaaactaactagcggtgtcatcctctggtctcgatttagtggggagctaatacaccatgacccagaacctgtaattaccgagcatctgggagaagccctgggttagggtttaggatgatttagggtcgtgacaaagaactgcggtgattggaaacagctagtgtggaacctcttatgttttagctcttgttgattgaccgttcttcttcagcaacgttgttgtacttgtacacattggggcagcgccaaattgcacaagctgctcttgctgcctacaacaaggatccttgtgttttttttatataatatctactgcacatttccattattgtgtatgtttcaaaaaaaaaaaa

SEQ ID NO: 96097 - DNA, 530 bp, Triticum aestivum
  unsure (1)..(530): unsure at all n locations
  Clone ID: PAT_TA_96097
cggcgttagccgggcgagggaggcggcgagcaggtgcgtggcacccatgcggtgctcgtcgtcgagcacctgcctgcctgcctggccggcaagcagctcgctggcgcggtgctgggctgggccggcaggtgggcccggtgctgggcgccaggtaagcttttcccatttctttctgttttctattttttaaatacttctgcaactttgttgaattaaataaaatacttaggcaactccaaaaatcaccaaactattcctgggaccatagttggattatttccaacatgaaacattttaagtttaagagttatttgagcattaaaatattttatataattttaaatgcccaaatcaaatacttaagattaatccaaaaaccctaggatggcctaaggaaatgtgcacactttgggaagaggtcctgaaccaagacaaaaaggaggggattttagaaggcattcaagtcaatgaaaaattttaagtaaacctaatgggttcaagagggacgggggtcntcaacccaatnaagg

SEQ ID NO: 96098 - DNA, 494 bp, Triticum aestivum
  unsure (1)..(494): unsure at all n locations
  Clone ID: PAT_TA_96098
cccacntggtgctccangtgattttgctggtgagaagggtggagctcctgctgagtaccagccacctttcaggggtgctggtggtgctgccaggccctttggccgtggaggcggcggcggcantttcggttctggagctaccatggagtgaagaancgactcttcaccacgtgngancacccancangtcttcagatncaatgcgtgcgtggggtgctgtcctcnctgttgntgtntgaattctgcaaacactgtgacgantttgtttancgggattgtancttaagaccatggattatggnttcgnttgtgtnaaaatgactctttgatattaanacagtgttgatcgactcacantctaaagatggcaacttgctatttaantgtgtttccntccangtaactgactgcnataccccttacgggaccaaattcaattgttggcntgctgttgtcgccatgggaccctnatgatctggcaaggtgncatgacc

SEQ ID NO: 96099 - DNA, 520 bp, Triticum aestivum
  unsure (1)..(520): unsure at all n locations
  Clone ID: PAT_TA_96099
gtccccagctcgtcgctccatagcgccgagcgagcaatggcccccgagcggccgcggcacaagctatgcctcttcctcctcgccgccttggcgtgctcgctgcacgcaggcgccgccgcggcgaacacgtcaacgtccaccctggccatccggcacaagccgccgtcgaagccaaggcacggcagcacgaggcagcaccgaccgggtccgcgagggagccacgccggcagcgggatggcgtcgtgcaacatgttccagggcagctgggtgtacgacgacgcgctgccgatgtacgacgcggcgggnctgccccttcgtggagccggagttcgactgccagaagtacggccgccctgacaagctctacctcaagtaccggtggcgccccgcctcctgcgagctcccgaggttcgacgggcgggacttcctgagcaatggaaggggaagaagtatgttcgtgggggatcatcagcctgaacaatgggaatcgctgtgtgatctgcagccggcgcgccggctc

SEQ ID NO: 96100 - DNA, 550 bp, Triticum aestivum
  unsure (1)..(550): unsure at all n locations
  Clone ID: PAT_TA_96100
gcccaatccagaggaccaggaattctgctttctacaggagtacgaggacatggactcccaggtgctgctgcaacaccaagaagggcaagaggagtatctaaccagttcccagcagcacgtcaacgaaccaccctccaacaagcttgattgttgcagagacttcatcaaaatggaagactgtccacgcctttgctttcgttgcggcatcaacggtcactttgcccgcgagtgctctctcccgccacatgagcccttgccggcaatgcccccccgcacgctggttggccgtgcttcaatgcaacaccgagtccctttcgaaaggcgtccggttgctacaacaagtatcaataaagatctgtttatcatctgccaagctgggctcacaactagtcatctaccatacgggcgtcatggatgagacttcactgttacaaggtgggagatgatggnaacctctccaaactcctgctagttgcacttagtcggtgatgggtgacaattgggactttccttcanagtgcctcaaaatacatgcgttcgaggaaaaaga

SEQ ID NO: 96101 - DNA, 204 bp, Triticum aestivum
  unsure (1)..(204): unsure at all n locations
  Clone ID: PAT_TA_96101
ngagaagcccaaatcttagattgcanttttgatangcaaggatggaatggnctgtaaggctcnggtcgtttggggaggaaagttgcctgctagngtttacaaagtcatatataacctgaagntgnactatcnagatttgttccttcnctgctgntgctttcncttaacaattgctattacgantattgtttccangatctggat

SEQ ID NO: 96102 - DNA, 281 bp, Triticum aestivum
  Clone ID: PAT_TA_96102
ccgggaccaaaggcagcccattatggttcggccctcgtgataccatgccaactttcaactttcaacttttttagagttcatttgaaatgctttaatgcagaaaacaaaagagaataaataatgccgaaaacaaaagaaaaaaactggaaataaaataaaataaataaagcaaaaagaaaacaaaaaagtgtattcaaatttgaaaactaatggcactaacagaaaatttataatttttctaaaactaaaagcaaaaagaattaaaaagtaaaaaaaaaaaa

SEQ ID NO: 96103 - DNA, 530 bp, Triticum aestivum
  unsure (1)..(530): unsure at all n locations
  Clone ID: PAT_TA_96103
ttttttttttgacataatcttcaataaagtattactatacaacatcagagaaactatagcacctctttcataaatagcaggagcacattctaaaattacaaacatctttaatcttacaacgtcctgctcctagtctgattagggacagcctgcttgacccgacttctcattctctctccccactgatggaacacattagattcatcaaatttccctgtaaacttcaccttctgagctaattcaaacaatatgtccggcttcccagccttggagaagtctgcagcaaacttgttgtagtctatttgtggagccttcatccctttctggatcatctcttcgataaatttacatgcttcctcaggtctgccgtgtcgtatgtgaccattaataaacacagtgtatgcgttcacatcaggacaaatccccttccgatgcatctcgtcccacactgcgcaaccattgcatagttcgtccacgaaggaaatacaactcatcatcatgttgtatgtatggatntgggtcaagcccta

SEQ ID NO: 96104 - DNA, 535 bp, Triticum aestivum
  unsure (1)..(535): unsure at all n locations
  Clone ID: PAT_TA_96104
atccagcccccctccgatctcgccgagaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccaagaaggagtccaccctccacctgggtctcaggctccgtggtggtatgcagatatttggtcaagacctcactgggcaaaaccatcacctccgagttgancctcaagacaccattgataatgtgaaggcaagattcaagacaaggagggtatcccaccggacaacagcgtctcatctttggctggnaagcantcgaggatngcgcaccttgcagactacaacatcaagaagganccanctcactnggggctcaagnccgtgggggnatgcaa

SEQ ID NO: 96105 - DNA, 551 bp, Triticum aestivum
  unsure (1)..(551): unsure at all n locations
  Clone ID: PAT_TA_96105
ttaagtttgaactatatgtcctatacaacggtacagagtaattccttcgcttttgctagttttagaaaagaaaagagaacttctcacgaggtcttacaacatgaagccaaacaaaataaagaatcgggtaaggacattaatattatctcttatacaatattattgtggcaccatagcacaatttaggttcatcgctcgatgcaaaaggccgggggttacccnccttttcatagagaaagaaatatcacaactgaggtttcacctgagggaggagagtatgtgaccaggaaacggtattgtacataagtggaaggaaataaaaatttgagtcattatctttaaagaaaaactagcatgtgacccaacatgctaatatatgcacatctcangctttattcatttttaattttccaaaatgaaacttgcacagcacaaaaaaaattggttttgactaagagagagagagaaaaacgttatccctctttacatgcccatgcccatgctgggaangggctgcntgacaacantgtgtccctgtgtaanttgcaagg

SEQ ID NO: 96106 - DNA, 387 bp, Triticum aestivum
  unsure (1)..(387): unsure at all n locations
  Clone ID: PAT_TA_96106
gatgtccagaacccatcggccgcgctgacggaggaggcgcccgcggtggagaagccggtcgccgccgaggaggtcgcgaagacggaggaagcccccgcgccggtggaggccgaagtcgatgcgcctgcccccgtcgaggttgaggagaccaaggaggaggcgccggcagcagttgaggcanaggagacgaangagcccgagccancagctgcggccgaaccggaggccgaggcgcccgccgtggtcgagacananaccaaggaggccgtggctgaggcananccggcggnngccgangaggtnanaggaatgaggctgnncctgctgccgatggcnatccgggcgcttccgctgttgctgacgaagcactgtgnngcagcccctgtc

SEQ ID NO: 96107 - DNA, 349 bp, Triticum aestivum
  unsure (1)..(349): unsure at all n locations
  Clone ID: PAT_TA_96107
ttggatttgagaaatgcaaagaattctgctggatcaactgcggacacaatagacaatgttcgacggaccagatcaaggaaggcgcaaacataataaccatctaactgaagttttagctgacgtgtcttagacatacatatgctgaagttccctaataccttttgtacatgcgctagtgagcactgcagcgttgatacaaaatctttggnttacataccatccgtgnanaccntgtaaatagagaagtggatggtggantcagtgttcacattatcangcctcgtaacttatctgatcnaagtaaaaccgtggaagttgaaatgtcaanannactgaaaaatccnaccgt

SEQ ID NO: 96108 - DNA, 536 bp, Triticum aestivum
  unsure (1)..(536): unsure at all n locations
  Clone ID: PAT_TA_96108
aagaggagatgcaaaaaacatactagtatattgaattattctttgagccaattcggtggcacctagacgattctaggccactttagtgtctcagggacacctcacggaaaaatggaaccaaactgtggaagtgggttttggctagactgagataaatctaggtggctggagaagtaaaaggcgagttgtggtggttgagtgagataaaggccgcaactacaatgcattttgctatttcctaatctacgatgctacatactgaagttgtgtagaaaacctcaaattagtaatttgtgtgcatatttggttgattaatcagattagcataactgcacaagaaaaatcaaccatggtcattcaagagtcatgtttgtctttattcgttggggatgaaattataaggatctttttaaacagcgactattgaagcctctacatgttactgcagattcttaagggaagncntaaaggggaaacaggncaggatactttgcatttaaagttancaatnctgancaaggaatttacgggcaggg

SEQ ID NO: 96109 - DNA, 542 bp, Triticum aestivum
  unsure (1)..(542): unsure at all n locations
  Clone ID: PAT_TA_96109
gcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactgggtgagaactacaggcttctgtatgacaccaagggtcgcttccgccttcantcctgtcaaggacgaggatgcctaagtttaaactnctgcnaaggcaaggtcggtccnantttgggcaaaaangggaatcccatacctcaaanacctatgatgggcggcacaatccgctaccc

SEQ ID NO: 96110 - DNA, 282 bp, Triticum aestivum
  unsure (1)..(282): unsure at all n locations
  Clone ID: PAT_TA_96110
ncctccccttccggttcgggttctggttcggttctggtccganagtanctagcctagtctanggtttccgtanagaggaagggatagggagatccatcnatggcggagacggcgtaccgntgcttcgtgggcggcctngcctgggccacngacgacaacannctccatnangccttcagccagtacggcgagatcctcnacgccaanatnatcaacgaccncngatacggggaggncccgcgggttcngcttcngtcacgttcggcagtcaacgangtcgag

SEQ ID NO: 96111 - DNA, 497 bp, Triticum aestivum
  unsure (1)..(497): unsure at all n locations
  Clone ID: PAT_TA_96111
gccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaanaangtggtcatctctgccccaagcaaagatgcccctatgtttgtggttgggtgtcaacgagggncaacgtncacctcagacgtnaacaatgtctcaaatgcnnagctggaccactnaacngccntgctcccctannctcagatcnttatggacaactttccggtaataattggcgggtttggttgnccacngnttcaagggca

SEQ ID NO: 96112 - DNA, 453 bp, Triticum aestivum
  unsure (1)..(453): unsure at all n locations
  Clone ID: PAT_TA_96112
atcgctttgatccagtgccttagcagcttgcacggcccagtcggtgcgacaacaaggtcaagggagcgcgacgccatttgggtatgtcatcccggcttggagcatggtgacgtccgacgtccatgggtcgtacatcatgaggcggcccgtcgaatcccctgtcttggtgagtggtgaccatctcatgctgcgacctcttgtactgcatcgagctgtcggtgaaatagacttggccggtaacttgatcaaagtcaaccctgttggtgaagcgcagaggcacaccatcaacccggtcaacgtcctgccagaggagccaaagcagcagcaccaccattctctccttttcggaagaaagaaagacatgacactgtgtccacaaaaaanaaacaatatcagttatgtagtgatgaagcctgaaagctgattatcggccacaagcctcccccttaaatc

SEQ ID NO: 96113 - DNA, 548 bp, Triticum aestivum
  unsure (1)..(548): unsure at all n locations
  Clone ID: PAT_TA_96113
ccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagcctatccctctgctgagggtggtggtgatgatgagggtgttgatgaccaggctgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaangaagaatgttgaagtccgccacaanagtaancttcttanccaaagctcaaaggaccttcaagttccttgttgggcaaaaancancnatggatnatggccggcntggtgttccnccnacnacaaggagggaactgctgatcnactttn

SEQ ID NO: 96114 - DNA, 530 bp, Triticum aestivum
  unsure (1)..(530): unsure at all n locations
  Clone ID: PAT_TA_96114
ttttttttttttcaactaattccggacggaggaagtacttgataaataacttctacaggagtgagggtaacaacaaaggagcactaagctgtgccaagtaaacacaactccaacaactaccacgataatacacaccacaaacaataaaaatatttgcttattcccaccactactccaacagctagctcgataaaaatgtgataaataaattctaatcatcgtataccatagatgtatctcagcctagcttcctcagctgccacatcttccttagagcctgtccacgtgttaggacggcttctgcgcccaccaaatggcaaatgtacgttcaagtgaccaccaagagtatgcatcggccttgccagggtgcttcatatcaataattccatgatttatgcaaccatagcagtgggccattttcattggattcaatcntgcaaaaacnantgggcaccaatgcaatggncctttccccnttggcaactncancaanggaaaanttcccaagttccaancttttagncctttgg

SEQ ID NO: 96115 - DNA, 156 bp, Triticum aestivum
  unsure (1)..(156): unsure at all n locations
  Clone ID: PAT_TA_96115
tacgctggtgtgtggcaancactgacagggtagtgtggttgatggttcggaatttgctaactcacnacccagtganacatgccatcnatggacttcananggccgngcannaagctcctttggncaaacatccacattnattgatgngtttgncgc

SEQ ID NO: 96116 - DNA, 553 bp, Triticum aestivum
  unsure (1)..(553): unsure at all n locations
  Clone ID: PAT_TA_96116
tgagaacccccaacatgaagagagtcnccgccggnggnnagggaatcaagcaagaanatgnctcggggtaagccanaggggagcgcgaccgcnagcgcgccgcggnncggnagcccaactccaagaacggccggcgacggcctcaccccggagcancgccgcgagagggacaagaangcgctggctgganaagaacnccannaaggtggngcaggcctccggggangcacctccacggncgccaagggcaanggacgccaananttatcaggagangcgcccgcncggatcccgccccccgccaancgggatngggacnccgngctccaccaangnattgccaatgccntccttgttacccctgttttggctcgtcannnatcctgccgggnttccntttgtgnccttaaatcgtngtattgggtttgggtttaaaacctggtccttntggcntgcaaaanttccttttgntgcaatgangttttgnttgttaactccctgactngaaaattccgtcaaacctccgctgnaattganttanctaacnngcttg

SEQ ID NO: 96117 - DNA, 506 bp, Triticum aestivum
  unsure (1)..(506): unsure at all n locations
  Clone ID: PAT_TA_96117
cgcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctgttgtcgtccatggtgacgctgatgatcttggcaaggggtggacaatgagctgaagcaagaagcactgggaaaacgctggtgcccgtgttgctttgcggaatcatccggggctccnagggctagatgtcaatccttccgccgaccaaacgtccgtacaagatnctggggaaccnttttcaaaatngca

SEQ ID NO: 96118 - DNA, 252 bp, Triticum aestivum
  unsure (1)..(252): unsure at all n locations
  Clone ID: PAT_TA_96118
gggacatgaaccgtaggttcttgcctcccgccatggctgccgatcgattcctttcgctcggttggtactactgctattctttcttactttctttgttgctggttgatctggtgtattatggctgagtgagatctcactctggagcaagcaatatatccaatcgatgagctattttattcaaaaaaaaaaaaaaaaaaaaanaaaaaaaaaaaaacaaaaaaaaaaaaaaaaaaaaaaaaaaaaaaaaaaaaa

SEQ ID NO: 96119 - DNA, 366 bp, Triticum aestivum
  unsure (1)..(366): unsure at all n locations
  Clone ID: PAT_TA_96119
gccacgcaagaacacaaacacagccctcacacgcgagtcgccaagaagaaaagtcccaaactttttccccctgatcgatccgccctcctcctcctcgnngnggcagggggtttctcccggcattcngngaaccctcccaaggccganaagcggctgccggcggggaagtcggncgccaaggagggcggcgacaataagggcaagaagaangccaanaagagcgtggngacgtacaagatctacatcttcaaggtgctgaagcaggtgnacccncgacatcggcatctcctccaaggccatgtccatcaatgaactccttcaaggggccaanntcntccgagttccatcgaactnggccatcggcca

SEQ ID NO: 96120 - DNA, 184 bp, Triticum aestivum
  unsure (1)..(184): unsure at all n locations
  Clone ID: PAT_TA_96120
tgangattgtaaaagttttactgctccaaggagtanagaagatgcaaatgtagtataatgtttcangttttgctacttgccggttgcctgaaacttttgatgcctctgtgtgacctaaagttgcacatcaaaaaaananaaanaaaaaaaaaaaaaaaanaaacaannaaagaaanaactaacc

SEQ ID NO: 96121 - DNA, 479 bp, Triticum aestivum
  unsure (1)..(479): unsure at all n locations
  Clone ID: PAT_TA_96121
agcagctttccacggagaaaatgggccgaccccatccaccttcatctagccacactgcggctacactgattttcccatccattccaagggtttttagccccctcgccctcgccctgccgcgccgcagcaatggccgccgccgccgcagccgccgcgagatccttcctccgatccggatccgccacctcctccctccgcggcgcggccgccagggccgcctcccgctccgggccggcggccccctcgaggcggctcctctcctcccctccccgcgcccgcctcgccctaaggtcgccgctggagatgancaacgcctgcttggaagtcgctgatgcccatgcacaagcgccacgggctcggngctcatgacgtcgctcctcgccgccccgggntcgcgtcggttcctgctgggatttccgaagacttatgattgggtgaagggacggaggtctgggatgaaaaagacnccctgtttattc

SEQ ID NO: 96122 - DNA, 581 bp, Triticum aestivum
  unsure (1)..(581): unsure at all n locations
  Clone ID: PAT_TA_96122
cccncncaaagctggngctccacgcgggggcggctacanctagtggatccccgggcgcagggaaagaattcggcacgaggtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaccgggctgcgaggagtccggcaaggcctaaacagctcactcaccacggggccacatataaagtgccattgcagttttgtcaactctgacattgctttgggttttccttctccatttgtctttcttacttgttcctaagaatatgtgtatgnccatgttcatgtnaacaacatgggctcgaggggggggcccgggtaccccaaactccncccctaatnagtggaagtncggtatttaacgcggcgcccacttnggnccgtccgnttttaanaacgtncgtngacttggggaaaaaacccc

SEQ ID NO: 96123 - DNA, 456 bp, Triticum aestivum
  unsure (1)..(456): unsure at all n locations
  Clone ID: PAT_TA_96123
catattaaccaaggtgcataacaggttcanacatacaaggttcttacaacacaacaggttgttnaacaaacaccacaaagcanatgttcaaacagacagataacagataaagccactcgggcagatcataggattgcangcagcatgccttgggaaagcaccaggaggcaggctctagtactcgtcgccctcgtcaccgtcctcaccctcgtcaaactcagcaccaacttcttcatagtccttctccagggcaagcaangatcctcacgggnctcanagaactctccctcctccatgccctcacccacgtaccagtgggacgaaggcgcgcttttgcantacatcangtcaaaacttggtggtcgatgccggggangaaagaacttcgacngacactgggtgggangnttgggagaatnaatgnacaacaagcccctcctgggaccccttgggcaa

SEQ ID NO: 96124 - DNA, 464 bp, Triticum aestivum
  unsure (1)..(464): unsure at all n locations
  Clone ID: PAT_TA_96124
catcnatattgctctctggaagtttgagaccaccaagtactactgcaccgtcattgatgcccctggtcaccgtgacttcatcaagaacatgatcaccggtacctcccaggctgactgtgctgttctcatcattgactccaccactggtggttttgaggctggtatctccaaggatggccaagacacgtgagcacgccctccttgctttcactcttggagtgaancagatgatctgctgctgcaacaagatggacgccaccactcccaagtactcgaaggctcgttacgaagaaattgttaaggaggtctcttcgtacctgaagaaggtcggctacaaccctgacaaggttcccttcgtccccatctctgggtttgaggggtgncaacatgattgaganggccaccaaacccttgactgggtataangggcccaaacccctggctttgaagggcgctttggacca

SEQ ID NO: 96125 - DNA, 553 bp, Triticum aestivum
  unsure (1)..(553): unsure at all n locations
  Clone ID: PAT_TA_96125
cagccgaaggaaactgaagctacctcctcttttctcctgcccatggcgctcgccggtagcaatgcacaccccacggttcttgtcctcttcctggttctcacgatgatgatgccctcctcgccaccgtcacgctgccatgcacttaggatatggtcgtgcatcaatgctgcggtgcagccctgccgtgtagtgacgtgcatggctgagtgcnaanccaaggggaagctgcaggacctaatttctcctttcccgctgccaaccacactgtccacccccgagcantggctgctgcaggaacgtctagctcaactcaagtggtgacaagccaatgaacgggctaaagcaaccccttttggagnccgctttttcnatttctgggcaataacnctgggnttctngtttgctctattccaaatgaagcttggtntggccttatccntcctaacaaataaaaccaaaatantttttggggggttttcccttccaaaanaatggttactttccnggacaatnnatttttttcnaaatanaaaccnaaaaaacctggttatnn

SEQ ID NO: 96126 - DNA, 508 bp, Triticum aestivum
  unsure (1)..(508): unsure at all n locations
  Clone ID: PAT_TA_96126
attgttgaaaatatgaagagcaaaatttcatgatcgggcttggttttgtcatgctgatctatctgatgcttagcaaggctgtgagttaaggcttcgaagctgtgcggtgatatcaagcagcagtgacatcagaaattgaatacggcattattacatatggtcaagattcttttttggccacgggaatttacaattttggagctgtggagaggaggattacnggttcctgtgaactttttttttgggaaggactggttcctgtgaactgataaagtcataccaaatgatttatgtgttctcctttttcntggggtggcgattatctcatgcttcaatanatcgctagattaatggtaaaagcgccccttaatagtacaccaagtaattgtgtttgcacggtaggttgnttangataagganaatttaggtttgcaatgtcaaataattaccnttgnaanaattaaattgcaangcnaaaacatggttgacgccccnaacaattgaagca

SEQ ID NO: 96127 - DNA, 471 bp, Triticum aestivum
  unsure (1)..(471): unsure at all n locations
  Clone ID: PAT_TA_96127
gcagttcgtcgcctcaaccccgagcccgccatcccacccgccagncccgatggnccgcacgaagcagacggcgaggaagtccaccggcggcaaggcgccgcggaagcagctcgcgaccaaggcggcgcgcaagtccgccccggccaccggcggcgtgaanaagccgcaccgcttccgccccggcaccgtcgcgctccgggagatccgcaagtaccaagaagagcaccgagctgctcanccgcaagctgcccttccagcgcctggtgcgggagatngcngcangacttcaagaccgacctccgcttccagaggtccgccgtntccgcgctccangagggcggcccgaggcntacctcgtggggctgttcgaggacaccaaaccttctgccgccatccaaggccaanggcgcgttcaccatcatgnccaaaggacatncaagctcngcccgnccggcaatccggtgggcgaga

SEQ ID NO: 96128 - DNA, 259 bp, Triticum aestivum
  unsure (1)..(259): unsure at all n locations
  Clone ID: PAT_TA_96128
gctaatcaagctctcagctccttcccagctccacggtttccaagcaagcanaccgaagcactanatcctcgatggctcgcgtggcactggtcnccgtgttcgccgtgctcgcggcantggtcggtggcggagatggcgtccgggggcggtgacctgcngcnacgtgnacgtcccgccgtcncgcccgtgcatgtncctacggcgaaggggggnaaagcgtcgggcaccctccnggggngcnctgctnncatcngggggt

SEQ ID NO: 96129 - DNA, 379 bp, Triticum aestivum
  unsure (1)..(379): unsure at all n locations
  Clone ID: PAT_TA_96129
tctcctcgcctcgccgtctcgccccacgccgccgacgcaaagatgccgttcaangaggttcgtcganatcgggcgcgtggccctggctgaactacggcaaggactacggccgcctcgtcgtcatcgtcgacgtcgtcgaccaagaaccgggcacttgtggatgctccngatatggtcaggtgccaagatgaacttcaaagccgtctttccgctgacccgacaatcaaagattgacatcaaagcgtatccctaaagaatggcaactttttgtattcnaangcccattggntgggaaggcaagatgttggnaaaacccaanaatnggggaaaaacaaagcctcaatgnggggtnaacnaaanccttntttgtcccaacaaa

SEQ ID NO: 96130 - DNA, 506 bp, Triticum aestivum
  unsure (1)..(506): unsure at all n locations
  Clone ID: PAT_TA_96130
tccggctccgccaccgcccacctcatcaacagcttccacacgccccaaggcgccatccaggccaagcagcaggtgtccatcctgttcaagtcgntttctagggagcttcctgtggtccatgttccacgtgcgttctacacggcgggggactcgtgcgggttcggctccttccccacgttcgnggatggaggcgtacaaccgggcggcttctacttccgacttctcgcgcggacgtacttcgngggtgggggatggattcctgccccctacatcatcaaacnttctcgcttgctcatcgggggagcaatcaatctnccttggggggggaatcaatgttgggcccctttcatncgaagaagcaaagaaggggggggacctgggtaccgacgncccaaccctccccaaacaancaagccctcnaacgggccctcaaacgggctaaccaaggttcnttcaatcctcccaatncggccaatggatttnatgggggggacgngggcctcttc

SEQ ID NO: 96131 - DNA, 428 bp, Triticum aestivum
  unsure (1)..(428): unsure at all n locations
  Clone ID: PAT_TA_96131
gtcncgagtttttttttctttnnttttttttcaagaggnagcatgtagatttgcgganaantanttantaanacncatacattgagggatcttccaccgnacaaccggccanattccctaatgaattactcaacataaccttaacctatcacanatcataaaagcggacacncagttaaacatagagggcctatggaactaaatcaacattttctccctttgaggtaccnagatagtgaatncatccaatnttatcgagcccttgatgatggggacangggtaancttnncaacaagttccgnnnccaacggttttgnggtgngaattccttgccagntaatcattcnggactatncnacaaccccttantnctaattgcaatnnccacgctntcctccgaattttccctttggggtngaccctttgg

SEQ ID NO: 96132 - DNA, 512 bp, Triticum aestivum
  unsure (1)..(512): unsure at all n locations
  Clone ID: PAT_TA_96132
ccgtgatggcctcgtcggccacctccgtcgctcctttccaggggctcaagtccaccgccggnctccccgtcagccgccgctccaacggngctagcctcggcagcgtcagcaacggtggaaggatcaggtgcatgcaggtgtggcccatcgagggcatcaagaagttcgaagaccctgtcttacctgccaccgctcaagcacgggaggccctcctcaagcaggtcgactacctgatccgctccaagtgggtgccttgcctcnagttcaccaaggttggggttcatcttccgtgagcacaancgcatctccctgggtactacgaatggccggtattgggcaatgtgggaaagctgccctatgttcggggnngcaactgaccccaacaaaaggtggattaaacaangtggggagggagggtcaagaaaaggagtaacccctggaacngccgttttgtccggcaatccatccggganttcgaacnaacaatgcggtcaagggggcnaagtggccgt

SEQ ID NO: 96133 - DNA, 439 bp, Triticum aestivum
  unsure (1)..(439): unsure at all n locations
  Clone ID: PAT_TA_96133
gtcggacgcccgccgccggggccgcctcttcaccctcgcgctggccctcctcctcgcggccctcgccctcgccgcctacctctcctcccccancgccgtgcgaccgctcgccgccgcggaggccggccggcgctgcggtggaatccanggcctcgagctctggggccccgcgctcaactggggctccaagccaccgccttgccctccgccgccgcctgctgcgccgcctgcanggcccaccgccgctgcgaacttcctggggttcttctgcgggggaacccgcccncantttgcnggcaagcccgccttcccggngaagttgcttggcttgntatnaactcaagnaaccgaatgccaatngggtccccttgcctgtntattgcccgactggggggggacgggnttttcatcttgcganccttnnggggctctcngttct

SEQ ID NO: 96134 - DNA, 386 bp, Triticum aestivum
  unsure (1)..(386): unsure at all n locations
  Clone ID: PAT_TA_96134
gtctcgagtttttttttttctgctaagtatcaaatatgatgacagtatcagctgcttgaagattgacaccaacgcctcctgctcggatacttagcaagaaaaatgaaagctggngaatcaggatcattaaatctatcaataagtgntcctctctcatgcccaagaagtgtgtccatctaaccgaaggtantgatactttttccataccaggggggggcccggtaccccaattcgccctataagtngaagtcgntatnaacgccgccgctcaactgggccggtcgnttttaacaaaccgtcgnngacctggggaaaaaacccctgggcnntttaccccnaactttaaatccgncccttgccaggcaacnaatccccccctttttcgc

SEQ ID NO: 96135 - DNA, 512 bp, Triticum aestivum
  unsure (1)..(512): unsure at all n locations
  Clone ID: PAT_TA_96135
cctactcacactccacctcccctctctccctctccctccctccctcgccgcgccgtgctccctccactccatcccatcgccccagggcgcacacgggatcgcgcgcagatctgcgcccccaatcccacgcgctcgcttcccactccccgcctccccgcggcggcctgggctggcttaatttcgctaccaatgcgcctctgggtagggcatgagaggcactggcggcggcttgccggcggaccaattcacacccggatggagctcaagcgtcgccggccgcagccgtgggagctcgggcaagcggggccggccccgaacgaccantaccaaggaggcaaggaccaaggaaccaagggggaatgccaaggcgggcttgggcgcctccgttgcccggtggnccgccgcaaccaagcaaggcaaaccccctncctcggcgggntntaancggcngttctccgccggcggggctcccggggcgggtaaagggaaccggcccacaagnaaangggnct

SEQ ID NO: 96136 - DNA, 268 bp, Triticum aestivum
  unsure (1)..(268): unsure at all n locations
  Clone ID: PAT_TA_96136
cctactcacactccacntcccctctctccctctccctccctccctcgccgcgccgtgctccctccactccatcccatcggcccagggcgnacacgtggatcgcgcgcanatctgcgctcccaatcccangcgctcggnttcccactccccgcctccccgtcggtgngcctgnctggcttaatttcgctaccaatgcnctctggggtanggcattgataggcnantgggcgggnnggnttgctnggnggnaccnaaatttcnanaaccc

SEQ ID NO: 96137 - DNA, 226 bp, Triticum aestivum
  unsure (1)..(226): unsure at all n locations
  Clone ID: PAT_TA_96137
tcaaacgaaggcccgtnccccgtgtcgctccctggagcggttcnatcaaanngtncattccanntccggngatgtttactccagtccttatcacggtcgtgtaggaaagccatgcccatgcagctcgtgctccggagcaatactggtaatctgctcttcccaacaccnnnaatgccaaacgctcnccttttctcatctcctnaancaatcaaagcctgggaggcaa

SEQ ID NO: 96138 - DNA, 462 bp, Triticum aestivum
  unsure (1)..(462): unsure at all n locations
  Clone ID: PAT_TA_96138
atccaatccagcccccctacgatctcaccgggaaacctccgatccgagcgaagcgaaggntctctcgtcctcctcctcaagatgcanatctttgtgaagaccctcaccggcaagaccatcacccttgaggtcgagtcctctgacaccattgacaatgtcaaggcaaagatccangacaaggagggcatccccccggaccancagcgtctcatctttgctgggtaagcanctcgaggatggncgcacccttgcggactacaacatccaagaatggngtccacctcttccacttggtggcttaaggctacgtggtggntaatgcnagattttntgtcaacgaccctcaaccggcnaagancattcaacccctggnagggntganttcctcaagacaccaattggacaantgtttnaggcccanngnattccaaggaccaaggaaggggcatcccccccnggcac

SEQ ID NO: 96139 - DNA, 463 bp, Triticum aestivum
  unsure (1)..(463): unsure at all n locations
  Clone ID: PAT_TA_96139
agcaagctaagctaggcagcatcgagaagctagtgagctcactcactcaatcgcgctcgccatggccgcgtccaccgccgtcaagctgtctctgcctcctcctcgtcgccgccgtgaccttctccgtcgcggccgcggngccggcgccggcancacccccgccgttccggatggtgtatgcgttcggggactcgttcacgggncacggggcaacacgcactccacgacgggggggcctaactcggtacgggntacgttcnccaaacccgccctacgggggggcaancttttttcaaccgctcccaacaaaccgcctacttccggacgnggnccgccctncgtccgttcnaactttccntcggccaaccggaacgccgcntgggcggcctggcccctcccttttcnttccccggccccntaaactnntcccctncgcccggccccccaaaaangncnaagcaag

SEQ ID NO: 96140 - DNA, 327 bp, Triticum aestivum
  unsure (1)..(327): unsure at all n locations
  Clone ID: PAT_TA_96140
cgacgcctcgcgataccagcatggctggccacatcctccatcncccacggtgcggtcgtcatgtcccccgtcgtgctctatangtcncctattccatcaacatgacgagctaaacatatcgtgtactaccaagtaccaacacgtccactggctcatgggcaaacacacacccataattatacactaatgactctgagtttaagcctaagaagatatanattaaactctaacagaagcgaccttcttcttcntgattgttgtttcaagttgcatccctgcgggcctcanntttgaggggnagaccaaacntgaatcngnttnaattgg

SEQ ID NO: 96141 - DNA, 643 bp, Triticum aestivum
  unsure (1)..(643): unsure at all n locations
  Clone ID: PAT_TA_96141
tgcctagnttnttcgntctcgcaggcggccaanaaaagntgganctcnccgnggtggcggtcgctcnanaactantggctccccgggcngcaagccaaatctcctcatcctcccgcgcatctcctccgnnatggcccgcaccaagcagacggngaggnagtctaccggcggcanngngccgaggaancagctggncaccaaggccgcccgcaagtccgccccggtcacaggcggngtcaagaanccccaccgcttccgccccggcaccgtcgccctccgcgagatccgcaagtaccaagnacgaggcaccggagctgctcatccgcaagctccccttccagcgcctctgtccggcgaagatcgcccnagtganttcaagaccngacnctccgncttccagttcctnccgccgtctccgccctggcanggaggcgcgncggagggccntacctggttgggcncnctttcgaaggaacacccaancctctggcgcncaatccaacgcncaaaggcggcggtncaccantcnatgctccnaanggnacattcaagggttcgncccgcncggtanatccggtgggaagaagaaggggccntaangctnctggttcggcncggttccgtctggttangttcgnnccnt

SEQ ID NO: 96142 - DNA, 504 bp, Triticum aestivum
  unsure (1)..(504): unsure at all n locations
  Clone ID: PAT_TA_96142
ccctcgcgctccaagttgaagcgttgaactcccaagcccactcgatcccccaactcgcaactcgaccccgaccaagccgaacatctagccaatggcgggagcagtgcctctggcgccgccgatggtggccgcggcgaggccggcggcgggctcgctctacgaagcgctgcgcgtgggccgcgcggcgacgcaggtggagatcaggaccgcgtaccgctccatggccaagcgcctccaccccgacgtcgcctcctgcggccgcgggggtcccgaggcgttcctggagatccggagggcgtacgaagacgctgtccgacccggccgccnagggcngcgctacgacagctcgctcggggtgttcccgccggcggggggcgcccggcggncgttgattcccgggtgcnggaggttgggaagaccggaccaaattgccttgggtgatttaaggccaatgaatntcccaaacctcccaatgaaaacgtgggatttgagcctttngntttg

SEQ ID NO: 96143 - DNA, 286 bp, Triticum aestivum
  unsure (1)..(286): unsure at all n locations
  Clone ID: PAT_TA_96143
gcaanccgtccgcctcgctcttctcnccgagcctggnccncatccactccgcctcgtcctccccaancangatttatcaatctanaagttaagcgnctccgtccgtcttcgtagctgctcacatggcgattcaangatgaccaaggccnaagnaagaagnatcgcgttacgaccaanangcttctgncaagcntgcccccnnggaagtaacaccaacnggtngctcnatccntgccgttcngcccggacnaatggtcctgctnccaaanccaagcctcncanggaa

SEQ ID NO: 96144 - DNA, 560 bp, Triticum aestivum
  unsure (1)..(560): unsure at all n locations
  Clone ID: PAT_TA_96144
agacgacacatcatatnaacaccaacaaaacagaagcacccgacacacatccgggatnacaagacaagaacagctctaagccaagtattaccggcgacccanaacctaggccctctcccctcggatgcggcggggcgaagctggatgtccttgggcatgatgggtgacgcgcttggcgtggattggcgcaaaaggttggtgtcctcgaaacaancccgacgaagggtaggcctccggcgggcctcctgcaggggccgggaggacnggcggggaggctctgggaaaagcgnggaggtcggtcttgaaaagtcctgcgcggatctcaacgggaccgaangcgcttgggaaagggggaagctttgcnggaatgaagcaaactcccgttgctcttcctgggtaaatttgccgggattctccgccgggagngggcgaacggggttccccggggccctgaaagncggttggggggctttctttcaacgccccgccccggttgggcgggcggcccganttntcnccgccngnccttgggtgggngaagcttcctttcctccgncgcc

SEQ ID NO: 96145 - DNA, 545 bp, Triticum aestivum
  unsure (1)..(545): unsure at all n locations
  Clone ID: PAT_TA_96145
aacgttctcttggcaggtctgattcaacagcaagtggagattctccaaaggagaggattgtgccaccatctcaagaaaccggcaacaacttccttgagaatcgaccggtttgtacgcccatttaccctgagagctgtgcaagagcttcttggtaaatctgngatctgtttgtagcttctgggatgggatcatatcaacgacccactgctanggttacattctcctcgagtgggaaggaaagctacaagctactccggtgatgctgtctacaaacctggcaagtgggcccccaaaacaatgggcaaattagtctngttaggctggaaatttgtttgantcccccaagggaaagtgnaaaccgcaaangctttgaaaccccctccccccctccccccaagcnangccaaacnagcnaggtgggncgggttccctaattaagcccaangccacctaccaaccaaaggggaagggctcccttttgccangcaaagggtcnagggcaaaaatcanaaaggtggtggccctcncccaagcctggctgncnn

SEQ ID NO: 96146 - DNA, 476 bp, Triticum aestivum
  unsure (1)..(476): unsure at all n locations
  Clone ID: PAT_TA_96146
gagcaggcggcggtggtgcccgaagacgagaagcacggcgacctagcccgagctcgcaaccatggctagggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcaagcgtcatatcatggttgatggaaaggtccgcactgacaagacctaccctgctggtttcatggacatcatttccattcccaagactgggtgagaactacaggcttctggtatgacaccaangggccgctttcgcccttcactctgtcagggatgaggaatgctaaagttcaagcntctgcaaggggcagggtctgttcanttncgggcaaaaangg

SEQ ID NO: 96147 - DNA, 170 bp, Triticum aestivum
  unsure (1)..(170): unsure at all n locations
  Clone ID: PAT_TA_96147
aagagggagtagtttattgcagtggntaaaaattttctggcccccatacattcatgtcgagctccgccactgtatatacatgaagcattccagcaacatgacgagctaaacatatcgctgctactagtaagtaccanacacgntcaagtggttcatggggcacacacaca

SEQ ID NO: 96148 - DNA, 466 bp, Triticum aestivum
  unsure (1)..(466): unsure at all n locations
  Clone ID: PAT_TA_96148
cccaaaccttctcctccttctgaacctcccggcgcatctccgactccatggnccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccaagaagagcaccgagctgctcatccgcaagctccccttccaagcgcctcgtccgggagatcgcccaagacttcaagaccgacctccgcttccaaagctccgccgtctccgccctgcaagaggccgccgaggcctacctggtggggctcttcgaggacaccaacctctgtgccatccacgccaagcgcgtcaccatcatgcccaaaggacatccaactcgcacgccgcatccgttgngaagaagggctaaactn

SEQ ID NO: 96149 - DNA, 228 bp, Triticum aestivum
  unsure (1)..(228): unsure at all n locations
  Clone ID: PAT_TA_96149
cctgtctgaaccggtaacgcatcccccccaaagtgtccctactccgacgatctatccgtcgagcctctcaccggtcaccgcggcactcgcancagcgccggaggaggaggatggggcggccgccgancagcggggggcccgcgttccggttcacgcacgcggaggtggccggcantcttnccctcnacctatcntttttgactaacgganttctnccgctngctttaa

SEQ ID NO: 96150 - DNA, 552 bp, Triticum aestivum
  unsure (1)..(552): unsure at all n locations
  Clone ID: PAT_TA_96150
gcaatccaccaagcaaacccgatggcccgcacgaagcagacggcgaggaagtccaccggtcggcaaggcgccgaggaagcaagctggccaccaaggcggcgcgcaagtcgngcgccggccaccgngcggcgtgaagaagccgcaccgcttccgccccgggcaccgtggcgctccggggaagatccngcaagtaccaagaaagaagcaccggagctgctcatccgcaaagctgcccttccaagcgcctcgtcaaggggagatcgccgcaagggacttcaaaggaccgacctggagggttccaagtcctccgcctgtggtcgggcgctggcaagggaggggcccgcccgaagggcatacctnggtgggggggctgtttcgnaagggacaaccnaaaccctctggngccaatccaacgcccaaaggggcgttcaacaatcaatgcccnaanggacattccaagctccgcaaggaacggcattcaanggggaagaagaaggggcctaaaatttcggtccggcttccntttcccnagtggtctggtactccngaatt

SEQ ID NO: 96151 - DNA, 489 bp, Triticum aestivum
  unsure (1)..(489): unsure at all n locations
  Clone ID: PAT_TA_96151
gttaacccaaaggccccgaactaactgaggagtggttccgcaaatcatagcatgacaaggaggacaggacngacggagaggcgtgccgcggaacaagatcgggcatcggaacatattgcagaagatctcgtatggacgcgcgcccttccaagctccgatcccaagtacttagctggaggcgcctcagtggaggaggaggatgctggtgctgcatagagaattcagtgcaaagctggctgccgtctggaagggccagatcgattgggccgccgtggaagaagaaacgccgcggcggttgcacgctgcggtactgatcaagaggttgcacggtgggtcgcgcctcccttttgtcgtgcggtttatccaatccgtgtatgaaaccaaaggctcaaaaagcaagcccgcaagatttctcaaatgccattccaattccaantccaattccaatggagtcnggaaaatattcggcaaagtggccctgccctggcc

SEQ ID NO: 96152 - DNA, 474 bp, Triticum aestivum
  unsure (1)..(474): unsure at all n locations
  Clone ID: PAT_TA_96152
caggtaagggacgaggagagcggcggcgaagatggtgtcgctgaagctgcagaagcgcctggcctcgacgtcctcaagtgcggcaagggcaaggtctggctcgaccccaatgaggtcaacgagatctccatggccaactcccggcagaacatccggaagctggtaaaggatggtttcatcatcaggaagcctcagaagatcactccaggtctcgtgcaaggagggcacatgaggccaagcagaagggccgtcactcctggatatggtaagcgtaaggggtaccangggaggctaggctccccaccaaagatctgtggatgcggaaggatgcncgtcctgaggcgccttctgcgcaagtaccgtgagggccaagaagatngacaagcacatgttacatgacatgtncctgaanggcnanggtaacatgttcaanaaacaaaaaggtnctcatgggagaagtatccncaagtccaa

SEQ ID NO: 96153 - DNA, 512 bp, Triticum aestivum
  unsure (1)..(512): unsure at all n locations
  Clone ID: PAT_TA_96153
cttttttccccttccnccgccgccgngactagagtttcctcgcgtagggtttcgtctcccggtccgggatcagcagcaccacgcgggcgatggcggccgcgggagangccggcgagaagaagatgatcacactcaagagctcggacggcgaggagttcnangtggaggaggnggtggccatggagtcgcagacgatccgccacatgatcgaggacgantgcgtcgaccaacggcaatcccgctccccaacgtcaactccaaaggatncctctccnangggtcaatcgaagntactgcnncaaggcacggttccaagggcccaagccccgccgnatgggggctgnccgccggggagncnggggagcccgggaggccttcggatcgnccggcccncccggccgnnccccggccggagggnaccctcnaangaaacctggggaccgccnngaagtttcgttcaagggtncgacccaaaggccnncccctcntttcggacccntcaannccttggg

SEQ ID NO: 96154 - DNA, 552 bp, Triticum aestivum
  unsure (1)..(552): unsure at all n locations
  Clone ID: PAT_TA_96154
ccaagccaatcccaccggagagaagagaagatgtcgggccgcggcaagggaggcaaggggctgggcaaggggcggcgccaatcgccaccggaaggtgctgcgcgacaacatccaagggcatcaccaaagccggcgatccgccgtcttgcgcggcgtggcgggcgtgaaagcgcatctcggggctcatctacgaaggagacccgcggcgtgctcaagatcttcctccgaggggggggccccggtacccaaattccgccctataagtgangtccgtattacgcncgctcactgggccgtcgttttacaaccgtcgtggactgggggaaaaaaccctggggcgttacccaaactttaatccgcccttgcnagccacaatcccccctttccgccaagcttggcngttaataatcgaaagagggccccgcaaccnggatttgccctttcccaancaagtttgcgccaagccctggaatggggcggaaatgggggaacnccgcccctgttagccggcggccnttaaaanccncggccnggttgntgggtggcttnact

SEQ ID NO: 96155 - DNA, 544 bp, Triticum aestivum
  unsure (1)..(544): unsure at all n locations
  Clone ID: PAT_TA_96155
gccactcgcaccacagtcatccactcacaagctaagctagcggcgcagtagctcacttcagtccagcggnatggcggntccgaggggcgcggcagtggtgctggcgatggtgctcgcggccatggtggtgcgcgccgccgggcgacggtgcacgcgngccatatcctgctccacgggtgtacaagcacgctgatgccggtgcctgcaagtaccgtgcaagcaagggcgggttccgccgggcccgngggcttgctgcaccgggcatccaaganacctgttgggcgggnagggccaaacnaacaagncccgaaccgccggcaaccaatctgcgggctgccctcaaaagcaacgtccgccaaacgggcggcctccgngcggggcccctacaattaaccccgccgccggccggcggcctccccctccnaaggttgcaaacgttccccccctcccccctaacaangattcaagccccnagncggtccgaactgcnaancttcggattccnactggaaacggaaactngaaanccgccnttggncccgtt

SEQ ID NO: 96156 - DNA, 559 bp, Triticum aestivum
  unsure (1)..(559): unsure at all n locations
  Clone ID: PAT_TA_96156
ngccaaaggtaatccaatccgcacanaaatccccanctcaaaacccnagccctcatccccgatcccggcaagcgangatggccaacccnagggtgttcttcgacatgaccgtcggcggcgccgccggtcggggcgcatcgtgatggagctgtacaaggacgcgngtgccngcgngacggtggangaacttccgccgcgctctgcaccgngctgagaangggcgtncggcaaagaagcgggcaaaagccgctgcactacaaaggggcaagcgccttcctacccgcgctgatccccngacttcatggtgccaagaggccgggcgaactttcaccaagtggggcaaaccgggcnacccgggagggcgaagtcccatctacgggcggaagaaagttccgccngaacngaagaaaagtttcgtccaacaaaggcaaanaccaaagccccgggggatncttcttccnatggggccaagcggccgggggcccaaacaccaanngggntccccangtttcttcaatnctgcaaccggtcnccctgncaaattngggctccgaacntg

SEQ ID NO: 96157 - DNA, 480 bp, Triticum aestivum
  unsure (1)..(480): unsure at all n locations
  Clone ID: PAT_TA_96157
ccgggcagcaccgaggaggagtcgcggtggctcgcggncctctccgagcccgagctcgatctcctatcggcctgaagatgctggccgtgaagcgggcggagacagccggccgcccccacctcgccgacgccttcgatctgcgcaccctccgggccctcggtgtagttttgctggaagatttcaaacaagcggctaagagaagaaacctcactcgatgtaaccggtcttgatagacttgcactatcaagggatcctgttatggatgctaagtgtcggtactaagtagcagtgattccgaggtgttcaagcggggcaaagcaaagatcagccaataaaagccaagcgggtgtcnagaggaaacgaaaggcagatgcaaagatgggcgtcatggaagaggctgaccaaagggaacaangaaaaagnaagaaaaancgaagccccgaaggagattaacggtgaataataaatcgaattgcgaat

SEQ ID NO: 96158 - DNA, 513 bp, Triticum aestivum
  unsure (1)..(513): unsure at all n locations
  Clone ID: PAT_TA_96158
gntccnggtcgatatcancgacaccatcgncaatgtcaaggcnaagatccaagacaaggaggggatcccgcggaccagcancggctgatcttcgccgggaagcacgctggcggacnggcgcacgctggccgactanaanatccagaaggagtcgangctgcacntcggtgctcngcctccgcgggggcatcatcgagccctcgctccaggccttcgcccgcaagtacaaccacnngaatatgatctgcccgcaaggtgctacgccagtgctgcantccangggctgtnaanctgncggcaagaagaagtgtgngnnacagcaaccanncctgagggcccaangaattaanatcaaaganntaggngccncgtaaanaccgttnatntgccgctnttcantngtnctgggagtaaattcttgttangnacaaaaaaatgtttcctggggnttacccattttgcctggccccacngtcnangaatggtttnaacncntggtttaancttctaatg

SEQ ID NO: 96159 - DNA, 557 bp, Triticum aestivum
  unsure (1)..(557): unsure at all n locations
  Clone ID: PAT_TA_96159
ggcccctcactcnttcccttcccttcctcgcggnggaggtacctacagcagcgggccgcctcaatccccgccccctcctctgcctcccgggggacgcgcgccgccgccgccgccgccgccaccaccatcgccgttcactttcttcttncgctcccccggggacatcctgctggctgtctncancccgttccaagtctctccgccaattgggctccttccttccttcgaggatatttcagagcaacaacagagcttgcagagtgtcacccccaaanggtaccaaattgaangttgcaaaagtaaaccaaacctaaaacaacaantgggccacctggaatgcctncctggnaaggaggattccttgggtttctttggaacaagtcgcntaggtaatgggtanantaagaaaaaggtctccccgcngaaggacantttgnacctttgtccnataaattttgatnaaanncgctggttctngcaagcttattacattgacccaaannggaggangggttggttnanggaacgcctttttntcctcgctggcgaagaaatan

SEQ ID NO: 96160 - DNA, 543 bp, Triticum aestivum
  unsure (1)..(543): unsure at all n locations
  Clone ID: PAT_TA_96160
ccagccccccatccgatctcgccgggaaatctctccgatcgaagcgaggcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccaagcangcgtctcatctttgctggcaaagcagctcgaggatggccgcacccttgcggactacaacatccagaaggagtccaccctccacctggttctcaggctccgtggtggtatgcanatatttgtcaagacccctcactgggcaagaacatcacccctggnggnntgaagtcctccggacaacantgacaaangttgaagggcaaagatncaaggacaaaggaggggnatcccaaccgggntnaagcaacgtctcaatcttttgccggggaaangaagctttgagggatggggcgccaccctttgcaggcctaacaacaatccnagaanggggtccaactnctccn

SEQ ID NO: 96161 - DNA, 175 bp, Triticum aestivum
  unsure (1)..(175): unsure at all n locations
  Clone ID: PAT_TA_96161
angatncacaatgtccgccagtccagtcctcaaagntatcgacaancttgttaattttgncccntgcctgctgggtggngntccatcaaacagtgannaataaccccgccggccgggcggcctcggctagatnaacaacaacttangaaatttgttnatgncngatatgggccgg

SEQ ID NO: 96162 - DNA, 531 bp, Triticum aestivum
  unsure (1)..(531): unsure at all n locations
  Clone ID: PAT_TA_96162
ggcactggtcgccgtgttcgccgtgctcgcggcactgggcggtggcggagatggcgtccggggcggtgacctgcggcgacgtgacgtccgccgtcgcgccgtgcatgtcctacgcgacggggaaggcgtcggcaccctcgggtgcgtgctgcagcggggtgaggaccctgaacgccaaggcgtccaccccggccgaccggaaggcggcgtgcaactgcctcaagaacctggcggggtcgggcatcaacatgggtaacgccgccaacatccccggcaagtgcggcgtctccgtctctttccccatcaacaacaaaaccaactgcaaataaccttcaactaagttatgttgccaaggatcatcaatcaaaaccaaggctacctaagcccaatccggtgtctaatgttgctggcccgctctctgcaatgtgttccgctgtttgtttttcctggcatntgttcaanctccaatctggttgcccctttgttacaagattgaagcaagatttactggattcgaaatcanccaaataa

SEQ ID NO: 96163 - DNA, 513 bp, Triticum aestivum
  unsure (1)..(513): unsure at all n locations
  Clone ID: PAT_TA_96163
gccgctgccttctctactgcaccgccgcagccatggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaaagaaccgtcagcccaatggtcagggacgctggcctgccaagtctgctaagttcgttctggatcttctaaagaatgctgagagcaatgctgaggtgaaaggtcttgatgttgatgctctctacatttcacacatccaagtgaacaaggcccanaagcancggcgccgggacctancgtgcccatggacgcatcaacccctacatgtccnaacccatgccacattgagctgatcttgtccgnagaaaggaaaaanccgggtt

SEQ ID NO: 96164 - DNA, 546 bp, Triticum aestivum
  unsure (1)..(546): unsure at all n locations
  Clone ID: PAT_TA_96164
gtcgctctgtcctgcatccttgcctcttctccacactcatctccaaggcataaacctctccctccctgtctggcaatcatcattgtcaacaatggcggaacccaaggcggccaagagcaagtcgtcgtccaagtccaagaaacaccaccaccaaggggacggcgaggcgtccaanaaggcgaccaaggggaaggccgaggccacgggcacgccgtcgccggcgccggcgccgtcgctcgacgcgcacttcaagccgtgcgccgacgtggcgggcctccgcttcggcgcgcanctcgtcacgcgcgcgctcaccgttgcggcgcgccgggcccgctcgagctgccgcacctgctccgagtcgtcgtccccgacgccgggcgncggggcaanagcacgaaaagggcaaaaagggggcgcaaccgcttgtcgttcgccnccgacgaacgacccgcgttacattcccggaccaaacttccgccatncttggcggcaacaacgccgtgggaacaacngctcanggcttcggggctccggcaacaaaaaaan

SEQ ID NO: 96165 - DNA, 308 bp, Triticum aestivum
  unsure (1)..(308): unsure at all n locations
  Clone ID: PAT_TA_96165
gacaggtctacctcaccggggagaaaagaaaagaagcgaagatgtccgggcgcggcaanggangcaaaggtctgggcaagggcggngccaaacgccancggaangtcctccnggacaacatccaaggcatcaacaagccggcgattcgtcctctggcgcgtcctgggggggtnaaacgcanctcgggggtcanctacgaagaganccccngngtgttcaagatnttcctccanaacgtnatncgcgangccgtnanctacancgnntaaacccgccgcaanaacgtcaccgncatggncgtccgtcta

SEQ ID NO: 96166 - DNA, 533 bp, Triticum aestivum
  unsure (1)..(533): unsure at all n locations
  Clone ID: PAT_TA_96166
atcacagccgcctccgccaccgaccatggggggcgctctcgcaatcgccgccgccgccgccgccgccggttcttacgaccgcgattgggcggggctgccggaggaaatactccttcaggtgctgtctgcgcctcgtggcatgctgcttacctagccgtccgccgccatcgcttcccccttccgatctcccggaagcaagctcccctgcctgctctacgcatgccgcgattccgccgcagacggcgccgtcgtctgctgccccttcaccggcgattccgtccgaagcccccctgccgcagcccccgctcaaccgccantccacggtcggctccgcgcacgggntggctcgtcaccgccgacgagggctccaaactccacctcctcaatcctatcantgggggcccaangccggcgctcccaaccaatcgccactctccaacaacgttcgaagaagctgtaccgaccgcccgaagggccgcctcaatgttacaacntcttcgacaagggggcgattcccgaagccgaaccccctt

SEQ ID NO: 96167 - DNA, 520 bp, Triticum aestivum
  unsure (1)..(520): unsure at all n locations
  Clone ID: PAT_TA_96167
ggaagtctcatcgtacctgaagaangntggctacaaccctgagaaggttccctttgttcccatctctgggtttgagggtgacaacatgattgagaggtccaccaaccttgactggtacaagggccctacctttcttgaggctcttgaccagatcaatgagcccaagaggccctcagacaagcccctgcgtcttccccttcaggatgtttacaaagattggtggcattggaactgtgcctgttggacgcgttgagactggtgtcatcaagcctggtatgggtgttacctttggccccactggtctgacaactgaggtcaantctgttgagatgcaacaccnagtccctccctggaggggcttcctgnngacaatgtccgncntcaacgtgaaagaaagttgctgtcnaaggatctnaaagcgtgggtttgtttgcatccaactccaaagggatgaccctgccnaaggaggnagccaacttcacctcctcaagtcaacatcatggaaacaaccctggtcaga

SEQ ID NO: 96168 - DNA, 529 bp, Triticum aestivum
  unsure (1)..(529): unsure at all n locations
  Clone ID: PAT_TA_96168
ttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattggtagggtaacgtattttggtttcaaaagccctacgtngctcctacgttttggggggattctaccgaaattcccccctactttattccaaaaactttccaaagggccccncctcannggttatccaaagttngaaagaaaataaagttgaan

SEQ ID NO: 96169 - DNA, 245 bp, Triticum aestivum
  unsure (1)..(245): unsure at all n locations
  Clone ID: PAT_TA_96169
acagagggagaggatggnantcnacagcatgcacgtcgtgatgttccccttcctcnccttcgggcanatcancccgttcgtgnagctggcgcgcaagctcntccccgccggaggggtgcgtgtcannctgctgtcggncgcgggcaacgtgnccccgcntcgaggncatgntngggccggcggncggcgcggtgngcggtggcccccctgcgcctccanaagcgtgccggggctcccccgagggc

SEQ ID NO: 96170 - DNA, 559 bp, Triticum aestivum
  unsure (1)..(559): unsure at all n locations
  Clone ID: PAT_TA_96170
tttcctcgctagggtttcgtctcccggtccggatccaagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggnatcccgctccccaacgtcaactccaagatcctctccaaggtcatcgagtactgcaacaagcacgtccaggccaagcccgcccgatnggggctgccgccggagccggagccggagcctcgggacgccggcccccgccgcccccgccgagggagctcaaagaaantgggangcccgaagttcgtcaaagggtccaacaagggccaaccctcttccgaactcaaccctggggttggccaactaccttgaanatcaaagggggctgggtgggaccctgaacntgccaaaacngtttgctgacaatnnttaaanggngaaagacccccaganggaganttcgcaaaggaactttcaacaatcaaaa

SEQ ID NO: 96171 - DNA, 523 bp, Triticum aestivum
  unsure (1)..(523): unsure at all n locations
  Clone ID: PAT_TA_96171
ggnacacattgtcacctcaaatnaagcaataaacctaaccaaatgtggtgtnctataaagtacctgataatcatgcctttncaagggatacanccancatagctcgtggatttctagcacgctcgtcttgcatgctgccctcgagggtccagcgccgctccgcggtcctcacaaattnatccatgacctctccaaaatgctcgactattatcggntcaaatatggntctcanataattcacaaacgagcttggggtggnagagcatgctgttcatatcanttgcagcgtcatataccccgcatatcgctgatanaaaaggagccctccgtcttgggntgatctccctcanctcttcaacaagagggtccntacaccggnacatanaaaagaatcnaacttcgctttgtcgatnacaacctctaanggcatgacacntntnaatctngnactaaaggtttccaaaaggnggaaggaaattttgggggnnttttacaataaaaagggcgcccctacaaagggaaa

SEQ ID NO: 96172 - DNA, 575 bp, Triticum aestivum
  unsure (1)..(575): unsure at all n locations
  Clone ID: PAT_TA_96172
gctttanctaccgagaagaagagagaaaaaaggttcgagtgcgttgcanagtgagaagagatggctccggtgaagctgtacggcgcgaccctgtcgtggaacgtcaccaggtgcgtggcggcgctggaggaggccggcgtcgagtacgagctcgtccccatcaacttcggcaccggggagcacaagagccncgaccacctcgccaggaacccctttggncaaggtgccagctttgcagganggtgacttgtacntcttcgaatcacgcngctattttgcaagtatgccgttgccgcaagaacaagccaagaagctgttganagggaggggcgacatcaagggaggtcaagcaaattgggtgngattgtgttggctccnaaggtggganggcccaatcaanttacnacccgcccgncttctggaggcccccaattcctccttccgagggtgccttatcccaatccctaatgccttgggggggaagccaacctgaccnaagaaaggntccatttganngaacaaacccttttttnaggntcaaagaaaccgtgntgggcaaantgtnaanaaggggg

SEQ ID NO: 96173 - DNA, 541 bp, Triticum aestivum
  unsure (1)..(541): unsure at all n locations
  Clone ID: PAT_TA_96173
gccagtagtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctangagctaatacgtgcaacaaaccccgacttctgggaggggngcatttattatataaaaggctgacgcnggctctgctccctgatccgatgattcatgataactcnacnggatcgcacgggcttcgtgccggcgacgcatcantcaaanttctgcccctatcaacnttcgatggtaggataagggggccctaaccanggtggtgaccggntgacgggcgaaattannggtttcnattccggnngagggaaggccngaagaaaacnggnttaccannttccaangggaaaggnaannagggcgcgccaaattaaccccaatcccgggcacnnggggaggtngtgggcnagtaaataacaaataccgggccnccattaatcgtccggggaaatnggnag

SEQ ID NO: 96174 - DNA, 559 bp, Triticum aestivum
  unsure (1)..(559): unsure at all n locations
  Clone ID: PAT_TA_96174
ggtcaacctcaccgaggagaagaaaggagaagcgagaaggatgtcggggcgcggcaagggaggcaagggtctgggcaagggcggcgccaagcgccaccggaaggtcctccgcgacaacatccagggtatcaccaagccggcgatccgtcgtctggcgcgtcggggcggcgtgaancgcatctcggggctcatctacganagagacccgcggcgttgctcaagatcttcctcnaagaaacgtcatccgcgacgccgtcacctacaccgancacgcccgcccgcaaagaccgtcaccgcccatggacgtcgtctacncccctcaaagcgccangggacggcaccctctaacgggattccggagggtnnggncaacaacggcnccaagaattangantggtctaagggntcgtggtctttngatgttatccncaatnatctncgcctggttgntttgcntaaccctcctggtagcaatgggaaattggaangggnaaatcccaatctaatttttatcccttntcaaaaaaaaaaaanaaaaanaacnccnagggggggggnc

SEQ ID NO: 96175 - DNA, 535 bp, Triticum aestivum
  unsure (1)..(535): unsure at all n locations
  Clone ID: PAT_TA_96175
ctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaacgctcagcacggaggccctcctcaagcaggtcgactacctgatccgctccaaatgggtgccttgcctcgagttcagcaaggttgggttcatcttnccgtgagcacaacgcatcccctgggtactacgatgggcggtactgggacaatgtgggaagctgcctatgttcgggtgcaccgacgccacacaggtgatcaacgaggtgggaaaaggtcaagaaggagtaccctgacgcgttacgtccgcatcatccggattcnacaaacaatgcgccaangttgcaattgcgtcaagcttcaatcgccttcaaggcaaccggggcttgcgaaggagtcccggcaaaggcctaaaacaagctcactcaacaacg

SEQ ID NO: 96176 - DNA, 537 bp, Triticum aestivum
  unsure (1)..(537): unsure at all n locations
  Clone ID: PAT_TA_96176
ctgcaagaattcggcacgagagtccatcccccgtcgccctcacgctcttcgtgctcgccgcctcccttcgcgtgctgcctcatgggttccatcgccggatctgccgtgtccttcgccaagcccgtcaaggnaatcaacacgaactcgctctctttctctggtccaaggaggggcaatgcatttcttcgcctgcagccagtgccgatgagatttgctgtttgctgctcancaaagcangatacagtggagaaagtttgtgaaattgttaagaaacagcttgctgttcctgaaggcactgaaagttgcggtaacaccaagttctctgaccttggagctgattcactgggacacggtccnagattgtgatgggcctcgaggaggagttccaanatnaagtgtggagggagaccaagtgcgcaaggaantgcgacagttgaaagaatgctgccacgcctcaatcgacaagccttgtctcctggcgaaagtcaatccntgaaagggagggccctnaatcntaatgattgggagctncgtaaa

SEQ ID NO: 96177 - DNA, 226 bp, Triticum aestivum
  unsure (1)..(226): unsure at all n locations
  Clone ID: PAT_TA_96177
agccctccctccctccctcccacgttccctcgccccccnctccacaaaccataccaanaacagccacccggttgacgcgangcaatcngntcgacgtaatatgagggagatcctgcacatccangngcggccaatgcggnaaacagataggcgcannttctgggaggtgatntgcggcgaancacggagttcgaccccaaccgggtcanntacacccgggacggtg

SEQ ID NO: 96178 - DNA, 508 bp, Triticum aestivum
  unsure (1)..(508): unsure at all n locations
  Clone ID: PAT_TA_96178
gccaccttctttggtatgcaacaaggaggattcaagagaccaaagtaactggggccaatgttgtagaagatggtttgtaagcacagagaaatttccctctgttctcgtcagtgttgcagtcatgcaaagaagctttggttagtgatgatggggcaaaatttgcagagatagaggcctttttactttcgagggtgagaagaagtctgagcaaaatggctgctctacatacagaattgacaactgcgaggagtcacatcttgaggataggtgttcttcgatagctacagggaatagacagaagcagagagctgatgatcaatgtacaaggagaggcagtggagaactgtgaccacttattttgccagttgaacntgcctctttgggaatggtcaccgcgtatttccntctgttgagatgaagcgggcgtatttcttctngttgagatgagcttttattcaagcgtgcccaactcccaaagaaaccgaagtgagctttttaatctttgatn

SEQ ID NO: 96179 - DNA, 501 bp, Triticum aestivum
  Clone ID: PAT_TA_96179
acagcatgaagaccacatagaataatgcattcatctgataggacttgtgttctttatgctgataggtctgtctctgtattcatgacttcatacgaacttgcatgtatctctgtacttattctgttcagcttttgcttgaatttccggtgaattttaactctttgaattacagtgtaatacctcttaatttctctgtaatttccactatatttgtagtgtaatattccccaggattacattgtaatatacataccccaaatttatattgtaatatcccccaagaatcacattgtaattctgaattgtattaaataatgctggaatacggtgtaatattcccccagtttgcattgtatgtcatgtaggtattacactggaattcatctcatttttccatgaatgtcatgagttgtccaactctgtaatttcccctgaagttcatgttagctacattgccatgtatcgcagcaaaagattttttcaagtgtactacaacacaaa

SEQ ID NO: 96180 - DNA, 242 bp, Triticum aestivum
  unsure (1)..(242): unsure at all n locations
  Clone ID: PAT_TA_96180
gaaactaaccgagaagagagaagcacacacacgcacgcagtagtgatcctgtgaggcgcgctaatggcggtgcaggaggaggagaaagccgccgggcaggcgcgcggggccgcacccgctgctgcgcgggcggaggcgggacggnaagtacacgcacgggctgcaccccggcgcagatggaggcgctccgcgccatgtgcggcgccttcatcccctcgctgccggccgangaggnggacgca

SEQ ID NO: 96181 - DNA, 456 bp, Triticum aestivum
  unsure (1)..(456): unsure at all n locations
  Clone ID: PAT_TA_96181
caccaacctcctcantcctcanagcatcctctcagtccttagcttccttccctcgccgccaaccaccaaggaaaggaggatgtcttgctgcnggggcaactgccgggtgcggcgccggctgcaantccggcaaacggctgcggcggggtgcaaaatgttccccgacgtggaggcnaccgccggngcccncngccatggtnatgcccaccgccncccanaaggggngntccggcgggttcganacnggccgggggagaccggcggcttgcgactgcaccaccttgcaaantgcggcaccgccgttcgggctgctccctgcttgcaagctgcaaactgaaccccggncncccaaagaaggnccggcccggncaanagggcnganccacgaaggattnagggagggaaaaancaaanccaagccaccaatcaccaccaagttcaaccnaccacccaagc

SEQ ID NO: 96182 - DNA, 312 bp, Triticum aestivum
  unsure (1)..(312): unsure at all n locations
  Clone ID: PAT_TA_96182
aattcgggggccagngtcgccatactgctggctctgctctgcttttgctctggcaccncttcctactccttccgcgacgangcggcctgtgnaggtgcgagtggnatggccatnccgggtccgggtaatctcctcanagccgaacaatctggcaaatgcnagnncattaaaatccactacgcgatcgccgccgcaccggtgaaacagctccgcccgcactgtcatcctcatnaagcccggagtctacanggagaaaatngtcntccccgtggacaaagccaanatancacttttcggcaccaacgccaaaca

SEQ ID NO: 96183 - DNA, 527 bp, Triticum aestivum
  unsure (1)..(527): unsure at all n locations
  Clone ID: PAT_TA_96183
gccacagctcctcctccatttccatctcagtcaaactccaagatgtccggccgcggcaagggagggaagggcctcggcaagggcggcgccaagcgccaccggaaggttctccgcgacaacatccagggcatcaccaagccggcgatccggcggctggcgcggcggggcggcgtgaancgcatctcggggctcatctacgaggagacccgcggcgtgctcaagatcttcctgggagaactcatccgggacgccgtcacctacaccgagcacgcncgcccgcaagaccgtcaacgccatggacgtcgttctaacgcgctcaagcgacaaggacgcaccctctacngattccggcgggntggacctgcgccccgcngctgctccatcgaagtcaactctgctgcatgctgctgttcctctgctatgcggtttcgtttcctgaagtgcnnttnggtttgctgtttccaatcctgtctgtgntacttaatgganagggcgaanggatctgaatgcaaatccnanaatttgtt

SEQ ID NO: 96184 - DNA, 511 bp, Triticum aestivum
  unsure (1)..(511): unsure at all n locations
  Clone ID: PAT_TA_96184
ccccagccaacctcccatccccgtctcgcgtcgcagcggcagttccactccctcgccatgggcaagattaagatcggaatcaacggtttcggaaggatcgggaggctcgtcgccagggtcgccctccanagcgacgatgtcgagctcgtcgccgtcaacgacccctttatcaccaccgagtacatgacctacatgttcaagtacgacaccgttcacgggcactggaagcacagtgacatcaagctcaaggacgacaagacgctgctctttggcgaaaagccagttaccgtcttcggcgtcaggaaccctgaggagatcccgtggggtgaggctggtgcccattacgttgtggagtccaccggtgtcttcactgacaangacaanggcgctgctcacttgaagggtgggtgccaaanaaagtggtcatctctgccccaaagcaaagatgcccctaatgttttgtgggttggngtcaatgaaggacnaattcnacctcaaaccgtttaaaatt

SEQ ID NO: 96185 - DNA, 509 bp, Triticum aestivum
  unsure (1)..(509): unsure at all n locations
  Clone ID: PAT_TA_96185
cccactgccagcctcagctcaaccgaagcaaagccaactagcacgcagcgcgcgatggcggccgcgaccatggcgctctcctccccggcgatggccggcaacccggtgaaggnctccanggcggcgcccttcggcgagggccgcatcaccatgcgcaagacggcgggcaagcccaaggtggcggcgtccancaacccgtggtacggctccgaccgcgtgctctacctcggcccgctctccggcgaacccccgagctacctcaccggcgaagttccccggcgactacggctgggacaccgcggggctgtccgccgaccccgagaacttcgccaaagaaccgggagctggaggtcatccactgccgctggggccatgctcggcgcgctcggcttgcgtcttccccgagctgctcgcccgcaacggcgtcaagttcgggcgagggcgtctggttcaaaggccggctcccaaatnttcancgaaggggggctcgactaactcngcaaacccaa

SEQ ID NO: 96186 - DNA, 481 bp, Triticum aestivum
  unsure (1)..(481): unsure at all n locations
  Clone ID: PAT_TA_96186
gcattactgggctcacccaccccatatntcatggctccccancgccgccancacgcggcggtgnctnctcatcctcctcgcgctggtgcgccgcgccggcccaagggcgggctnctcnctngccgggcanggtcatnaaatggnctggcnggcgngcggnccaacgcgatggcgantnggcgggacgaagttccttggtgcccgcaaaancaaatgnncctcgcggncggtcngggggtgggttgcgctgtcnggtgcgagcntcctacctgncgngcgggcgtgtgcgnngtgggacccccgtncccagccagcaggaatcaagaantaaactgctgccgtttcgncggganananggggcngcncagccccctaanngggtgtcnaaaccaatggggttggggacaanctanccggcgtcgncgcccngggccagangttggttgggcccttccctnggggtgggcnccantnggccaa

SEQ ID NO: 96187 - DNA, 499 bp, Triticum aestivum
  unsure (1)..(499): unsure at all n locations
  Clone ID: PAT_TA_96187
ggaggaccccctcatcgtgtggatcaccggcggccccggctgctccgccctctccggcctcttcttcgagatcggccctctcaaattcgacgtggccacctacaccgaggggttcccgaccctggtctacttcgaggactcctggaccaaggtgagcaacgtcatattcctcgacgcgcccgtcggcacgggcttctcctacgcgcgggaggagcagggcctcaacgtcagcctcaccggcaccggcgcgcagctcaggatattcctcgagaagtggatcgccgaccaccccgagttcacctccaacccgctctacatcggcggcgactcctactccgcctacctcgtgccggtcaccgcgctcgggatcgccaatcataatgatgcgggccacgcaagcggagggcanaagctcaaccttcagggctacctggtgggcaaccctggcacggacgaacaggtacgaacaccccgggcaaggtgctttcatgcacggnaa

SEQ ID NO: 96188 - DNA, 521 bp, Triticum aestivum
  unsure (1)..(521): unsure at all n locations
  Clone ID: PAT_TA_96188
cctcantcctcacaacatcctctcaatccttancttccttccctcgccgncanccancaaggaaaggaggatgtcttgctgcggcggcaactgcgggtgcggcgccgggtgcaagtgcggcaacggctgcggggggtgcaagatgttccccgacgtggaggccancgccggcgccgccgccatggtcatgcccaccgcctcccacaaggggaactccggngggttcgagacggncgggganaccggcggctgcgaatgcaccacctgcaagtgcggcaccgcgtgcggntgctcctgcttgcaactgcaactgagccggcgcccaagagggcggccggcaaaagcgaacacgaaggatnaaggagggacaaagcaaagcaaagcaacatcaacaacaattcaacaacaacccaacgtattaatcaacaagccgccgcaatgcgctcgcggggcgccgcgcgcttgaataaaataaaaacaacccgtttcgttgtttccgtaatttctgttaaaaaaaaaaa

SEQ ID NO: 96189 - DNA, 537 bp, Triticum aestivum
  unsure (1)..(537): unsure at all n locations
  Clone ID: PAT_TA_96189
ggctgcaggaggaaatccactccaatccaatccccacagaaatccccanctcaaaaccctagcccgtccgatnccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgaaaagggcgtcggcaagagcggcaagccactgcactacaagggcagctcgttccacccgcgtgatccccgacttcatgtgccagggcggggacttcaccaagggcaacggcaccggcggcgagtccatctacnggnaagaaagttcgccgacgagaagttcgtccacaagcacaccaagcccgggatcctctccatggncaacgcggggccccaacaccaacgggtcccagttcctcatctgcaccgttccctgcaaattgggctcgacgggaaagcacgtggtcttcggcgaggtcgtccaagggcaatggacntcnttcaagaacaa

SEQ ID NO: 96190 - DNA, 510 bp, Triticum aestivum
  unsure (1)..(510): unsure at all n locations
  Clone ID: PAT_TA_96190
gccactccctacggctccactgtgagctcctctacctcctccccctctccgctagctcgcccgcgctccgtagctgctcccccacgcgcgcccgaacgccgcgccgcggagctcgccgccggcgggtctccggtgaccaaatggtcacggggccaagcccgttgcactccccgccgtacgtagatgccccccccgcccatacgcttgctcgtttgcccgccgtaaccgcgtttccgtcgagcacccgtagcacctcgccgccggcgaagctcgtagcggtcgactccggccgttncaagcccctccgaccaacgccgttggacgcgcgacgtcgagccgcgtcgaacgcgcccanccaagcctccggagaacccctgtacgcgaaaaccgttaccctcccgagccgcgccgccgtgcgtctggtcgccggcgttgctccggngccgggcgccgacgtggnanaactgggggcaaccctgggtcactggcaatgggcccccacggggccaa

SEQ ID NO: 96191 - DNA, 263 bp, Triticum aestivum
  unsure (1)..(263): unsure at all n locations
  Clone ID: PAT_TA_96191
agtcaaccgacgcccggaccccccctcgtctcgtcatggcggccgcgacggcgacngcgacngcggcggaggaggaggcgcgcctgctgcggctcgaggagcaggcggagcacggcggngttttgttcttttattactcatccnttccccantcttcnctcccnccttttncttcccatctgttcantttctttacttctctcnttntttcgcangtnnttgacttcgnntttttcttttctttttnctttntantngtccat

SEQ ID NO: 96192 - DNA, 519 bp, Triticum aestivum
  unsure (1)..(519): unsure at all n locations
  Clone ID: PAT_TA_96192
ggcaaacaacagcacagactacatcgttattaagccacctattttttgcaatgatcctacttattccattctacatgtggataatagcataacactcaggtgtgcctgagatgtctgataaagcgatccattaccaaagaggttccatgaccacctacagaagttgaatgagcgacaatgtacacagcaaatatctgaattcnacgagagatttcagcgcaaagtagtgagatacgcccacgcacgtaaggtgttcgacagaagtgaagacgacgaaacagagcagaagaggcaccttgataccggggaatgacatgccgagctcctcctcngggatgacgaagggccacttctccccggcctcgcggaaaaactgctccggtctccaagaagcgggccgcngggcnaangatntgctcncgcaagccctgcgcggggggtngccgtccggggngancaaaaggcctcctccggcgccnttgaggtaggtgaccaaggaccccccgggggcggcttggg

SEQ ID NO: 96193 - DNA, 515 bp, Triticum aestivum
  unsure (1)..(515): unsure at all n locations
  Clone ID: PAT_TA_96193
aagaattcgagaccctgtcctacctgccaccgctcancacggaggncctcctcaagcaggtcgactacctgatccgctccaaatgggtgccttgcctcgagttcagcaaggttgggttcatcttccgtgagcacaacgcatcccctgggtactacgatggccggtactggacaatgtggaagtgcctatgttcgggtgcaccgacgccacacaggtgatcaacgaggtggaaagaggtcaagaaggagtaccctgacgcgtacgtccgcatcatcggattcgacaacatgcgccaagtgcagtgcgtcagcttcaatcgccttcaaagccaacgggctgcgaggagtccggcaaagggctaaacaagctcactcaccacgggccacatataaagtgccattgcggttttgtcaactctgacattgctttgggttttccttctccaattaacctttcctgtttggtcccaaaaatatgtgtttgtccaaggttcaagtnncaaacaatgtctccag

SEQ ID NO: 96194 - DNA, 618 bp, Triticum aestivum
  unsure (1)..(618): unsure at all n locations
  Clone ID: PAT_TA_96194
ttttttttttttgccgggagaaacccantttattgcatgtcacaaacattgtccactggnacaaaacgggcaagacnnntacaagctccaaaaaatntcacaaatcggcaccnatacatgggntgagtacattccaaagggcaacaaatacatcacaaaattgtgggtacaaggggccgccaagcccgtggagcaanaagaaaatgggagggagatcattttatgaacgaaaagaacacttttaatcctaagcctangcttcctccaacaacgggtaacgggccaacgggtttgattctccgtgtcccggttgggcttgcaaaaatcctcaaagcaaatgcaaaggnaactggctggccggctcttcttttgttgaagggcgcctggctggcnanaaagcaanangcccgtttcaanngcctttttctccctctcccttccctcctaanggcaaagttaagaagaaatccaaactatatcatccctggttggacaactccccnttctggtaggtccnaaaangtgganttggntttgtaaacctcntngttgtttccaaattaaaatccnttgagggntaaaacttttccnagggacccaaacctaatgttngttaan

SEQ ID NO: 96195 - DNA, 510 bp, Triticum aestivum
  unsure (1)..(510): unsure at all n locations
  Clone ID: PAT_TA_96195
ttttttttttttttgccaaaggcgtcataactggctttattataacattcacaaattttctcacaagtagtgcaccgaagtgagatatatttttattgcattggtgcatcatatgatccgatgatcgagcgatcctgatcttcaaggttccttggcgggaccatggccaccccacatcttctcgcatgcatggatacaatccggagcgcaagcggacggcgctggtgacaggccgcagatagagtcggtgcagcaggcgaccatgcaggtgacgacagggtccttgttgtcattgcagctgccgccgcacacgaccttgcagagcatcgggaaggcgttcttgcactctaagtancactttcggtagcagtcncaagagtgatcgaagaactgctgacgggatggccttggcagcatgaggagcaagagcatgcacaaggcggggattaacgccgctctcttcttcaacaacatctccctcctcgtgcaagcagtgaaaaaaaaaaaaaa

SEQ ID NO: 96196 - DNA, 509 bp, Triticum aestivum
  unsure (1)..(509): unsure at all n locations
  Clone ID: PAT_TA_96196
cggcgtccaaggaggccggcggcgaggcgaagacgaggggccggaagaagggcagcaaggcgaagaagagcgtggagacgtacaagatctacatcttcaaggtgctgaagcaggtgcaccccgacatcggcatctcctccaaggccatgtccatcatgaactccttcatcaacgacatcttcgagaagctcgccgccgaggccgccaagctcgcccgctacaacaagaagcccaccatcacctcccgggagatccagacctccgtccgcctcgtcctccccggggagctcgccaagcacgccgtctccgagggcaacaagggcgtcaccaaagttcacctcctcctaaaattgcatctgcattgcntgtatctatctatctatctatctantaacgactgtagctgggtctgttactttangtgcnttgtcgactcctgggttatctggaactacaaattggtattaatgctgggaaggggaatccaattgaatttgtgctccttccnc

SEQ ID NO: 96197 - DNA, 509 bp, Triticum aestivum
  unsure (1)..(509): unsure at all n locations
  Clone ID: PAT_TA_96197
ccgaaaccccatcttcccacacgctccaaccaccagcacccatggcacccaaggcggcggaaaagaagccggtggccacggccgagaagacgacggcggggaagaagcccaaggcggagaagcgggcgccggcgtccaaggaggccggcggcgaggggaagcagcggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgaagaagctcgccggcgagtccgccaagctggngaggtacaacaagaagcccaccatcacgtcccgggagatcaaacctccgtccgcctcgtcctccccggggagctcgccaagcacgccgtctccgagggcaccaaaggcgtcaccaagttcactcatcctaaggttcatccgtcgtcgttttaacgaatcgatgan

SEQ ID NO: 96198 - DNA, 359 bp, Triticum aestivum
  unsure (1)..(359): unsure at all n locations
  Clone ID: PAT_TA_96198
attgccgtcccctcggcggngccgctccggcgaccacatcacttccgctttctccacccatccagaaagcttgccctatccagaacacgctgcgccccctcgctcccggcaagagtcgcagccagtggctccgcaaccccggcggtacccgaggcagtacccaagcgaggcggtgggcgttgccgaggagatgcggttcgtcgccatgcgcctccgcaacactaaagcgcgccactcgtaataaggacaataataaggctgacggagcccgaggaggacgatnaatcccaaggaggaggaggtgggaggacaaacaacnagatggacgaagagggnaacnacnaaaaaatgtaattagg

SEQ ID NO: 96199 - DNA, 514 bp, Triticum aestivum
  unsure (1)..(514): unsure at all n locations
  Clone ID: PAT_TA_96199
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgaagttcaacaaggttgggttcatcttccgtgagcacaacgcatctcctgggtactacgatggccgggtattggacaatgtggaaagctgcctatgttccgggtgcactgacgccacacaggtgatnaacgaggtggagggaggtcaagaaaggagtancctgacgcgtatgtccgcatcaaccggattcnaaaaacatgcgtcangtggcagtgcgtcagcnttaatcncc

SEQ ID NO: 96200 - DNA, 468 bp, Triticum aestivum
  unsure (1)..(468): unsure at all n locations
  Clone ID: PAT_TA_96200
gtttaactccgacctagaactagaggccangcaggatatatcattgaacctaacacaaacaacatttctattacncaaatatcttttttttcttccatcaattttcagaatcatgttgatcatattatattcatattaaatccaatatatctccanttgatcatactacaccctaaagttctctagtttcaatctcctanaagngtgcatctaagtacanaatcataactatgattcanccaagcccattaacatggntatctaagtccagtatgaaggcaagcttccaactggggtgactantangatncagcnagatttttttcanagatcactatcatggtaagttaaatccaaaccttcaannaggtcctaaccctaaaagtcctccaagtttcnaagggttatttaaaggtttattttatcnanccangtatagtancannttcataaggtcctacccctcct

SEQ ID NO: 96201 - DNA, 407 bp, Triticum aestivum
  unsure (1)..(407): unsure at all n locations
  Clone ID: PAT_TA_96201
agccaagacaggtctacctcaccggagagaaaanaagagaagcgaagatgtcggggcgcggcaagggaggcaagggtctgggcaagggcggcgccaancgccaccggaangtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatgggntggtcntctacgcactcaaagccccangggactcaccctctacgggtttcggagggcttggccaaccaccaccanattatcngtgtctggggttcngtggtc

SEQ ID NO: 96202 - DNA, 269 bp, Triticum aestivum
  unsure (1)..(269): unsure at all n locations
  Clone ID: PAT_TA_96202
gcggcgcgcgcatangaggcgaatcancagcggaaccaagccgccggacgccaccatgggtatctcgcgtgactccatgcacaagcgccgggccaccggtgggaagcagaaggcttggaggaagaagcgaaagtatgagctcggccgccanccagccaacactaagctttcaagcaacaagacagtgnggagggtccgtgttcgcggaggtaacgttaagtggagggctctccgtcttgacactggnaacttctcatggggnagtgagg

SEQ ID NO: 96203 - DNA, 505 bp, Triticum aestivum
  unsure (1)..(505): unsure at all n locations
  Clone ID: PAT_TA_96203
cctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccgggcggctgcgactgcaccacctgcaagttgcggcaccgcgtgcggctgctcctgctgcagctgcaactgagccgggcgcacangangccgggccgggcagaaggcgagcaccaggatnatngaggangaaacaatcaatcatcatcaccaccaacaccaccccagcgntatcagtnacaactaanccncccgcaatgngncccccgcccggnnccaaaattaanataaanaccgncatgtttttctntaggtctgtaat

SEQ ID NO: 96204 - DNA, 571 bp, Triticum aestivum
  unsure (1)..(571): unsure at all n locations
  Clone ID: PAT_TA_96204
agctccatcccctcccgctanggttttaaggntttgagtccgggaaaccccncccggngacgaacaccaataacaccggggagctgaaatnggggacccggcngtgangtgcctccggggacgggccgnctcnangggnaagcaagcnccggggctgggcgtngagggctccctccaaatgctggccgctcccggggcgcggcaatnctccaangtcgcccgccgcccgttcgccctccaaacgcgggcccgccgggggaaaggcacaangccaangggacntngtggtncgntggcgttttgatncttanccccgggaagtttnccttggatatcatgctttcngcaacgggcctttgattcaaaattgcactgangttccaatgtgtttccggataanttggatttgctactccagacccaactggggggttggnaagnaaaaatattcgaangtcaagtcagcaancaangancaaacaagtgggaanacttgttctcancaanacaaaangacaccnatagcaactttcaaaaagtgttanagggatgnttnattaagttcttcntt

SEQ ID NO: 96205 - DNA, 387 bp, Triticum aestivum
  unsure (1)..(387): unsure at all n locations
  Clone ID: PAT_TA_96205
gagacgctcccggggctcgacctcctctacgccgtcgncgccaacgccaaacgccnggggctgcgcccggcgcggccagtcaccaatgctcctgcggcgcctcctcggaggcctccgagccgtcgcccatcggggagccncctctccatactctccccagatgaacccgncgngagacgggtgaaaatgaanggctgaagnagtggggcncanggtggtgggcgcttgtcatgcgcatcccgctcctngaaccaaatccacccaagccantgaaacggccaancgtgcaaatggcataaccgaatntcagngggnaggggacaaacaanccaaggcaggacggcangaagnanaaagaatcattcccccccaatccctggcttcgaa

SEQ ID NO: 96206 - DNA, 516 bp, Triticum aestivum
  unsure (1)..(516): unsure at all n locations
  Clone ID: PAT_TA_96206
ggcgcctccacttctctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaggacctgtacatcaacactgcaatccangatggatgttgttggcaacaggaaggccgtggtgatccatgtgcccgtaccgtctgcgcaagcccttcaggaagatccatgtcaggctcgtcagggagctggagaangaagtttatcgggcaaggatgtggtctttgttgcaaacaaagaaaggattggtgaggccacccaaagaagggttcttgctggtttcaagcgcccctccgcaaccaaggaccctgaaccagcctgttncatgaatgggtatccttgggngggatnttcgtgtcccccagnctgnagaatggngggggaanacgt

SEQ ID NO: 96207 - DNA, 497 bp, Triticum aestivum
  unsure (1)..(497): unsure at all n locations
  Clone ID: PAT_TA_96207
gggaggcgagccgtggctcaggaagttcgtcgatgttctaatccgtggaacaggaaaaacactttcctggttggtagtagtaactacnangtggaggggtggaagtgctctgctacctgtaggcactccattgtaccatcagcgaggtcgggtctcctgggatctcagccaccgtgggaatgggccgtcgccgatgagcaggagatagaattcctgatgcagccaattaaaagattcacggtgcttgaggaggtcaatgatagcgatgtcccgatggcgccctgcattagcccgtcgccggcgtcggcgaagctgcagcacgcggcggccccagagctgagcagggacggacaaatctgtgcgacccaagcagtggtggcggcagactggcagaaagggaaatttcaccccaaaaggcttgattaatgaacctagaaaatccctggaattgggttccactaagcgtccgagctcctccaccggcaagatgaaccaca

SEQ ID NO: 96208 - DNA, 296 bp, Triticum aestivum
  unsure (1)..(296): unsure at all n locations
  Clone ID: PAT_TA_96208
gtcctgcgcaggggacgacaccgccacctccttacattcattccctgctaaaatagtaagtggcttgttctgtcagttacatatatcctgaactctgatatgcagtagtcttcataaggagttaccttggaaccaggaaagttgctttaatttttgttgatatgacgacgaaaaaaataatgaatacaagaactttttgtctggngaaaaaaaaaaaaaaaaaaaaaaaaaanaaanaaaaaaaaaaaanaaaaaaaananccggtggggtntnnggtgggcaaaagngnccaaat

SEQ ID NO: 96209 - DNA, 375 bp, Triticum aestivum
  unsure (1)..(375): unsure at all n locations
  Clone ID: PAT_TA_96209
ccgggcgagcatgaaggncctcggcgcgcacgcctccgacctgctccgcgggccgcacctcgtccgcgccgccgtgctcttcctcgcctgcgccgcctccttcctcgtcggntaccgctggtccgacgcctccgcgaagccccctcttcttctcgtccgtcttctccccggcgtccccctcctcccgcatctcctctcgctccccttccgtcgccatctcgcccaactccaacatctccttcgacccatccctaatccccgcccccgcagttgctccgcccgcttcgtccantccaatgcctcgccgccccctccaagcggcaaactccgtcgcccccgccaacggcctccaatgccgaactcccggntcgcccc

SEQ ID NO: 96210 - DNA, 496 bp, Triticum aestivum
  unsure (1)..(496): unsure at all n locations
  Clone ID: PAT_TA_96210
ggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgtgcggctgctcctgctgcagctgcaactgagccggcgcacangaggccggccggcagaggcgagcacgaggatgaggaggagaagcaagcaatcatcatcaccaccaacaacacccancgtatcagtaccactagccgcccgcatgcgctcgcgcgcgcgctaaataaaataaaaccgtcatgtgttccttagttctgtacgaacaagtgtccctcctcaatgcctccacttcctaaagaatataatggcgcctcaactttgaacgaaaaaaaaa

SEQ ID NO: 96211 - DNA, 501 bp, Triticum aestivum
  unsure (1)..(501): unsure at all n locations
  Clone ID: PAT_TA_96211
gctccaccaggcccttggggcagatncgtctccctgtcaccttcgggacccgcgacaactaccgcaccgagctcatcgacttcgacatcgccaagatcgacctgccgtacaatgctattttgggatacccggccttggcccagtttatggctgcgacccaccccgcgtacaacctcatgaagatgcttggcagcaacggcgtcctcacggtggcgggggacaccaaaggcgcgctgcaggccctcaagctcaccttcangacagccgcgtctgcgctgcccggcgagaaaaanggtcaggaggncccanaagcancgccggccaagaanaancanttgttntcccnagaccgagccganacnaaacaagtgcangtctgtgaggatgggacgaccaaccccaccttcnacaaaaggggtgggctccctcaaggtcaagaggggacattgattnaattttttcagccaacaaaggatgntttnccttgggnancaaaananc

SEQ ID NO: 96212 - DNA, 496 bp, Triticum aestivum
  unsure (1)..(496): unsure at all n locations
  Clone ID: PAT_TA_96212
gccacttttccctcttgcaaatatagtgtagactaggcataaagcatctagccaactgtcaagagcctcccagctatcagcaaccaagaacctaggtccatgaacagtatctacacaaagaccagcaccaggtggcaatgttagatcagcggatgctgacacagaaacaatatcctcaacagctattcgggtaggctttcttcctctgtccattgattgtgatggaggctggccagaggcatcggccttctggagtccctcatggttcanaacaaactgtgacctctcccaatcagtgtgtggtgcaatggcattgttggctggaggagcggtcaaatatcccactttgaggtatggcaaaagnaacatcaancggactaatcgcaaagcactgcgatagaccgagtaacttggtttcaatgcatgagcagntgcaacataaataagcagactgactgttaagctcattaagggantacgtctgggctcccanatt

SEQ ID NO: 96213 - DNA, 496 bp, Triticum aestivum
  unsure (1)..(496): unsure at all n locations
  Clone ID: PAT_TA_96213
gcgacgagaangccatgacggcggcctccgtgtcccggtccagcgcgcccctgttcccgaagctgaagtcgtctcgctccacgttgtagtcctccctctccttggctccatccattttgcggggggacttggcggccgccgcgtcgttgtagtccggcgcgccgccgccgaagacgtccgacaccggcgacgcgctgganctccagacgaacatgtggaggtcctcgcccttggcctgtccgttcgtggccggcttctttggtcccttgggcgccgcggccaccgccgggttcggcgcggggtagtgccccgccccgggcgccgggtgcttgggcttgggcgcgtcctcctcctaattggacgggcgcggcgtggcgccggtgccngatgccgtacgccgtcggcggcgccnaaagttggagctccggccgaccaatggagtaaaagtcggtgttgttgaactngagcccctggggntggggttccgcgaacaant

SEQ ID NO: 96214 - DNA, 501 bp, Triticum aestivum
  unsure (1)..(501): unsure at all n locations
  Clone ID: PAT_TA_96214
cttcactcanacaccaactaagcccacggngcaagcaaactagctagtttctgccatggcagctccccgtgnccacgccgccgcgaccttggccctgctggtggcggcgcttgtgctgtctgcgggaacggcgccggcggagggtgcggttgcnaactgcnggcaagtggtgagctacctggccccgtncatcanttacgccatgggcaaggtgagtgcgcctggcggtggctgctgcaacggcgtgcgttgccttaacgccggnggntgccaaccccgcccgaccgcaagaacanctgcacctgcctcaagcagcaagcgagcggcataagcggcatcaaagcccaaacctcgttcgctggcatcccccggcaagttgcgggggtcaaanatcccctaacgccaatcaagccaaaggaaaccgatttgctccaaanggtgcgtttaagccgttgagattaagaancaantttcaaaatgcatggtgaaaaacgaaaatna

SEQ ID NO: 96215 - DNA, 446 bp, Triticum aestivum
  unsure (1)..(446): unsure at all n locations
  Clone ID: PAT_TA_96215
ggccgctgccnctgccgccctgaccctcnccgctgnagganacaccaccgcgcaaccatgggtatnnacctcntccccngcgggcgnaacaaaaagaacaagcncacggagnccaaatccgacnangtgtatctcaagctggtcgtnnagctctatcgnttcctngggggggggnacaaacaacanttcaatcncctgatnctnaagcgtctcttcatgaacaaagaaaaacaaccgccgctctctatgagccgcctcctcaggttcatttaagggggaaaggaggcnaacatntctcgtncttgtngggnaccancancnaatgaacaaaaaggtnnaccanataactgcaatgaaanggggggcggcgctcaaggtttcatccaacacgggcgagggggcagggaatcgtccaatgntnggtgggggagggnggctttaccttt

SEQ ID NO: 96216 - DNA, 493 bp, Triticum aestivum
  unsure (1)..(493): unsure at all n locations
  Clone ID: PAT_TA_96216
gngcctcccactgncagcctcanctcacccgaagcaaagcagctagcacgcagcgcgcgatggcggccgcgaccatggcgctctcctccccggcgatggccggcacccggtgaaggnctccagggcggcgcccttcggcgagggccgcatcancatgcgcaagacggcgggcaagcccaaggtggcggcgtccaacagcccgtggtaaggctccgaccgcgtgctctaactcgggccgctctccggngaacccccgaagctacctcaacggcgagttccccggggaatacgggntgggaaaacgcgggggctgtccgccgaacccganaacttcgcaaagaaaccgggaagctgggaggtcaatcaactgccggctgggccaatgctcggcgcgctcgggntgcggtctttccccgaagctggttcgccccgcaaacgggngtcaaagtttcggngaaggccgtcctggntcaaagggccggnttccaanatn

SEQ ID NO: 96217 - DNA, 425 bp, Triticum aestivum
  unsure (1)..(425): unsure at all n locations
  Clone ID: PAT_TA_96217
cgggactgtggagtctgggaaaatgaccaaagaccttgcactccttgtccatggntcctcaaaagttacaagaaagcgattacctgaacactgaagaattcaatgacgctgttgctgctgagctcaaatcaaagactggtgaaagacctcctccacttcaatgcttgaatagtcaatactcatcnattcaagtcaatttgggtatgtcgccaatacctgtcaagctttcaattgtgaacaaaacgaagcttttactggaacancccaatattatggtcaaacatgcaaaccaattctgttanatgcctgatgttatgttaagtggggggcncaaaaattaaggggcattttnnaaaccaattattcaaaaaaaaaaaaaaaaaaaaaacnccnaagggggggggcccggtanccaaattcccccc

SEQ ID NO: 96218 - DNA, 500 bp, Triticum aestivum
  unsure (1)..(500): unsure at all n locations
  Clone ID: PAT_TA_96218
gggagatncgcaagtaccagaagagcacggagctgctgatccgcaagctgcctttccagcgcctggtccgcgagatcgcgcaggacttcaagacggacctcangttccanaagccacgccgtgctggccctccangaggcggccgaggcgtacctggtggggctgttcgaggacaccaacctgtgcgccatccacgccaagcgcgtcaccatcatgcccaaggacatccagctcgcccgccgcatccgtggcgagagggcctaagctggcccctccgccgacgccgttagtgagtccggaatgagttgattcctgggttgtaagtttgttcctaaattgctgtgctaagtctcctctgcttttgggtaanaaaaaatatgggntggntgggnacaaagcaaagacnaacctttgtttangtgaaggangttaacctttggggtttgccgaatgaaagcaaaaccgtatggttaaaaaaaaaaaaaaaaaaaaaactccag

SEQ ID NO: 96219 - DNA, 498 bp, Triticum aestivum
  unsure (1)..(498): unsure at all n locations
  Clone ID: PAT_TA_96219
ccctgacgggcaagaccatcacgctcgaggtcgagagcagcgacaccatcgacaatgtcaaggccaagatccaggacaaggaggggatcccgccggaccagcagcggctgatcttcgccgggaagcagctggaggacgggcgcacgctggccgactacaacatccagaaggagtcgacgctgcacctcgtgctccgcctccgcgggggcatcatcgagccctcgctccangccctcgcccgcaagtacaaccaagagaagatgatctgccgcaagtgctacccaagctgcatccaaagggctgtcaactgncgcaaagaaaaaantgtgggcaaaacaaacaactgaaggccaaagaagnaagatnaaagaactaaaactccgtaaaaancgtttanttgccgcctttcaattgtcctggataaaatctttaaacaataaaaatgnttccnggggttaacaantttgccggcncaaagtcaagggatgttgnaacctt

SEQ ID NO: 96220 - DNA, 552 bp, Triticum aestivum
  unsure (1)..(552): unsure at all n locations
  Clone ID: PAT_TA_96220
ccaatccaaccgaactcctcncgaatcccaatncccgcangcctcctcctccgggcccgccgncgcctccccaaanggtttaaagttnttcaaagatggnacaaaaagaggggggtttccaacnngccggaggggcccnatcccaatgttgttaataactgtgggttcctttggaacgnccgcgaaccaatgaacaatttgctccaaagtggccacaaaggagaatgtnaatgaaggganggagcnaaggccaaagcttggctgcctcctcctttcgaataacaatcnncaaacnggttggcgaatgggtngggaaaagcnaccttgnttgtttgccggcttgttggcccgccnaanccccnaaaaggtgggccgggtttgcttcaaagtttgaccnntgaaaggcgcctttgtttgtgcaaccctgctgctngaatnnttgcaaggancaaaccaaaancntgnttgccnttgaagccccccaagaggaaaggggggggccccaaattccggnttcccaaactttcaangaaaaaaggggttttgnctctt

SEQ ID NO: 96221 - DNA, 409 bp, Triticum aestivum
  unsure (1)..(409): unsure at all n locations
  Clone ID: PAT_TA_96221
agcccagctcccctctcctcgcctcctcaacccgtcgatccatcccgagctcgtcccgtctcttccgatggcgtccaagcgcgctcctcctctgctccctcgtcgccctcgccctcgcgggcggctccgacgccagggaccacgtcgtcggcggcggcaaggacggcgcgtggagggtgcccgcccccggcgcagcccgacgcgctcaacgactgggccgggaaaggccgcttcacgtcggtgacaanctcgtgttnagttcaacgcggcgaacggactccgttctggaggtgacgccggccggactaacnaccggtgcaacaagggcaagccccatccgccanctanaanggcaagcgggggcggttcnttgcccgctgccgcccaaangggngcccgctttccgcta

SEQ ID NO: 96222 - DNA, 250 bp, Triticum aestivum
  unsure (1)..(250): unsure at all n locations
  Clone ID: PAT_TA_96222
tttttttttttttttttagaccacactcgcgaattgcgatgcaaaagcttacatcttatccatattgggcgcatttcatggaactgtttcacactactagccgccgccccgtaatcaagtagtagtccagcaggccgtgaaaatatgcgcggagcgggatnacaacggnagcggttgcccatccgccaaggcctttgaagacgaaggaaccggggcgnactcnaagcttgaagtatnatgaancctcccc

SEQ ID NO: 96223 - DNA, 476 bp, Triticum aestivum
  unsure (1)..(476): unsure at all n locations
  Clone ID: PAT_TA_96223
gnaatccaatccgcacanaaatccccatctcaaaancctagccctcatccccgatnccggngagcgagatggncaacccnagggtgttcttccacatgancgtcngcggcgcgccggcggggcgcatcntgatggagctgtacaaagacgcggtgccgcggacggtggagaanttccgcgcgctctgcaccggggagaanggngtcngcaagancggcaagccgctgcactacaanggnagcgccttccaccgcgtgatnccgacttcatgtgccanggnggngacttcaccaagggnaacggnaccggaggngagtccatctacngngagaaattctccnaccanaaattcgtncacaaacacaacaagcccggggatttctccatgggcaacgccggggncaacaacaaagggtnccaatttttcatctggaacgtcccctgcaatttgggtccacngnaaacnaatggtcttn

SEQ ID NO: 96224 - DNA, 473 bp, Triticum aestivum
  unsure (1)..(473): unsure at all n locations
  Clone ID: PAT_TA_96224
cccaccagcagagacgaagatnccacgaggaaccgttgggatctanctaactagctcntcncgatgattaccgggaaggacatctaccacntgctggnggnggtggtgccgctgtacgtggncatgttcatggcgtacgggtcggtgcggtggtggggcatcttcacgccggaccantgctcgggcatcaaacgcttcgtngccgtcttcgcggtggcgctcctctccttccacttcatctccaccaacgaaccctacgccatggactaacgcttcctgggcgccgactcgctgcanaanntcgttatcctcgccgncctcgccgtgtggganaangtgctctcccnccaacggtgcccnggggganagaaggcggcgaaggctcctcnctgggctgggacaacanactcttctccttggggaaagtgccaaaanactggngaaggggaatccccctgctgggcgcaagtatg

SEQ ID NO: 96225 - DNA, 476 bp, Triticum aestivum
  unsure (1)..(476): unsure at all n locations
  Clone ID: PAT_TA_96225
gagaactagtaccatcgacacaggaaggaaaggaatatagctaaccgcttctcatggctcctaccaagtagcaacgctcgggtcttttgtctggtggctctcctgggtcatgtctaccaccttcttgtcctgtgatgcancangtgggtggacgaagttctgcgtacccgagaaagcctgccagaccccaacaggacttcagggcgactatgtgtgcaaggttgactgcggacgccaaggntatgatgaggataaaagccactgcgggagtgggcatttgctgctgtgaaaagtaatataaaccgtcaatatgttttgttatgtgctggaacgatttcncgtaagtgaggggagacttattttctatgcacacctaagnttagttcatacaaaaacaatcaagtaaactgttatgggtgtattcctgagaaaaaatctgccaatgggtgatnaaaaaaaaaaagggggggccggtn

SEQ ID NO: 96226 - DNA, 443 bp, Triticum aestivum
  unsure (1)..(443): unsure at all n locations
  Clone ID: PAT_TA_96226
ggctgcanggcgccaatcaaacaaactacactcatncantcaagcaaaagctancggngtaataactcacttnantccantcggcatgggggctccnaggggtgcggnactggtgctggcgatggtgctcgncggccatggtgggtggcgccgccgggcgactgtgcaacgccatatcctgctccacggtgtnacagcaagcctgattgccgtgnctgcagttacgtttcancaagggcgggttccccgggccgggggcttgctgcaccgggnatccaaaaacctgctgggccgagggcaaaaanaagccccggaccggccgnaacaattcttgnggggttgccttcaaagnaacgtccnccaaacngggngccctcccggggggggccctaaaattaaacccggggncgggcggggggtttcccctccaaagttggaaaacg

SEQ ID NO: 96227 - DNA, 452 bp, Triticum aestivum
  unsure (1)..(452): unsure at all n locations
  Clone ID: PAT_TA_96227
gcgggtgggggggcggctctaanaaataatgggnttccccccgggctgcanagaaatnagggaaacggtataaggaggggggcgacctgttnaangncaccggncgccatcaaaacccncgaggncgggggngagcccncgcaaaaatccangccggggncgccanccactgctgtttctggggcaatgttggccgttgcgccnaacaacggngcaagcggngggggngccttctggatgcanccggcatggggcttccgngccgggaacanagtgcaagcgccgctgcaattcatttnaanaaacanctttcccggggggatgggngacacaaatctcnggatgntcgcggggctcaaatcctgggggcgctccaacgggggggagcaacancaacaacnacaaccgccnnncaggaggagggagggganggcaancctcccccanaatgg

SEQ ID NO: 96228 - DNA, 510 bp, Triticum aestivum
  unsure (1)..(510): unsure at all n locations
  Clone ID: PAT_TA_96228
gcacgcgctagctccttgtgtcgagaatgtttcctcctgctggtggtgttggtgctggagctggagctggcgcgtggcaactgcancaagggatgggcgtgcgcgcggtggcggcggcggacgtcntcctcgggctggcangggcgccttcgcgctctaanccgtccgcctcaaaccgggaaaattcctgncgcaanactgatacgcgctgangtccgcgaaactgcggcgncacgccgcaacaaggagtgggcacgcgccttccaaggggctggtccgtgctcctcaacgcgggngggcgcaaggcgggcaacggccggggcgggcttgggtgattcccgaacggcgtttcggccgccgggaatgggccggctcctccgctaatcnttcggcgcaangctcctccggtgggtttcaaacgcctaacgcccttctaactaacgttcgttccgcnggggggtgggccggccgtcaaccnttggggcctcctgcaatgggcnaaaccccgaa

SEQ ID NO: 96229 - DNA, 492 bp, Triticum aestivum
  unsure (1)..(492): unsure at all n locations
  Clone ID: PAT_TA_96229
gtggagatnaacccaatcccaagcggaaaataaatncacaaaacgaacaagggttccaatggaaacagctgcaacgaaaacaaccactcggccgtcttctaaaatgctcataattcatttgctctcgttttaacgacttccctagtacgtatttcaaaggacgcactggatgccgtcatagctgataaaagacttgtgcttgatcatctggagttcggacgatnctccgtgcaccacctccccaacaagaaactccanacaagaactccantccggtgagcacaacancgggntgggttgtcctccgtgtctgggtccccgatgtttgaagaanttggttatgcnaaacnttgccgcgcccaagtacaagaagntggaacctcaatctggaaccaatcctcaaggggggtcaaaggtcctggccantccttggaagcaaacttttggnngcccccgttctaaggttgggnggagggncaaatggcnggaaaa

SEQ ID NO: 96230 - DNA, 336 bp, Triticum aestivum
  unsure (1)..(336): unsure at all n locations
  Clone ID: PAT_TA_96230
gatcttctccantcctattctactcaacccctcgccgccgccgccgcagatngcaccaccgaccgaccgaagcgatggccgcctccaccgtcgcgtccaggggcgtggncgtcctcgccgtcctgtcggtcgccgccttctcngtcgtcgccgctcangagggcccggcgccgagccccgtgtctggcgcccggngcancgggggccgtcctcgccgccgcgctncgtcggcntccgggggccnccttcctcttcnccgccgttccggcaattgaangcgggcggctccggcctttccccgaccgtcgcccgtcgaatgggtnaatcctcctanaa

SEQ ID NO: 96231 - DNA, 475 bp, Triticum aestivum
  unsure (1)..(475): unsure at all n locations
  Clone ID: PAT_TA_96231
ctcctctgcccacaaaancctagccgtcgtctcacaagctcgccgccgacgcaagcgagctcttcctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcanaacgtgcttggtgagaagggccgcaagatcagggagctcacctccgtcgtccaaaaacgcttcaacttcccgggagaacggngttgagctttacgccngagaaaggtccgtcaaaccgttnggctctggcgccaacgcccaaagcttgagtcanctccgctaacaaagctcctcngganggcctttgcccgttccgcaaggggaatggctnatggggggttcttcc

SEQ ID NO: 96232 - DNA, 491 bp, Triticum aestivum
  unsure (1)..(491): unsure at all n locations
  Clone ID: PAT_TA_96232
tctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcaaaggagacnaaggagcccgagccagcanctgcggccgaaccggaggccgaggcgcccgccgtggtcnagacagagaccaangangccgtggctgangcaaaaccngcggcggncgaaggangttaaagaanaagcggngccctgcttcccaaggccaaacccggcgctcccgctgctgctgaangaaacaacggtggaagcaanccccggccgccgttggcaaac

SEQ ID NO: 96233 - DNA, 333 bp, Triticum aestivum
  unsure (1)..(333): unsure at all n locations
  Clone ID: PAT_TA_96233
gcaaagtgtacttttgccgataataaatcatccaggaggnatatcatgatcaattgcattggntcactgacaagagaaaacacattaactacaccaaagaccaacaagttgcnaccaagggacacttttattttcantaatgggngcgctgcnccaagtcntgacatagagcgctacttccgatttatgnaaaagaaacaagtgngcaagatntctctccacaagnacagggtccctcgccnantttcaaanaaaacacccttaaagngggcntgngcccccnccgggttctctgcnatcaacatganacttnatgcgccncaaaattcccat

SEQ ID NO: 96234 - DNA, 478 bp, Triticum aestivum
  unsure (1)..(478): unsure at all n locations
  Clone ID: PAT_TA_96234
tggngcctcatgacactctggtcgtggtgacgccgcctgtcccctcggtcgncgggcgnctcctcatccnggttggcaaggggtggtgggccgcaccccnatgcctccctgcccatgccttggnttcctgcctcccaaaggntgggtccgacatcncttttggttaaagcatgcantccaacgtcagcanctgctactgctccgtcagcanctgccggcacccccgttcaaaatctcctgctgaccggtctccccgtgtanaccccaaattttcaatttannatattatacattaaatnatcattgcatatcaagttttanttgcaattttggctcgatcctacaaatttttttnaacccaaaggaccaaccgagaagaatttgngaaaaaaaaaaaaaaaaaaaaatccangggggggnngggtacccaaatnaccccanaaatgagtccgtnttaatcncgctcantggnccgtcg

SEQ ID NO: 96235 - DNA, 486 bp, Triticum aestivum
  unsure (1)..(486): unsure at all n locations
  Clone ID: PAT_TA_96235
gncacctgctgctcnccgtccggaacgacgaggagctcggcaagctgctggccggcgtcaccatcgcgcacggcggcgtcatccccaagatcaaccccgtgctgctccccaagaagacggcggagaangagggccaaggcgcccaagtcccccaagaagggcgccaagtcgcccaagaagggcgccaccccgaagaaagcttaagaaagatgcgctctctgtcgtttaagatgtgtgctgtgtagtgttcgtctgaataatgatgtgaangngttccgtcnaattgtttgatgtacccgtgtttgtgtttangttcaangggaaaaaattaattatctctcaaaaaaaaanggggggggccgggtaaccaaattcccctaaaangtgaagttcctnttaaccccnccctcnactgggccgtcgtttttnnaacgtcctnaactngggaaaaacccttggnngttacccaaanttaatcnncctttg

SEQ ID NO: 96236 - DNA, 478 bp, Triticum aestivum
  unsure (1)..(478): unsure at all n locations
  Clone ID: PAT_TA_96236
gagttgcagagcccaatcaaaacatattgaaatcacactttacattaataagaagtcaaatgtgtgcacaaacattgcacttattacatgaatacatatgatgttcgatacagaggaaagccacacaaattcaaatccaagcatagatgcgaccatttatgcccagtcagagtcacaaggcacccatgtgaagaaagtaaacacacatacttagttgtncagcagaaagaaattaacatacaagcagaacagattgcaatccacactagcacacgcaaaccacactatgggatcaaaggagaagagggccttccagcgtcgaacctgtttctttccagcagaaagagaatcttgcagcatcgtcgtcgtcctcttgttcancctccttttgctcagtcttaaagtttttggtccataagtttaagggtaggcntggttttatgcttttcaatggcctcncccacctcaacggggggag

SEQ ID NO: 96237 - DNA, 493 bp, Triticum aestivum
  unsure (1)..(493): unsure at all n locations
  Clone ID: PAT_TA_96237
agcccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgacaagaaggggaagaagaaggccaagaanagcgtcnagacgtacaanatctacatcttcaaggtgctcaagcaggtgcaccggacatcggcatctcctccaaggccatgtcatcatgaactccttcatcaacgacatcttcgagaagcttgccggcgagtctgccangctcncaaggtncaanaaagaaagcccancatnaacgtcccggggagattcaagaccttccgttcgnctcctccctccccgggngaagctcngccaaggaacgccgtcttcgnngggnaacaaagggcgttcaccaaagtttaacctccgtnctaaggctcctcnntt

SEQ ID NO: 96238 - DNA, 234 bp, Triticum aestivum
  unsure (1)..(234): unsure at all n locations
  Clone ID: PAT_TA_96238
agacgccgtgctcctaaagctccaaggcaactcccaactcgtctcgtcgtcgttctccgccgcttcnaaacctcttgcactggacgaggggnccggtccantggacgangaactcgcccgccgcctcgangcgctcaagtcccgcccgccggngccgaaacgggcaagtgctgcccccgcccctananccggcgggatggacgagatggagggcacgttcgcggcgctgaaaag

SEQ ID NO: 96239 - DNA, 351 bp, Triticum aestivum
  unsure (1)..(351): unsure at all n locations
  Clone ID: PAT_TA_96239
ggcacgggggtancccatcgctncgccgncngacnaatccctctcanccccatcagnttcgccgccgcacgganaaganaccatgcnaaacagcgcgttccacaangaatgatggaggcggggctcntnttgngtctggcgcncaccancttctnangatncatccgaacggattttaanntacggtgttggtgggcctcctccccggcgnagngngaggtggattccgggggcttcanangccggattcaccacgtttgnggtgaccacccntgtggtccgggggtgganagggagannagttnagcgcncccacgtccangcaggnaccgggggtccctgggggggatc

SEQ ID NO: 96240 - DNA, 547 bp, Triticum aestivum
  unsure (1)..(547): unsure at all n locations
  Clone ID: PAT_TA_96240
acaatccaatccaatcccccgagagagagaagaggaggaagatgtcgggccgcggcaagggangcaangggctcggcaagggcggcgnnaagcgccaacggaaggtgctccgcganaacatccagggcatcaccaagccggcgatccggcggntggcgcgcatggngcggcgtgaaacgcatctcgggggctcatctaccangagaccctgcggtgttgctcaagatnttcctccgagaacgtcatnccgccgangccgttaactanancgatgcacgcccgcccgcaagatctgtnacccgccatgggnacgtcgtnctatgccnctcaaagcgccaagngccngcaaccctcttactggatttcngcgggctaaaggcccnaagggncccantccgttcnaagctcgccaaagcccggccgttccgaccggagaagttnntcactngggtatcctatcctanntttgctgtctaagnggttcntnggctcctccgttttttgnncaaatgtttttcccttgggtngtntgttctgnctccccttg

SEQ ID NO: 96241 - DNA, 435 bp, Triticum aestivum
  unsure (1)..(435): unsure at all n locations
  Clone ID: PAT_TA_96241
cggggccgagctcnatgccgcccaangggtcgaaaaangacggngagccggnggngcgccccatcctcgggngcttntcctcccacctcaagatcggaatcnttgggntanccaatgttgggaaatcaactttcttcaacanantaacaaaattgtccatcccggnngagaacttcccattctgtnccattgaaccaaatgaggnacgggtacatgttccggntgagcnatttgactatctttggcaacttttcaaancaaanagtgaggnggggtgcatatctgggaatcaacgacataaccgggcttgttttaggagcaagtgcangggagggtctggggaangccctcttatcccaaaatacntgctggttgntggggatcctttcatgtccctgagagcatttttgacaccggaatcnaccatattgggtt

SEQ ID NO: 96242 - DNA, 471 bp, Triticum aestivum
  unsure (1)..(471): unsure at all n locations
  Clone ID: PAT_TA_96242
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgaagccccgaaatgtggcgctgcgcggatatgaaatccaccgtcgacggcacctgcggtgggaccctgcaagaagtactgatcggttcatgccgggnatgatatgttccgnctaaaaattaaaataaaaagctcanggngaagatggagcaacgtcatcgtgcctnatgccgtgtgtgtggtggccaaacaaatgncttanaccaantatgttcgtccn

SEQ ID NO: 96243 - DNA, 470 bp, Triticum aestivum
  unsure (1)..(470): unsure at all n locations
  Clone ID: PAT_TA_96243
ctcaatcccactcgcgcagcagctccaagaggatcgtcagccatgtctgggcgcggcaagggaggcaaggggctcggcaagggcggngccaagcgccaccggaaggttcttcgcgacaacatccanggcatcaccaagccggncatccggcgcctggcgaggnggggcggcgtgaancgcatctccggcctcatntanttggagacccgnggtntnctcaagatnttcctctnnaacgacatccgtggngccgtcacctacacggngcacgcccgccgcaagaccgtcaccgccatggacgtcgtctacgcgctcaagcgccaggggcggcaccctctacgggcttcggcgggtaaggncgcnccagatggtcctcangtcctcgnccgccgcctgcaagaattccgctgtgttaagtcccgcccgttccctaaagggggggggcccggtacccaaattccccctatagg

SEQ ID NO: 96244 - DNA, 220 bp, Triticum aestivum
  unsure (1)..(220): unsure at all n locations
  Clone ID: PAT_TA_96244
gcgcagcggcggctcactccaccgtcgactgctcagcgcaagggcgcgacggattcttccctcgggcgcgcggcagcctcttcgctcgggcgcgcggtggcatctttcctagagcatggcgcgtgacggccactacagaggagctcctccctccggcgtcggccacccgacactgcactggcgcccggctgtcccccccccccccccctaggngttnctc

SEQ ID NO: 96245 - DNA, 647 bp, Triticum aestivum
  unsure (1)..(647): unsure at all n locations
  Clone ID: PAT_TA_96245
agnaaagnacactcngttacctaacncccgggagtatggcaatncttgggcaanggcaaaaagaaanctgcgacgtccacaagcttcccgagtgctggctgctaagancttgccangcggaaanaanccggttnaagaaagataaaccctacgacaaagctcaacaatcactggagtggggcgctttcaactccgctccgcggaagcaagaaagttcaaagggagatngggctgaccccaaaaagctggggggataagctttgttccaanggcccgaagggtgaaanccgggatgggtggctccgtccggggcttgcctttgcaactcaagaacaaagcccaagaaacaaaangggccgggttgaattgttcttgaaagtttngttgggaagaatgcctccaaagggggggaaatcttgcccgaagaaagtttctttattctttgggagaaatgacnattctgtttcaaaggcctcaaanccaaccaancctctgttccaaggggcancctcctgggccccctggcaagcttcaanaaccgcccattcancccgaaagaagaaaagggaattcccaaaacgaanggattaaccaatncncanggganggcggaactggatttcnaagccgaagaacnggtgcccntg

SEQ ID NO: 96246 - DNA, 524 bp, Triticum aestivum
  unsure (1)..(524): unsure at all n locations
  Clone ID: PAT_TA_96246
gtcaagaggggatctcgatccccatctccctccagcgctctgctcgaacccccctcctctcactctcttcctcacgctccagggaggagcaccaagccctcacactctgccctcacgcgcgagctcaaccttgacccgccgagtgcctcttccacttgcaccttgtcgcgcctccctctgctgccactccagctgctcgcgtcgcgcctctgcgccaccatctagccatggtgcccggaccggcctcccgcgcacacatagagggacggcgcccttgccttcgtccccggccggcatctccttcctccgtccccgttcgcctcctccctcaaccacgccaagcaccgggagtcgttgctggntgctgncctccgtcgcgncaatccatccgtccatctccctgtgccgcggctcgacaacacggaggcccgagcttccggctggggagcanncgnagctacgtcgtgcccacaacnaagcagtcngcanaagtgggcatctctncctcaccaanaagtggccgn

SEQ ID NO: 96247 - DNA, 515 bp, Triticum aestivum
  unsure (1)..(515): unsure at all n locations
  Clone ID: PAT_TA_96247
ctcatctgatcacccatagctagctagctagcagcttaaggaactagcttgcagctaccgatngatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatggggcaaggtctccggcgtgcccggcaagtgcggcgtcagtgtgcccttccccatcancatgtccaccaactgcgacactgtcaactaagttcaatatataacccttcctacgttgcatgcatgggacgcnccttgtgttggagcttaatgtctatgttgatggagtgct

SEQ ID NO: 96248 - DNA, 542 bp, Triticum aestivum
  unsure (1)..(542): unsure at all n locations
  Clone ID: PAT_TA_96248
gggctgnaaggcacagctcagcttccanccactctcaaaccctctcgccggagcccgagcaagccaagcaagcaagcaagatggacggcaagcaaggcgaagaaggtggcggcgaagaagttcggcgggcccgaggaagaagtcggtgaccaantccatcaagggcggggctccagttccccgtcgggcgcatcgggcgctanctcaagaagggccgctacgcccagcgcgtcggctccggcgcccccgtctacctcgccgccgtcctcgagtacctcgcaacanaggtgctggaagctggccgggaacgccgccaaggacaacaagaagaccggatcgtgcccaaggcacctgctgctggccatccgcaacgaccaaggagctcnggangctgctgancggcgtcaccatcgcccacggcggcgttgattcccaacatcaaaccggtgctgctcccaagaangccgctgagaaggtganaagggcggngccgcccccaagttcgcccaaaaagaacaacaaagtcccccnagaanggcacc

SEQ ID NO: 96249 - DNA, 176 bp, Triticum aestivum
  unsure (1)..(176): unsure at all n locations
  Clone ID: PAT_TA_96249
tttatgggaaatcngatattgggggtactgnttgctatctgaaacccttgtgcctccaatggnatttaagagtgtcctgtaccttcttgataccaaaattcaatgttatgcgactgatgccccnnaaaaaaanaacaanaaaaaannaaaaacnananaacaaaanaaaaaaaaaa

SEQ ID NO: 96250 - DNA, 448 bp, Triticum aestivum
  unsure (1)..(448): unsure at all n locations
  Clone ID: PAT_TA_96250
acacacacacacacagagaagccaagatgtncggccgcggcaaggganggaaaggcctccgcaagggcggtgccaagcgccaccggaangtgctccgcgacaacatccanggcatcaccaagccggccatccggcgtntggctcncangggcggcgtnaancgcatctcggggntcatctacgaggagacccggggcgtgctcaanattttcctggagaacntcatccncgangccgtnacctacancgagcacgcccgccgcaagaccgtcaccgccatggacgtcgtctacgcgctcaagcnacangggcgcaccctctacngnattctgcggctgaactncgcccgctggctccaatctccatgttctcntgctatgggtttcgtttctgaattcaaaatgcgtcgcgttgtttggtccatnggctccgtcttttttagtggatt

SEQ ID NO: 96251 - DNA, 211 bp, Triticum aestivum
  unsure (1)..(211): unsure at all n locations
  Clone ID: PAT_TA_96251
gctttgtgtaaccattcactatgttatatccatcagtttcccatgaggatacggttctcttcttacattgcagaaatgtgtgtttgcctgcagctgccaagattcagtctttagttataaaaaaaaaaaaaaaacanaaaaaaaaaaaaaaaaaaaaaaaaaaaaaaaaacccnaggggggccnngaaacnaaaatanaanaaaaaaaaaa

SEQ ID NO: 96252 - DNA, 622 bp, Triticum aestivum
  unsure (1)..(622): unsure at all n locations
  Clone ID: PAT_TA_96252
nacgggtcgagcaaattcgggcatctccaagctacatcgaggagaagtangagggncttccctccgcgcacgcctccctcctcangggcaatctccgccaagcaatgaatggaggcccgggtaaagctcccnttcnccaaagaaacaactacctcaagggccgatgctccctccgccacccccgggaaaagcgcgggcgttgggncgcccgcccnaangaccccaancgcgcccgcccaangcccaaanggnnggtggcccaaagggaccccaaacancgcccaaggcgcgggtccgcggggccgccccgcccaaagggctaaaggactcccattggcccgaacgcccgttcaaagggaagggccggtcgccaaanggccaaccaaccgggncaatgcccccgcgggccgccaggccggncccgcccggggntcccctccctccgggccaaagaaagggccaaaggtcaaccaacnggnagggttggcntnctcccgggcttccccgcggtccnggggttcgncctcccttgncaaatgcgctgggccgttgggccgccccanagccaanggtgggcggggttttaanggccttgcnttgttgaatgncctttccggtctng

SEQ ID NO: 96253 - DNA, 328 bp, Triticum aestivum
  unsure (1)..(328): unsure at all n locations
  Clone ID: PAT_TA_96253
gttccccagaccccctccgccaacgcctaaaggccacatgccgctccccgccatcgccgacgccgcgctcactgctctgttcgaccgcatggtcctctccccgccggttcctgtcctccgcctaggcgccccctctcgcctcacaatccgctcgtccgcgattccgctggtctcgctcgactcccctgacttggcctcccttcgcgcccgccggggacgtgggctacttccacctcgtcggncatggcatcccttcccagctgccatcctctgcantcgctnagnctgtctcgcgtcnacnnagtcccgcnaatgcgcnngtctattc

SEQ ID NO: 96254 - DNA, 510 bp, Triticum aestivum
  unsure (1)..(510): unsure at all n locations
  Clone ID: PAT_TA_96254
cggcantgagggtgtcaagggnaccatcttcttcacccaggaggganatggcccgaccaccgtnacgggaagtgtcactggactcaaggaanggctccacgggttccatgtgcacgctcttggtgacaccaccantggctgnatgtcaactggaccacacttcaaccccgctggtcatgtgcatggggcacccgaagatgaaatccgccatgctggtgatcttggnaatgtgacanctggagcggatggtgttgctaacatcaatgttacngactgccatatcncccttactnggaccaaattcaattgttggcccgtgctgttngtcgtccatgngtggacnnctgatgatcttggncaagggtgggncatganctgaagcangagcactgggcaaacgctgggtgccccgtgttgcttgcggnatcatcggggctccangggctatatgtcatcttccgccagaccaaangtccgtacnnattgtgggaaccctttttcaagaaattg

SEQ ID NO: 96255 - DNA, 334 bp, Triticum aestivum
  unsure (1)..(334): unsure at all n locations
  Clone ID: PAT_TA_96255
gcaacgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctccgtcaagctctaccgtttcctggtgaaggaggaccaaagagcaagttcaaacgccgtcatcctcaaaagagggctcttcaatgaagcaaagactaaaccgcccgccgctctccatgcgccngcctctccaaacttcatggaaggggaaaggganggaganagaacattgctgtggttgttgggtacaatcacaggat

SEQ ID NO: 96256 - DNA, 171 bp, Triticum aestivum
  unsure (1)..(171): unsure at all n locations
  Clone ID: PAT_TA_96256
agagaangntgataaatctgatgtcccggnaattgataanaagaataccttgtccctgccgacctcactgttggncagtttgtctacctggtgcggnagaggatcaagctgancccaaaaaaggncancttcgtctttntgnanaacaccntgccaccnactgcttcgttg

SEQ ID NO: 96257 - DNA, 469 bp, Triticum aestivum
  unsure (1)..(469): unsure at all n locations
  Clone ID: PAT_TA_96257
ccccccgaactccaaaccctantagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgatgcgaggagatctgcatgtccggcggnctcgtccgccagaagatgaagtacctccgcttcctccgcaagaggatgaacaccaagccctcccacggncccatccacttccgcnccccggccaagatcntctggcgcaccatccgcggtatgattctncacannaccgcnaggggcgaaggccgcgctcgcnaaggcttcaaggcggtnccatggcgtgcccgccgcccgtacgacnangaccaaagcnnatggtcaatcccccgacgtcnctcaaaggtttcttganggctg

SEQ ID NO: 96258 - DNA, 344 bp, Triticum aestivum
  unsure (1)..(344): unsure at all n locations
  Clone ID: PAT_TA_96258
gccccgtggtccccaaccgccgcccgccgncgccgcagaggggagaggccgccgccgcccgccgccgcccccgcgcccccgccggccgggtttgatnccatggcgtccaagaggatcctcanggagctcaaggacctgcanaaaggaccctcccacctcgnncagccgcangtcctgtangtgagganatgttccactggtcaggncactatcatnggaccctctngacaagcccgttcaccggtgggnctatttttggtgaacattcatttcccaccnggattaccccttcaangccccccgaaggtctctttctgcaccaaggtgtttccaancaaacatca

SEQ ID NO: 96259 - DNA, 499 bp, Triticum aestivum
  unsure (1)..(499): unsure at all n locations
  Clone ID: PAT_TA_96259
gcgatggactggatcggacatggcggaagtgatggtgcgcatggttatgtttcatcgcttgatcatgctgttggtgacttgaaagaatttttagaggatgtcgtcttanaagaaaactatggcttgccatgcttcttatttggccactccacaggtggagctattgttttgaagacagcactagacccttgtgtggaagttcanatanaaggtttgatcttgacctcgccagctattcacgttcagccatctcatccgattatcaaagttgttgcaccaatcttctcggtgctagctccgaaataccgggttagtgctttgcataatagaggacctcctgtttcccgtgatccagaggctctgaagatcaagtatgcagatccacttgtgtatactggccccattanagttanaancaggcaacgacatccttcggatatcatcatacctgcancanaaaccttaaagtagagnttacagtccccttttccangnnctt

SEQ ID NO: 96260 - DNA, 330 bp, Triticum aestivum
  unsure (1)..(330): unsure at all n locations
  Clone ID: PAT_TA_96260
gctaagctaaacagcagcgagcaatggngtccacctcctgcttcctcnancaagtccaccgcgcgcctggcccgcctcggcgcgccctgcgcccgccgtcgggcgcaaccagcttttcgtctgcaaggcgcaaaagaatgacgaggctgcatctgacgctgccgtcgtcaccaagccggcgcgccggcgctgtccctcctccccggtgcccgccgccatcgccgtcaaagtctccccccgccggncgccgcctacnggngaancaagnccaacggtgtttcgggcaanggcgaangaaagaaaaaacnggnctttcngtggctgttataa

SEQ ID NO: 96261 - DNA, 470 bp, Triticum aestivum
  unsure (1)..(470): unsure at all n locations
  Clone ID: PAT_TA_96261
aaaccctagccgtcgtctcacagctcgccgccgacgcagcgagctcttcctccaccgccgcaaccatggcgacccagatcaagcaagaagaagaagtttgtgagcgatggcgttttctacgccgagctgaacgagatgctgacccgggagcttgccgaggacggctactccggcgtggaggtgcgcgtgacgccgatgcgcacggcgatcatcatcagggccacgcggacgcagaagcgtgcttggtgagaanggccgcaggatcagggagctcacctccgtcctccagaaagcgcttcaacttcnccggaagaacgggggtttganctttnctccgagaaggncgtcaaccgtggncctctgcgccatccccaaggcttagtcacctccgctacaagctcctcggangcccttgncggttcncaagggcatgccnanggggttcttcnccttggtatgngcaacngtgg

SEQ ID NO: 96262 - DNA, 369 bp, Triticum aestivum
  unsure (1)..(369): unsure at all n locations
  Clone ID: PAT_TA_96262
actcccgcgtaccaagccaccgaccaacatggcaagcgtctctccaagccgcggccacgctgatgccggccaagatcggcggncgggcctcctccgcgcggccgtcgtcgcacgtcgcccgggcgttcggcgttgacgctggcgccaggatcacctgctccctgcagtccgacatcagggaggtcgcaagcaagtgccccgacgccgccaagatggccggnttcgccctccgccacctctgccctcctcagtctccggcgcgagcgcggagggggcgcccaagangntgaccttcgacnagatcanagcaaagacctacatggaggtgaatggtaccggcaccgcgaaccantgcccgaccatctacgg

SEQ ID NO: 96263 - DNA, 329 bp, Triticum aestivum
  unsure (1)..(329): unsure at all n locations
  Clone ID: PAT_TA_96263
agtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcaanttgaggcagaggagacgaaggagcccgagccagcaagctgcggccgaaccggaggccgangcgcccgccgtggtctata

SEQ ID NO: 96264 - DNA, 340 bp, Triticum aestivum
  unsure (1)..(340): unsure at all n locations
  Clone ID: PAT_TA_96264
ccaagttcatccatccgatcccatctgcccgctcgcagctccaaggaaggaaggaagccttcagccatgtctggccgcggcaagggcgggaaggggctgggcaagggcggagccaagcgacaccggaaggtgctgcgggacaacatccagggcatcaccaagccggcgatccggcgcctggcgcggcggggcggcgtgaatcgcatctcggggctcatctacgaggagacccgcggcgtgctcaagatcttccttggagaacgtcatccgcgacgccgtcacntacaccgagcacgccccgncgcaagaccntcaccgccatggacgtcgtcnacgctct

SEQ ID NO: 96265 - DNA, 494 bp, Triticum aestivum
  unsure (1)..(494): unsure at all n locations
  Clone ID: PAT_TA_96265
atcaatgttgagaacgttgaggacaancgtcgtgccctccgtgagctcctcttctgcacccctggtgccctccagtacctcagcggcgtgatcctgtttgaggagaccctgtaccaaagcaccaagggtggcaagcccttcgtcgacatcctcaaggcgggcaatgtcctccctggcatcaaggtggacaagggtaccattgagcttgctggaaccaacggtgagaccaccacccagggctttgatgaccttangcaagcgctgcgccaagtacnatgaggctggtgcccgcttccccaagtggcgtgcantcctcaanatcngcgccactgaagccancgcagctctccatcgaacaaaacgctcaaggtctggntcgctatgccatcatctgccaaggagaatggtcctggtgccattgtggagcctgagattcctgttgatggncctcatnaacattgaccgccgtgcnttanttcaccggagattntcct

SEQ ID NO: 96266 - DNA, 447 bp, Triticum aestivum
  unsure (1)..(447): unsure at all n locations
  Clone ID: PAT_TA_96266
ccaagtctacggggtgtgaccgagcgaagcacacagcacaagggcctantggaagatgcaaagtcaagagaagataacacctgtgaagcctgtagcctccaggcctttctccagtttcacttccttctcgaagctantgaaagacttcactgtgactggttctgcaacaatctcctctccagnagagactgttatatttangcggccaaaggtaanacgtttcgcaccgccaccaagtgatctatcngcaggaattgctgcaaccatgttacaggatgctggtttagataccacacatgaaaaaatggtcatcgatccagaacaagtcgtcccctgtgaccagatgacgggcattccaccatancaacaanccaaattcatggcggtgnaaaaaccntctgtccttacgatggntacaaatttggnccgnaagttatggggcaagaa

SEQ ID NO: 96267 - DNA, 314 bp, Triticum aestivum
  unsure (1)..(314): unsure at all n locations
  Clone ID: PAT_TA_96267
aggaggaagggaagaggatcgtaccgctgccggggacggtaancaacacgacaggctgacggccangaggcgaggaagcgttggtgtggcagctaggtcgcgttcgtgctccatagcagcggcgccgccgccatctccacctcatcctctcaaactcccganccccacaatccccgccgccaacatgctcatgctccggagccgccgccgccatccggcgctcttgcacagaacttgggactcgatgtctttttatatgtgccttccgcttgcggaacgggcaaanggattttgtgtcagagatcccangggta

SEQ ID NO: 96268 - DNA, 520 bp, Triticum aestivum
  unsure (1)..(520): unsure at all n locations
  Clone ID: PAT_TA_96268
gtcctcacagcatcctctcagtccttagcttccttccctcgccgccacccaccaaggaaaggaggatgtcttgctgcggcggcaactgcgggtgcggcgccggctgcaagtgcggcaacggntgcggcgggtgcaagatgttccccgacntggaggccaccgccggcgccgccgccatggtcatgcccaccgcctcccacaaggggagctccggcgggttcnagacggccggggagaccggcggctgcgactgcaccacctgcaagtgcggcaccgcgtgcggctgctcctgctgcagctgcaactgagccggcncccattattgncttgncggcanaggcgancacgaggattgaggagggacangcaagcaagnaccatcaccaccaagttcaccnacnancccaagcgttatcattcaccaagccgcccccatgccgcctcgcggggntgncgtcccgtctgaataanataaanccaaccggttcgttnttncgcttaacttcttgtatgccccttg

SEQ ID NO: 96269 - DNA, 404 bp, Triticum aestivum
  unsure (1)..(404): unsure at all n locations
  Clone ID: PAT_TA_96269
cccatccccgccgccgcctccgctcggttccttctccttcctccgagcttcagccatgggcanggagaagactcacatcaacatcgtggtcattggccatgtcgactctggcaagtcgaccaccactggacatctgatctacaagcttggnggtattgacaagcgtgtgatcganagggtttgagaaggaagccgctgagatgaacaagaggtctttcaagtacgcctgggtgcttgacaagctgaaggccgancgtgaagaggggtatcaccattganantgccctgtggcagttcgagangaccangntaccactgnaccgttatttgatgcccctggtcacccgnggacntcaancaagaacatgntcnacngggtacctccccaacgcngcacttgtgct

SEQ ID NO: 96270 - DNA, 381 bp, Triticum aestivum
  unsure (1)..(381): unsure at all n locations
  Clone ID: PAT_TA_96270
cgaagcaaaaaaagcatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaanagtgcaaggagcatgcccaggcaaagcatccgaaggagcgagctcgtccaagtgcttccctcacctcaaagcagttgatntcctgnccaatcaagacangtgagagangtaacntnagtccccncgagaggngcgctnttttttttccaccctangtcattaacatngt

SEQ ID NO: 96271 - DNA, 497 bp, Triticum aestivum
  unsure (1)..(497): unsure at all n locations
  Clone ID: PAT_TA_96271
acgacaccgttcacggncactggaagcacagtgacatcaagctcaaggacgacaagactctgctctttggcgagaagccagttaccgtcttcggcgtcaggaaccctgaggagatnccgtggggtgaggctggtgccgattacgttgtggagtccaccggtgtcttcactgacaaggacaaggccgctgctcacttgaagggtggtgccaagaangtggtcatctctgccccaagcaaagatgcccctatgtttgtggttggtgtcaacgaggacaagtacacctcagacgttaacattgtctcaaatgctagctgcaccactaactgccttgctcccctagctaagatcattaatgacaacttcggtattattgagggtttgatgaccactgttcattccatcactgccacacaaaagaccgttgatggtccctcnagcaaaggactgganaagtggcaagggcncaagcttttacatcattcccaacaacactgg

SEQ ID NO: 96272 - DNA, 479 bp, Triticum aestivum
  unsure (1)..(479): unsure at all n locations
  Clone ID: PAT_TA_96272
gaacancgagattcaaggntccagatntaaattccggncaagcaacaatgggaaggacggtgactgtgcccggatngtcggtgccatcgacgccgctgctcaaggacgaactggacatcgtgatncccgancatccgcaatctcgacttcctccagatgtggngccccttcttccaaccgtaacanctcatcatcgtccaagacggngaacccaacaaggncatcaaggntcccgagggcttcgactangagctctanaacccgcaacgaaatcaaccgcattcttggncccaaaggctcatgcatctccttnaaaggactccgcgtggccgctgcttcggntacatgggctccaagaagaagtacgtcttcaacaacgacgaacgactgctttcgtgggcaaaggcccatctgggaaaagaaatcaatgctccttgagcaacaaatcaaagaaactcctcaagcccgttcaaaacgtt

SEQ ID NO: 96273 - DNA, 615 bp, Triticum aestivum
  unsure (1)..(615): unsure at all n locations
  Clone ID: PAT_TA_96273
gnaacaantcctgctaagttcgttctggattctctaaaagaacgctgaagaagcaaatgctggagggtgaaaagggtcttgaatggttgattgctctcctacaattttcacaacatccaaaagttgaaccaaggcccccaagaaagcaagcggggggcccggggaccctaaccgtgcccatgggacgcaatcaaacccctaacatgtccaaancccatgccacattgagctgatcttgtccgggagaaaaggaagaagccgggtgaaagaaaggagggcttgaagtcccaagatcgcccaaggaaanggcctaaaagaaanggaagctctacataaacctatccgccctaattcgttaagaagcaagtttgtagcatctgggtttgggctgagtgggaaaatttttggggcctggttatcctggtgtccgtcctaaatactggctaagctcatactttgtgaaaacccaatgatcgtctcatggttactggggattcaaataaattggttgtgnttttgggaatattttttcaaaaaaaaaaaaaaaaaaaaaaactccgaaggggggggggcccgggtancccaaattccgcccctaataagtggaggtccgtt

SEQ ID NO: 96274 - DNA, 513 bp, Triticum aestivum
  unsure (1)..(513): unsure at all n locations
  Clone ID: PAT_TA_96274
acttncctgctccctcctctcctcncgcgcaaggcccggngaaagggaagcaaaatgtacaccgccaggaaaaagatccaaaangacaagggcgtcnagccctccgagttcnaggacaccgtcgcgcangctttctttgacctggaagaatggcaaccaggagctcaagagcgacctcaaggacctgtacatcaacactgcaatccagatggatgttgttggcaacangaaggccgtggtgattcatgtgccgtaccgtctgcgcaagcccttcangaagattcatgtcaggctcgtcagggagctggagaaaaagtttagcggcaagggatgtggtctttgttgcaacaaaaaaggattgtgagggcaaccaagaaaggntctgctgttcaacgccctcccaccaagaacctgacagctgttcatgatggtatcttggggggatgtcgtgtaccaactganattgtggggaaacgtgtcaaataccgtttggatggtgccaaaggcatcaaa

SEQ ID NO: 96275 - DNA, 350 bp, Triticum aestivum
  unsure (1)..(350): unsure at all n locations
  Clone ID: PAT_TA_96275
aaacgagagagaatacacaaacaagagcacaagacgtatggaggggaaaactactctatgtttcctcacggtgcttctgctgctangaaattgtgctgatgctgagacctgcaaagagcaccgtgctaacaagggcgcagcgtgcataaatgaaggttgttgggcagactgcgccagagactaccatggacattatgtcaagaatgcttattgtaccggcgtttaccccttcacaaaagtctattgtgtctgcgacgtctgtgaagagtaggagacaatgcagcatcacattacggggtccatttacacagaggattcttgaagtttggcaataataaattttggggggg

SEQ ID NO: 96276 - DNA, 576 bp, Triticum aestivum
  unsure (1)..(576): unsure at all n locations
  Clone ID: PAT_TA_96276
aggaatttcggaccaaggnactttccaaagaggccctggntaaaatgtgaccggggcanaancaagntggtcttcccgggaaaggggggaaaagcaccggggaaanaactgcttnaaactgncaacctgaaaagccacttttcaatgccaaaaagaaattaaatctccaaaagnccaacacaaaacgcnatnagtttgattaccaatangnagtggantcntttaaccctccccaaattggcgtgtctcctggctggcaancaatgtgagggaaaacaacccttnaaatactgcatgggggaaacaantggatnncangggggggggcccnggtacccaattccccctnataatgagtcctttttacgcccggctcactgggncgtcnttttaaaacgtngtggaactgggggaaaaaaccctgggngntaaccaaactttaatcncccntggcangaanaatccccccnttcncccaagctgggngttataaacnaaanaagggccgcaaccggattgccccctcccaaanaatttgngcaanccctgaaatggcgaaatgggggaacncccccc

SEQ ID NO: 96277 - DNA, 495 bp, Triticum aestivum
  unsure (1)..(495): unsure at all n locations
  Clone ID: PAT_TA_96277
ctcctcctaaaacantctccctaaccccgtgtccaanaatcnancccccggctccaatggnggngaaagaaacgatgcgcgtgctcgtcaccggcgccgcanagacaaatcggatatgctcttgttcccangattgccangggaattatgcttggtgcaaaccaacctgttattctgcatatgctggatattgaatttgctgctgaagctcttaaaggngtcaagatggagttgatcgatgccgcatttccacttctcaagggagttgttgcaacaactgatgttgttgaggcttgcactggtgtgaatgttgcggttatggttggtggattccccaagaaaggaaggaatggaaaggaaagatgttatgacgaaaaatgtttcaatctacaaagctcaaagcatctgctcttgaagctcatgcaacccccaattgcaanggtttggttgtttgccaaaccancaaacaacaatgctcctcaacctgaaaggagt

SEQ ID NO: 96278 - DNA, 538 bp, Triticum aestivum
  unsure (1)..(538): unsure at all n locations
  Clone ID: PAT_TA_96278
acgangggcgggttnaggtttcacttncatccattctcaacgttagcaaggagccagtgggaagtccggccatggcgccgtcccancccaaagtcanggctcttcgtgggcatcaacaagggccacgtcgtcaccaaagccccgagctgccgcctcccccgtccgaccgcaaggggaaaggtacaaagagggtgcattttgtcaagaacttgatcaaggaggttgctggatttgctccctatgaaaagcgtatcactgaacttcttaaggttggaaaaggacaagcgtgcactcaangtccccaaaganaaagcttggtactcacaaagagaacaaangaggaaaagaaaaggagatgtcaaagttgtccttaaggaaaaatgaaggtcctgcctggtggtggtgctgggtgacaaagaaagaaaataagaactttggctancctggtgaaanttttatcccgggaagcaaaagtccctgtattaacaagtcccgttacctataaaagctaatggncaattgtgtttaacactatctt

SEQ ID NO: 96279 - DNA, 458 bp, Triticum aestivum
  unsure (1)..(458): unsure at all n locations
  Clone ID: PAT_TA_96279
aacaaatgggtngnaactcnagattttcaacaaaacnagcaaagttgttgggcatgaagatgggtcctcaaattaagaaactccccaacaagcaacanaatgagcntccggngattngaaaaaaaatnctggggattggaaaacaacaaaatgcncnagggagttnaaggactanccgatgtgttgccttgcttgaagaatgaaaatgcctggctgaaaagcttgagctttgcacgccccgtttccgtaatggctggctgcaaattctanaaagcctgaaggcaacaatctgaaactgggggggttggggttttcctcctaacannaacccnagaattncaagcnggatactaancgcaactggggccactnccaaccangtgcaacaagggagccaagatgaacnaacgccaagttatcanctgggancaaattaattgctacaagttacaaaaatn

SEQ ID NO: 96280 - DNA, 505 bp, Triticum aestivum
  unsure (1)..(505): unsure at all n locations
  Clone ID: PAT_TA_96280
ctaaaaataatggggttnccccngggttgcaaggaaattccgcaacaaggggaacgaaggtaaanaaacaacaaacccgcaaacgccgaaccccgcngaagaaaacctaacggccgcccggccgcaaaaaagcaaccatgggtatcnacctcnttgccggnggggagggnaaaaaganggacaaagcgccgtcccgcccaaagtccgaacgatttntaactcaaagctcctcngtcaaagctctaacgtttcctggtgagggagggaccaaanaacaaagtttaacgcccgtcatcctcaaaganggctcttcaatgagcaaagaacaaaccgncccgccggctctccaatggcgccggcctctccaaacttnaatgnaagggaaaagggggggagaaaaaaacatttgctggtgggttgtttggtacaatcaacaagattgacattgcggggttcaaagaaggtcccaancaaatgaaagggttaccggcnccttgaagggttc

SEQ ID NO: 96281 - DNA, 548 bp, Triticum aestivum
  unsure (1)..(548): unsure at all n locations
  Clone ID: PAT_TA_96281
gtggggggcgctcnaaaataatggatnccccnggctgcaagagccacaaaatcacantaacactaacttnagctaaccaccttctgccantccgggcattttcttgcatccacnaangcaatggncactgctgatgtccaaaacccggcggtcgcgctgacggaggangcgcccgcggtggagacaaccctggtcgccgaggaggtcgcgaaaacggaggaggcccccacnccggcggtggccgaagtcnaaacgcctgctgcccccgtcgaggttgaggagactaaagaggaggcgccggccgccgctgagacggaggagaacaaagagcccgagcccgcanctgcggccganccggaggccgaagcgccaaccgtggtcnagacaaanaccaaagaggccgtggctgaagcaaaaccngcggtggtccaagaagtgaaagangaagnggcgcctgctgcccaanccggaggttgcgggcgtccccaagaaacaacggctgctgcggagganggaaccnccgccgccgcaaaagaacccgccgcccc

SEQ ID NO: 96282 - DNA, 495 bp, Triticum aestivum
  unsure (1)..(495): unsure at all n locations
  Clone ID: PAT_TA_96282
nctctcctcctcctgncancgattccgaaccaaggaggaacccggcgcgaggagggcaaagggaaganaagaggagaccaccgagcccancgcgcgcacacgacancangcgccgcgatntcncncaagagcggagatggggctcacgttcacgaagctgttcanccggctcttcnccaagaaggagatgaggatcctcatggtcggtctcnatgcggctggtaagaccaccatcctctacaagctcaagctcggagagatngtcaccaccatccccacaatcgggtttaatgtcgaaactgtngagtacaagaacattaatttcaccgtttgggatgtccggggtcaaggacaagatnaaggccctgtggaggnactacttccaaaacaaccaagggctcatttttgtcgtggncaacaatgacnnaaancgtgttgttnaggnaaaaaatgancttcaccggatgctgaattaagatgagctgctgatgcttc

SEQ ID NO: 96283 - DNA, 498 bp, Triticum aestivum
  unsure (1)..(498): unsure at all n locations
  Clone ID: PAT_TA_96283
agcccacattcgctccaagctcgaacaaaggagagaccgtcagccatgtccgggcgcggcaagggaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgacagggccgcaccctctacggcttcggcggctaggctcgtcctcgcctccctgcaaattccgatgtgcttgttcgcatgtgcgcaagagtctcgctgtcgagaaaacttagctgaaatgaaatccccatgtttaaaaaaaaaaaaaaaaaactcgaggggggggccggtaccaan

SEQ ID NO: 96284 - DNA, 496 bp, Triticum aestivum
  unsure (1)..(496): unsure at all n locations
  Clone ID: PAT_TA_96284
aaaaattcagaacctgtcctacctgccaacgctcancacggnggccctcctcaagcangtcgactacctgatccgctccaaatgggtgccttgcctcgagttcagcaaggttgggttcatcttccgtgagcacaacgcatcccctgggtactacgatggccggtactgggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcaatgcgtcaagcttcaatcgccttcaagccaccgggctgcgaggagtccggcaaggcctaaacagctcactcaccacgggncacatataaagtgccattgcggttttgtcaactctgacattgctttgggttttccttcnccaattanccttcttgtttgttcccaaagaataatgtgtatgtccatgttcaagta

SEQ ID NO: 96285 - DNA, 655 bp, Triticum aestivum
  unsure (1)..(655): unsure at all n locations
  Clone ID: PAT_TA_96285
gngcagccaagatttcgggtcccttcccttctcnnaaccaaaggcatcaagcaattggcgaacaacgggaagccgacgccacgggccgcgggttccnaaaggagcaagcaagcccgccaaacgggnttccgccgggccggccacaaccgggcgggcgaaagcaaaggtcacggccgccaactcccgaagggtcgggacaacaaagnagccttgctcccaagaagcgaacgccctcctaaccaagntacaatcctgggaggaacgaagcggttgtaaccccgcngcgaagcaacgaagttgcaatgaaaggggagctccggcggagaatnaaccggccaaaccnaccccaatgggaaaacctgattgaacgaacgttccggcggggacgaangggccaaagtttccttcaaacaattgctggcctcaaaaggcttcaatccggggnggccaaaagnaaagaaccaattgggaggattcgggnggttctaacaaccngggcttacttcccctgggttccgccnaacggnngcttcggccaatccccccggaacgaaagggggnaaccnatcnttgggcnatgggacnatcnaaacccgcgangaaanctaannaagctgggggggctggccggttgcaatccgaanaaanggcccgg

SEQ ID NO: 96286 - DNA, 530 bp, Triticum aestivum
  unsure (1)..(530): unsure at all n locations
  Clone ID: PAT_TA_96286
cggcaatgagggtgtcaagggcaacatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggncgtgctgttgtcgtccatggtgaccctgatgatcttggcaaaggtggacatgagcctgagcaagagcactgggaaacgctggtgncccgtgttgccttgccggnatcatccgggctccaagggctaaaatgtcatccntccgccgaaccaaacgtcctaaaanantntggggaaaccntttcaaaaatgcaaaattttgcaatnctccaantctaaa

SEQ ID NO: 96287 - DNA, 493 bp, Triticum aestivum
  unsure (1)..(493): unsure at all n locations
  Clone ID: PAT_TA_96287
gcggcatccatggcccccaaggcggagaagaagccggtggcggagaaggccgagaagacgacggcggcgaagaagaccaaggccgagaagcggccgccggcgtccaaggagggcggcgagaagaaggggaagaagaaggccaagaagagcgtcgagacgtacaagatctacatcttcaaggtgctgaagcaggtgcacccggacatcggcatctcctccaaggccatgtccatcatgaactccttcatcaacgacatcttcnagaagctggccggcgagtcggccaagctcgcccgctacaacaagaagcccaccatcacgtccaagggaaatccagacctctgtccgcctcgtcctccccggcgagctcgccaagcacgccgtctccganggaaccaaggccgtcactaagttcanctcccgcttanatagtctgctctgtcttcttgggcgattngatgggaactgtttcattatcntgtgaaatatgatt

SEQ ID NO: 96288 - DNA, 537 bp, Triticum aestivum
  unsure (1)..(537): unsure at all n locations
  Clone ID: PAT_TA_96288
tctagctcgaacccggcccttaaaagaagcacgcatgggacggncanaagatnccaggttctgtcaggctggcctgcggatgggtgctcctcaacgcctgcgccatgggcttggtccactacaccctctcctgcaaccagtgcgatgcgctgacggacaccaagggcgcctgcttcancgccctctggatngggactctgtgctgcgctggatnccaagcgaacgcggnggcgctgggcgctgctgctcccacgccgcccccgctggatnatccgtgaactggggcaaacttctcggtccgcgggtcgcccggcgctgggcaactgcaatgtttcaacgggggcaatctacatcctccaaccaaggagtcctacntnaacaactgggcctccgattctntttnatgctnggggcgaanataatntggcnggnaatgancnctccaaccctggttaaggtgaaggactggaggggnttaggggaaaacaaanaanncaccaangcaaagccaagncttaaattttggcccaactgcnn

SEQ ID NO: 96289 - DNA, 436 bp, Triticum aestivum
  unsure (1)..(436): unsure at all n locations
  Clone ID: PAT_TA_96289
gagtggcggncaaactggatgttcttaaagggntcaagtggaactacgcctgcttacgcccancgctgtcgtgaactttanctgtgattcaattttgngatggntttaccctgaaaccaaacggtgacatgcaatccactttgcatattttttgaaaatantcntttgatgtgaatgctttggagccttttgctccgtgcaacgggataaaatgactccgccaccccancgtaaggnctcaattggtttcaagggccgattaacccaaggntccaatccccctcggggggaattccaagccctcccccangccangggganaataacaagccaatttggntaacanaaggangggnggngatnacgtccaaaaaaagtgtaaacaaaattgttatattcaaggatcaatgaaaatggactcnggttccttaaaaaa

SEQ ID NO: 96290 - DNA, 384 bp, Triticum aestivum
  unsure (1)..(384): unsure at all n locations
  Clone ID: PAT_TA_96290
cggggccttggcaatgatcgtatgatgttcctggccaatcncatccactccactaaagctcaattccttcgcgagggtcgtcgggaggcctttggctgatgtggacagatgaagctcaaggtttctgtttataacgcttcgttccatgctatcctaacgaatgtagttcatgtagcttcaggtgtagagttttgtttggtctgtatatatggtgatccttatcatccccaaactactgtcatatggaattaggtggccacttttgtgtatgataacctangcaagccgatgatctgtatgggtgacatgaatgatatcctgtatgatataaataaatgcaatgctaagtgtgaattattatcaaaaaaaaaaaaaaaaaaaaaa

SEQ ID NO: 96291 - DNA, 581 bp, Triticum aestivum
  unsure (1)..(581): unsure at all n locations
  Clone ID: PAT_TA_96291
tcaatcttcctcctccctggctctctcgtgttcccaacgaaacaaaacctaactcccaagattccancccccccggaaagccccgaancctaaattgaaccgaccgaaccgaccgattgaanggattccgatgaactcctccgtctcccgcccggccggcgggngggaaggaaggtggccnaatnggcncccgggctttccggctttccaacccgancggaccaaggaactggtctcctactaacctggcgccgccgcgttctcggggcgggngcctccggatttgacgccatccgccgaggtccaactctaaccgggtccaaggggggggcccggtaaccaattcnncctaatagtgaagtcctattaacnccgcgctcantgggncgttcgttttaaaaacgtcgtgaactggggaaaaaaccctgggcnttaaccaaacttaatccgcctttgcnagcaaaatccccccntttccccaagcttgggngttaataanccgaaanaaggccccgcaacggatttccccttcccaaaaaanttngccgcaagccttgaaatgggcgaaatgggaacgccgc

SEQ ID NO: 96292 - DNA, 223 bp, Triticum aestivum
  unsure (1)..(223): unsure at all n locations
  Clone ID: PAT_TA_96292
gtttcttcacatcnncagcttcaggatanagtcatgagncttgctcntttgctgcttgggncggaaagaatacngagaancctgtcanggnatggncgtcantatcgcanctantcnattggggaacgctgancatgtgtatcatctggntaancacgataaaaccaaactccccgtaangtgtgtcncccttcatctgctctccggtagcactgcctttggg

SEQ ID NO: 96293 - DNA, 491 bp, Triticum aestivum
  Clone ID: PAT_TA_96293
gctgccctccctagatctcatcctccacgaatccttctctgcctccatccaagcatcagcagccacatcggcggcgaggaaagctctgccccggcgcggtttcgagctgcaggaggaccccccctctctttctgtcggacagcttcgccatcgtgcgtgaacccggacggatccgaggagctccgtgctggatccggccgtcccacgtcttcgtgtgggctccgctgcctggacgctttcccgatgccgccgagccctgcgccgacgcccctcgcgactctcaaatccgacgccatctggagctcgtcctcaatctggagcaaagacgaagactacaagcggctaggaaatgggagttctttttgtgtggctgctgcttgtgtagcttgttttgtgggagaacgtactggagtttgtcgaccgatttcttttaacttcgcagtggctactgtttatcgtgcaagcagcatgtgctgttgttactccaagag

SEQ ID NO: 96294 - DNA, 490 bp, Triticum aestivum
  unsure (1)..(490): unsure at all n locations
  Clone ID: PAT_TA_96294
gcacaaatgaggccacaacaacaacctggatcatcacaaaatggtcctgtggtgcagatgttaccaacgcatcanatgcaatcggcaatggcctcgcctgtttctccacatcaacgccagcaagaacaaatgatgcaactgatacaacaacttcagcagagaggattgaatcgccagcagattgcgcaggcgctgcagcgacttccccatcttaatgcccaacatctgaaccagcagcaacggcaacaacagcaagcatctccaaggatgccaagcatctgcagcagggaagcccgcaaacacggcaggatcgcagccggcgacaccttcctcaggcggaaccgcggcgggtgcaaatgcgccgcatcaaggagggggaaattgcagccaacttattgggaagagaaagatacatgatttggtggcgcaggtggatccacagtgcgaggttgatccaaaggtggaagatttgattctggagattgccgac

SEQ ID NO: 96295 - DNA, 512 bp, Triticum aestivum
  unsure (1)..(512): unsure at all n locations
  Clone ID: PAT_TA_96295
ctcctgcgcctccacttccatcgcctccccaagatngcagatncgctccggtgagaatccgtcgccatgtcttccagcgaggtcgcctgcacccttgccgccctcatcctccacgatgacgggatccccatcacttccgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaggaagaaaagaaagaagaggccaaggaagagagcgatgatgacatgggcttcaacttgttcgactaagctgttcaattccaagttctcccngtgggttcttctatgcgaaaagacntgtccttanggtgcttttaagtcgaattttgaagaattaatatggttaatgccgtttggagaan

SEQ ID NO: 96296 - DNA, 502 bp, Triticum aestivum
  unsure (1)..(502): unsure at all n locations
  Clone ID: PAT_TA_96296
cacacactcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacgggcgcaccggtcgcgtctggaacgtcaccaagcgcgccatcggcgtcgagatnaacaagcaggttggcaacaggatcatcaagaagaggattcatgtgcgtgtggagcacgttgcaaccatccaagtgcaacgaaggagttcctccanaggaagctcaacnacgacaaagcttgaaaggcngaggccaaagtgcgttgttgaggtcatcaacaccaaagaaggcagccaacaaggcccaagccttgggntcatggtnggg

SEQ ID NO: 96297 - DNA, 271 bp, Triticum aestivum
  unsure (1)..(271): unsure at all n locations
  Clone ID: PAT_TA_96297
aggcagtcagagcagagcagagccgaagccttcgcccctcgccctcgccccanatagcgaacgcanacacacagccgnaatggngcgcgccggggctctctgcctcgcgctgctctgccctcctcgcggggcactccgccgtcgcccagaaaggccacgtggnccggnncgccgcgcccaacatctancanccccaacgcctgggcggctcctcgcnanngaaagacgaaccggcgtcccgncggcggngtccggaccaaccacgcccggt

SEQ ID NO: 96298 - DNA, 274 bp, Triticum aestivum
  unsure (1)..(274): unsure at all n locations
  Clone ID: PAT_TA_96298
natcccctctcatcgcccccgccccgtcgcccccgaaacttctcctccgcntcggncatctcaccgccacgcctctcaacccccaccccgtctaattgaagcgccaaacgggcgcgccatttgaattccccgcgagcttccgcccccatcngcctcctcggggcgccccctctgnngcncggcccgcctanggttttgctccgggaccccctctcgcggtcatggggtgaccctgtggnggcgtcgccctcgcgcngcgctgggctaaatcggc

SEQ ID NO: 96299 - DNA, 501 bp, Triticum aestivum
  Clone ID: PAT_TA_96299
ccccaatccaactcgcgcagcagctccaagaggatcgtcagcgaccatgtccgggcgcggcaagggcggcaaggggctcggcaagggcggcgccaagcgccaccggaaggtgctgcgcgacaacatccagggcatcaccaagccggccatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccaggggccgcaccctctacggcttcggcggctaagccgctgggccccgccaagatggtccgtcaatcttcgtcgccgcctgcaaattcccgattgtgttagtccgcccgttcctaataattgttgcgctcaagaaaatctcaaaatgggaaccggctttgtttccccaaatttcct

SEQ ID NO: 96300 - DNA, 506 bp, Triticum aestivum
  unsure (1)..(506): unsure at all n locations
  Clone ID: PAT_TA_96300
ccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataanccttcctacgtgcatgcatggacgcgctttgtgtggagcttaatgtctatgttga

SEQ ID NO: 96301 - DNA, 156 bp, Triticum aestivum
  unsure (1)..(156): unsure at all n locations
  Clone ID: PAT_TA_96301
ngaggaagcnagaagcgagccaccaagaaaccacccaaaggtttgcacaatggccgcttctcagctcaccatcctctccggtcctcgcgctcctggccgtggccgcgaccgctcaggcgcccggagcggtncccgcggcaancgccccagggcccc

SEQ ID NO: 96302 - DNA, 551 bp, Triticum aestivum
  unsure (1)..(551): unsure at all n locations
  Clone ID: PAT_TA_96302
nccccgggctgnaaggaattcggaagaaactcctcccgcgaacgcgangggcaacgccaanaaacgaaaccgcancgttaggaataacccaacccaacgggggncgtnaaacaaacnangggccgtncgaaggncaaaggacgccgggtanngnggggttaaattgttcccgtcgccgggctngttctcggggtcgtcgttaagagtttcgagtttaaggtgacgcaatcccggggtccaagcaacggtccggcggngcaacttgtnccccgccccgacgaactgttctaaaaaggggcanctcctgccgctgcaacctgtcgcccgcncaatctccatngtgcgcangctggcttgctccgcgtcgggngtnccgcctcngccttccgantccanctccaactncaaactcctcccgnaatcccaaagggnagcaactcctcctccttttccaaacgantgcgcccgcgctcctggctgccgggactccgccccctcgttcctcccgccccaagcttcgccaacgaacgaagaacggccacctcaanctn

SEQ ID NO: 96303 - DNA, 554 bp, Triticum aestivum
  unsure (1)..(554): unsure at all n locations
  Clone ID: PAT_TA_96303
agttccgagttttttttttttttttttgcaaagcaacaaccactgactctgtgattgatncatccatctatttctcctgcccctcctcactcancctcctctatacaaaacaaaaaatcttcttaanggggaaccaaattaangttaataagacccaanaaaaaagaggtgngangtaaaaccccaaaaananaanagccnctantgaaactaaaccccgggccaanggatgccccggcngatttganngcgngttggattgcctggacnggaaaaccngatntcatgggcgaatgcaatggtgnngggggattgccattgacngaacngggnncaaccgaatgnacctggacctggaccttanctttgggattgtgnacnncaaagncaattccaaatgcccnaccaatancnagccatgntactaccataananctcaatnagcttnaaggggggggaatngatgaaacnaagaanacaanactccgttcncgggnggacccnaantncccgtggcnactgggngnaagncttcganttcacantccccggg

SEQ ID NO: 96304 - DNA, 515 bp, Triticum aestivum
  unsure (1)..(515): unsure at all n locations
  Clone ID: PAT_TA_96304
gtcgaagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggccgtttcagctgctgcccctgctgctggaggtgctgctgcccctgcanctgagtcaaaagaaagaagaaaaatgtcctgggagaangaaaagagtgatgatgacatgggcttcantcctgttcgactaagttgtggggcaaccttgtgtctgaagtatccaatcccttggncaaggaaactanagtcaaatgatgtttttanctttanttaaactnaatttgtgaaacactggcaanann

SEQ ID NO: 96305 - DNA, 509 bp, Triticum aestivum
  unsure (1)..(509): unsure at all n locations
  Clone ID: PAT_TA_96305
cccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcggggcaagcccaaggtggcggcgtccagcagcccgtggtacggctccgaccgcgtgctctacctcggcccgctctccggcgaccccccgagctacctcaccggggaagttccccggcgactacggctgggacaccgcgggnctctccgccgacccccgagaccttcgccaagaaccgnggagctgggaggtgatncactgccgctgggccatgctccggcgcgctcggnttgngtcttcccggagctgctcgcccgcaaacggcgtcaaattcngcgaaggccgtntggttcaagggccgggtcccagatnttcaagcgnagggggggncctcgactaacctcgggcaa

SEQ ID NO: 96306 - DNA, 520 bp, Triticum aestivum
  unsure (1)..(520): unsure at all n locations
  Clone ID: PAT_TA_96306
ccacacaccacgcctgcctcatctctcggagcaggaggaggagcttgcaaagaacaatggcagcccanggtcttctctctgggaggcagctgctggggaggcctctgcagtcctccatctccaggtcgtcttcctcccggaaagtcccccttcgtcgtcagggcatcgtccaacccccctgccaagcaaaatgacaacaggcagctgtggttcgcgtccaagcagtccctcacctacctcgacggcacgctgcccggtgactttggtttcgaccccttggggctgtccgacccgganggcaccggncgggttcaatcgaacccaagtngctgggnctacggcgagattttcaacgggcgggaccggcgaatattggggggtggntggggatnaatncccccggggggccctngggcaaangtgggcnctgggtgncccccgganancgggaattccnttggttccaangcnaggcngcgattcnncccgggnggggacctaccaattactgggnccgacn

SEQ ID NO: 96307 - DNA, 449 bp, Triticum aestivum
  unsure (1)..(449): unsure at all n locations
  Clone ID: PAT_TA_96307
ctcgagccaagaagagatcgtcaagccatgtccgggccgcggnaangggaaggcaaggggctcggcaagggcggcgcttaaacgccannaggaaggtgctgcgcnaacaaaatcnagggaatcaccaaagcccgccatccgccgcctggntcggaggggcggcntgaagccatctcggggctcatctacnaggagaccccntggcgtgctcaaagatcttcctcgaaaaacgtcatccgcgaangcccgtcacctaaaccgagcaccccccgccgcaaagaccgtcaccgccatggangttcttctacgcgctcaaagcnccnagggcccgcaccctcctacggntttgggngggtaaggctctttccttcncccccccttgnanattcccaaaaaagtttgggattnacacccncgnactttgtgttagnttctcctgtttgccccgt

SEQ ID NO: 96308 - DNA, 199 bp, Triticum aestivum
  Clone ID: PAT_TA_96308
gcacgaagacactaccttctgggtcaagcagcactgattataatgaacatgatttattaagtgaacaaaagctattttcccctaaaaaataactcgcattatttctaagtgaaaagactaagagttataaatttaaaaagtagaaccatgcaaattattgatttataaactgtcagatgcattcggtccagtactttga

SEQ ID NO: 96309 - DNA, 472 bp, Triticum aestivum
  unsure (1)..(472): unsure at all n locations
  Clone ID: PAT_TA_96309
gccaanctcnagattcctcggnaattctccgtncaaagggcccgccaaatttcctcgtntttcaagggtgnacngtggnatccaattgcctccaaaaaatcctaagggagctcaatgcacnttctggggagcaagatttgcaacggctcctgacgaagctcaaggaggggagtacgancgaaatttggngggaaacaaaaaaaaccaagttgcccggaagaagaaaatcctgncaactttgttctnatcaaaagaagaaaaagggcccatcngttcaattgggggnaagggaaagccaanaaataaanggcgccaataaatggnaagaagggcaagaggaaaagccatctngcggccttanaagcaaaggaaccttgaaaacttgtttaaaaaacaagaagccaatctcccctaatgggggnaaactcctnccaggcaatttggaaaaaanggaacattggggnaaccaaat

SEQ ID NO: 96310 - DNA, 504 bp, Triticum aestivum
  unsure (1)..(504): unsure at all n locations
  Clone ID: PAT_TA_96310
ggaagattgggtgggaggagaaggcggcggcnacggttttgatttgtgatctgctacaggcgccgccacagggatggatgccaggatctgaggtgagtctgatccctcaaccccttcccattccttcccggtcttgtctcagcacacacgggggaggcgccgcgggacaaacaaggctcttgcaggttgcancgcgtgacggtgatgggagcggcaagaaaaggaagagcagcggcggcgcatctctgtctcgtggggccagccctcccgtccgcgcgtgcgacaacgccgatatggagtcccaagctcggntaagccaccacgacgttgggtgccccggcgggggctattgggaccatgccggcgtccggccatgattccggcgacggcaaanccgtatnataatgagccatcctccnccacttnccttttccttcaatgttttaaatcctgnancctctaacccaatccccaactggcctaactccctctctccacgtnatg

SEQ ID NO: 96311 - DNA, 479 bp, Triticum aestivum
  unsure (1)..(479): unsure at all n locations
  Clone ID: PAT_TA_96311
gcaccacagtcatccactcacaagctaagctagcggcgcagtagctcacttcagtccagtcggcatggcggctcccaggggcgcggcantggtgctggcgatggtgctcgcggccatggtggtggcgccgccggcgacggtgcacgcggccatatcctgctccacggtgtacagcacgctgatgccgtgcctgcagtacgtgcaacanggcggttcgcccggcccggggctggctgcaccggcatccaaaacctgctggngggnggccaacaacagcccccgaccgccgcaacatctgcggctgcctcaaaaaagtcgccaaacgggcgcctccggngggccctanattaacccgcgccgccggcgctcccctccaaagtgcaacgttcgcccctnccctaacaagatnagccccaagcgtcgactgcaactccgatncanctgaaacgaactgaanccgccntggcccntgtgtcgac

SEQ ID NO: 96312 - DNA, 617 bp, Triticum aestivum
  unsure (1)..(617): unsure at all n locations
  Clone ID: PAT_TA_96312
tatatttacttcnaagcaaagggagtattttgtttatcancctaatgcgtgattttacatccttgaatgttctgcctccaatcatctcaggctatgattaagtcccaaggattaaggatatntatgtncaaacaaacaaacatatagcaatctcaaatttcattgccaaaaaacangctcctatgcttgcacctggggaaaacacctgggaagacaagtaataccaactgtttctgtagcgaatgcccaagtaacagggaaaccaactccccgncggaattataaagaanatggattcccaaaattgggnaaagaacaaactccaaagtggtaaatccaattgancaacaattggattcatnacaaaaactaaaaacccatttcaagggacacaaggnctaactcaatnttaggggagggntgaaataaacaatggtgggctttcaataaaaatgggcccacaaccggggggatttcancggtcctggattttgcaatgaagcctggggtaaccaaagtcttttttgggcaaaaggggaaaaagagaagntgggcaagggggcaagccaaccaaacaaatcaagnctngggaaatcattttcccaaganatggaagg

SEQ ID NO: 96313 - DNA, 535 bp, Triticum aestivum
  unsure (1)..(535): unsure at all n locations
  Clone ID: PAT_TA_96313
ganaagcancangggcnaacaaggagatctcnccgaggaggcgaccgaccatgagggccaagtggaaagaanaancgcatgaggaggctgaaanaaggaancgccgaaagatntaggcaagcgatccaagtacgctgatgggggtggtgacggtgtgctgtaacttcctaatgtggtgtctttgggctgccggctgactgccnggcngtacttgccttggcaatgggtgngcgccattccttctcancctggtcaactcggcntatttccangaanaccctggcacttttaagtaaggggccctgtttancntttgcctttttaaagtttngttccnanggaagtttttngcctattcaatgaaccnaaancttancccaaacctggntatgaaacctnctngtttttngganggcttttnaattttgcctgngttaataattccgggccaaaanaaaaaaaanaaaaaaaaaaacccccnnagggggggggncccgntncccnaaattcgccctaaaagttganntcccnatta

SEQ ID NO: 96314 - DNA, 495 bp, Triticum aestivum
  unsure (1)..(495): unsure at all n locations
  Clone ID: PAT_TA_96314
accgccgacactcatctgatcacccactagctagctagcaacttaaggaacttccagctagcgatcgatggctcgtctcaacagcaaggctgtggtgtccgccgtggtcctggcggcggtggtgctaatgatggccggcagggaggcgacggcactgtcngtgcgggcaggtggactccaagctcgcgccgtgcgtgtcgtacgtgacggggaaggcgccctcgatcagcaaggagtgctgctccggtgtgcaggggctgaacggcctggcccgcagcancccggaccgcaagatagcgtggaagtgcctcaagagcctcgccaccagcatcaantccatcaacatngacaaggtctccggcgtgcccggcaaagtgcggcgtcagcgtngcccttccccatcancatgtccaccaactncaacaaatgtcaactaagttcaatatataacccttccgacgtgcatgcnaaggacncccttgttgttgancttnn

SEQ ID NO: 96315 - DNA, 529 bp, Triticum aestivum
  unsure (1)..(529): unsure at all n locations
  Clone ID: PAT_TA_96315
ccactggtggttttgaggctggtatctccaangatggncaaacccgtgagcacgctctccttgctttcactcttggtgtgaagcanatgatctgctgctgcaacaagatggatgccaccactcccaagtactcgaagggccgttatgaagaaattgtcaaggaagtctcttcatacctgaagaaggtcggttacaaccctgacaaggttcccttcgttcccatctctgggttcgagggcgacaacatgattgagaggtccaacaaccttgactggtacaagggcccaaccttcttgaggccctgggaccanatnaatgagcccaagangccctcccgacaaagccccctgcgtctttccccttcaaggacgttgtaacaanatttggtgggnattggaactggtgncaagtgggggcgtgttgaaaactgggagtcatccaagccaaggcatgggttgtcaacctttgggtcccanctggccctnncccacctganggtgnaaatctgtttnaaatgcaaccatnagtn

SEQ ID NO: 96316 - DNA, 211 bp, Triticum aestivum
  unsure (1)..(211): unsure at all n locations
  Clone ID: PAT_TA_96316
gagaaaactantctcgagttttttttttttttttttttttttggcagancacnaaagtaaaaccgtngacccaagacttcttccacagggacagggctagctaaaaatcatcatcctcaagttggcggcactgcgcccccaattgcngggccacaggcangagtaactaccacacacaaacaatgtgacatgcttgcacacaacggggggg

SEQ ID NO: 96317 - DNA, 502 bp, Triticum aestivum
  unsure (1)..(502): unsure at all n locations
  Clone ID: PAT_TA_96317
gaacagagcggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgtggccccctccaagggcaccccgtcgttcgaggccgccgccgagaacggagggtgcaagtgcggncccaactgcacctgcaaccccgtgcacctgcaagtgatccatgaggcctcaatcaaatcagatcaaggagatggcatgggatggacctgatgaaacgagcgagtaagtanttatgcatgaatcccaagcgtgtgtttccgtttttaaatttgccacccaaaataagaccgagatctatcgtatccgtancgagctagttaatgggattatccgtgcccctttgtggcttgtaccntgtgccngtttaaggcgtcttgtggccc

SEQ ID NO: 96318 - DNA, 397 bp, Triticum aestivum
  unsure (1)..(397): unsure at all n locations
  Clone ID: PAT_TA_96318
cccacactcaacacttccgccaccttggcctcctcctccanaagctaagctagcaaaagctgaggctagtanaaggtagccaaccaaaaccgcaagggcgacgatngcgtcgaccnccgccttcctccccgctgctggcgctcctngctgggtggngacgggcgcattgctcgccgcctgctgccccaagcggttgccccgcaaggcccgaccgggcaagggcgctgctcccggggntgaaancaagggggctnggggcaagccccgggccaacncctcaaagaattgggtccgcccgggcgttccggggggggacttgcttgccgccgttggggaccaaccttcaacntttcgaacgaagggcccggggccgcgtttgaaacaaacttttttcaat

SEQ ID NO: 96319 - DNA, 515 bp, Triticum aestivum
  unsure (1)..(515): unsure at all n locations
  Clone ID: PAT_TA_96319
ctcctctctccctcccccactccggnggnggcgcaccctagcgagcgcggaagagagaaggaagcgaatccgacgaacatggcgacgatngtnaacaccacggaggaggagccgacgctggcggtggtgcgctccacggngcagctcgcctgggccgacgcgggcgccgaggtcgncgacccggaggtggcccgcctctgcgccgaggggcatcagcacgccctcgccggccgctggctcgaacatggcctccctcatgctcgccaacgccganctcctcctcctcngcccccaccgcccccgaacaaagccgcanantctcgaagtgcgtcctcacngtcatctgcaaactcgtcaacaangcccgagtccnagggacnanggccctcnaaaatngccaaggctcatctggggccaaagctcnccccaccaatcccgggggacaagcccaacntctgcngcaatcaaagtncttgtttaatncctgttnaaacctggttnccgaagcttctntg

SEQ ID NO: 96320 - DNA, 241 bp, Triticum aestivum
  unsure (1)..(241): unsure at all n locations
  Clone ID: PAT_TA_96320
agctccccttccggttcnggttctggttcggttctggtccgagagtaagctagcctantccaagggtttccgtanaagaggaatggagagggagatncaatcatgngnggagaaggagtaacnctgcttcntgggcgggccttcncccngggccacccaccgaacaacaaanctccagncaangtcttcancccantaccgcnangatnctcctacnnccaantgatcatcaacgaacccg

SEQ ID NO: 96321 - DNA, 496 bp, Triticum aestivum
  unsure (1)..(496): unsure at all n locations
  Clone ID: PAT_TA_96321
gtttattattccccttcccgcagccgccccccgtgtcccgcgcgcaccttctcgaagcctcctccctccctcccccatggcggnccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcgggacggcaacggcaccatcgacttccccgaagttcctgaacctgatggngaaggaaagattgaaagggacacgggactcggagngagggagctcaagggaggcggttccgcggtgtttgntaaagggaccaagaacgggctttcatctcgggcgggcgggaanctgcgcccacggtgattgaccaaaccctcgggggaagaatgcttgaacgggaccaagggaggtgggaacgaagatgaatncng

SEQ ID NO: 96322 - DNA, 498 bp, Triticum aestivum
  unsure (1)..(498): unsure at all n locations
  Clone ID: PAT_TA_96322
ggcagagacacagagcagagcggataaactcgagggagattcgatcatcaccacaccaaccatgtcgtgctgcggaggcaactgcgggtgcggatccggctgcaagtgcggcaacggctgcggagggtgcaagatgtaccctgagatggacgagggggtgaacaccacctccgagaccctcatcatgggcgtcgccccctccaagggcaccccgtccttcgagggccgccgccnagaccgggggccgagaaacggagggtgcaagttgcgggccccaaacttgcaaccttgcnaaccccgttgcaaccttgcaaaggtgattccatccaaatccttggcaaanggagaacnggcaatgggaccnggaccttgatgnaanggaagcactanntaagttgttatgcatgggtgttgtggcgtgttgtgtttccttttttaatttgccaaccgaagaattaagacgaagntcgattcgttcccgtgctaagttaatnggct

SEQ ID NO: 96323 - DNA, 378 bp, Triticum aestivum
  unsure (1)..(378): unsure at all n locations
  Clone ID: PAT_TA_96323
cgagnagatcacaaggntcatgnccttgctgggaccanagcaatagccatgcgcgcgatgatttgggaccaccgcagnagtgagtcatttgncagtggcagcagcaagacagtctcctgctgangctagntgggcggtgaaaggagctgacgcattgtgcaaccanagtagctanccaagnggnccatcaccacgggngccacaccaagggaggtggnatgaacaagggtcattcaaaagggctatcttcctgacgnggtanagganggttcaagcaagccctccaagtccangcaattcaaggnacctcaacaacganccaccnnagggnaatccggcaaggaagctncngatgctccgagggggggggncccnggt

SEQ ID NO: 96324 - DNA, 218 bp, Triticum aestivum
  unsure (1)..(218): unsure at all n locations
  Clone ID: PAT_TA_96324
tttttttattctccaaaacgaaaatcattggggaaataaattcgattggcacacaagggagaatgaccagtgcnatatattcttacnacgaacangtgatctcctgataccactacatcagatgtgcggtagattcttacgacgaagcgataccagcacatcagatttggnctggacgctancaggtccgtggagaataanagccacaccgcgcaatc

SEQ ID NO: 96325 - DNA, 482 bp, Triticum aestivum
  unsure (1)..(482): unsure at all n locations
  Clone ID: PAT_TA_96325
gtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaatgtcaactagttcaatatataatccttcctacgtgcatgcatggacgcgcntgcgtggagcttaatttctacgtttgatgggaagtgctcnataacgaatggtttgaggctnctaaaaaaattaaaaatggaagttgcccngtggttgtggttaatttcaagtantnggggtctaatgtccggttacctntgccacacaacaactgtngttgtgcatt

SEQ ID NO: 96326 - DNA, 519 bp, Triticum aestivum
  unsure (1)..(519): unsure at all n locations
  Clone ID: PAT_TA_96326
attctaccaccgcaccgcacgagtgaagtgagagctttgcacgaaaacttcatcaagaaaccatgaagggcaccaanctcgcggcgatcctgatcctccaggccgtcctggtcatgggactcctctcacacgtgaacgccgattttttccccaagtgctgcaacaactgcaggtccttctcgggggtcgacgtctgctacgacgcccaccccaagtgtccccagggctgctcggngtgccgcgtggtgtcgacggagccccgaaatgtggcgctgcgccgggntatgaanatccacccgttcnacggtaccttgcggtgggaccctgcaaaggaaagtactgantcggtttcaatgccgggcaattgaataatgtttcccgcccctaanaattaaaaataaaaaagcttcaagggcgaaggaatgnagcaaggcggtcantccgttggcctaatgcggtggtggtgttgttgggccaaaacaaattggctttaatacccaagntaatggtccgtcctcc

SEQ ID NO: 96327 - DNA, 529 bp, Triticum aestivum
  unsure (1)..(529): unsure at all n locations
  Clone ID: PAT_TA_96327
ctcaggggctgatgatggatagtacaaaggaagaacatcctcgcgaggggtgttcttgtggtggtgtgcttggagagaaattgctccgtctctgttggctctgggtgaagatccaagatgagatgcctcctattgtggtggctaagtcctatatataagaggccctgggtcatcttcccaaatattgangcgggggaaggggcgccaaacaacggccattttgaagggggaacatctaagtacaagcttatcctcaataaaaagttgggtcttccgactggacaaaagactttggcgatgaacgccgcccttggggctccatgggtggacctccgtcctgcccgctctgccgggtctttgggtcctggttgccactggggaatgggcaaacctttgccctaaatgcctttgggttttgtgccttggcccccttttgcaccaaaaagaagggaaaacaaagggacactgcaataangtcggggngcccggtcctgggtctttggattcgtcnattgggctttgtggtcaa

SEQ ID NO: 96328 - DNA, 556 bp, Triticum aestivum
  unsure (1)..(556): unsure at all n locations
  Clone ID: PAT_TA_96328
gccgtctccgagggcaccaaggccgtcaccaagttcacctcctcctagattgcatctgcattgcttgtatctatctatctatctatctaagtaagcgactgtaagctggttctgttacttcagtgcttgtcgactctgggttatctgggaactacaagtgggtattaagtgctgggaaaggggaatcgattggaatttgtgcttctttcaaaaaaaaaaaaaaaaaaaactccgaggggggggggcccgggtacccaaattccgccctataaggtggaagtccgtaattaacgccgcgctcaactgggcccgtcgttttacaaacgttccgttgnactgggggaaaaacccctgggcggttacccaaaacttaaatccgccttggcaagcaacaatcccccttttccgcccaagcctgggcggtaaatancggaaagnaaggccccggcaaccggattnggnccccttcccaaaacaagtttgcnccaacccttgaaatggggcggaaatngggaacggccncccttgtaacccgggcgcanttaaagccgccggg

SEQ ID NO: 96329 - DNA, 461 bp, Triticum aestivum
  Clone ID: PAT_TA_96329
tgcagttcaagcattgttttgtagctgtacacttataattcagagtaatggcccgcaagatttatcctatcagcttttagtattaagaaactcataccattttatatctaactgaagaaaacctcatatttgcagattctttaggtacattttactgcagtgtccattgtttctgcatgcacataatggtgatggaccccacaccggtcagtgcatctaatggtctttgtacagctaaaaacatttttcacttggtgatgatatctgcactgcccttgcctgcataatttgaatatctcacatggactagaaacatttttttacttggtgatgatatctgcacagccctttcctgaacatgccctttatgttattcatacactttactcaagcatctatttgcccttatgttttgctaagggctcaatgttttctggaagtaagcttgactgaaaatacac

SEQ ID NO: 96330 - DNA, 393 bp, Triticum aestivum
  Clone ID: PAT_TA_96330
tgaccggtcctgaggcagtcatgaagatccgtgctatgggagtcaccgatgtgaagatcgtcggggtgtccgctgatgataacgccatggaggcgttcatgagtgccggtgctgatgactttgtacccaaaccaatgacgcttgaggtcctcgggcctatgattcaggaggtcatcgacaggaaaactaattagcgacgcttgctcgatccatccttggaggaagaaattaagctagctcatatactacgaatctttgctagctttgttatgcatcatattattgtcgggttgtcattttgttttcgaggtcaagcagagaggctacccataattaaatcattgggatcgatgtaatgtgcaacatttttgaatttagtctattaaggggggg

SEQ ID NO: 96331 - DNA, 205 bp, Triticum aestivum
  unsure (1)..(205): unsure at all n locations
  Clone ID: PAT_TA_96331
nggaanacgnanaggaagatgaatgtccgcncatccgttgacagncggctgtgccggcttctgcaangtggtgaaagcgggcggggngattcttccttcatcccactgnnatcttccaaaccaagaanncacaatgcagncgcccantgggctttctccanncatccncccgccttgncctccccggccccccgtccaaccgtcc

SEQ ID NO: 96332 - DNA, 457 bp, Triticum aestivum
  unsure (1)..(457): unsure at all n locations
  Clone ID: PAT_TA_96332
taccagggaggctaggctccccaccaagatcctgtggatgcggaggatgcgcgtcctgaggcgccttctgcgcaagtaccgtgaggccaagaagatcgacaagcacatgtnccaagncatgtaccngnaggncaagggnaacangttcaaaaacaanagggtccncatggngagtatccacaagtccaangctgngaaggcaanagagaaaacccnctctgatcagtttgaggccaaacgcgccaagagcaaggcaagcagggagaggaagcatgncaaggagggaggagagattggctcatggccccanagatcatgcaccagcaccagcggctggagctccagctccagcaagcaagcggcaccaaagaaggncaaggccaagaagtgaaggtctgacatgaagctttagctttctgggtatcatnaagggttagccngattttggagcatctgg

SEQ ID NO: 96333 - DNA, 488 bp, Triticum aestivum
  unsure (1)..(488): unsure at all n locations
  Clone ID: PAT_TA_96333
cccanccagtccatcccccgtcgctctcacgctcttcgtgctcgccgcctcccttcgcgtgctgcctcatggcttccatcgccggatctgccgtgtccttcgccaagcccgtcaaggcaatcaacacgaactcgctctctttctctggtgcaaggaggggcaatgcatttcttcgtctgcagtcagtggccgatgagatttgctgtttgctgctcagcaaagcaggatacagtggngaaggtttgtgaaattgttaanaagcagcttgctgttcctgaangcactgaagtttgcggtaccaccaaagttctccgaccttggagctgaattcaactgggacacgggtccnagattggtnatgggggccctcgagggaagggagtttccaagatnnagccgtggagggagaacgangtgcccaaggcaaatttgcnnacaagtttggaagnatgctgccaacgcctcaatcgaacaagctttgtcctctt

SEQ ID NO: 96334 - DNA, 448 bp, Triticum aestivum
  unsure (1)..(448): unsure at all n locations
  Clone ID: PAT_TA_96334
gcacactctccagcaccaagcaggccggcggcaagcagcgcaagcacaacaaccaaatggccaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgacccctgccgccgccgtccgcggggctggcgcgtccctactcgccgcggcgggcgcggtgaccgcgtccgcggggccggcgctggcgctggtcgacgaagcggatgtcgacggagggcaccgggctgagcctggggctgagcaacaacctgctggggtggatcctcctgggcgtcttcggcctcatctggtcgctctacaccgtctacacctccggcctcgacgaggacgaggagtccggcggnctctccc

SEQ ID NO: 96335 - DNA, 498 bp, Triticum aestivum
  unsure (1)..(498): unsure at all n locations
  Clone ID: PAT_TA_96335
attctaccaccgcaccgcacgagtgaagtgagagctttgcacgaaaacttcatcagnaaccatgaagggcaccaagctcgcggcgatcctgatcctccaggccgtcctgggtcatgggactcctctcacacgtgaacgccgattttttccccaagtgctgcaacaactgcaggtcccttctcgggggtccgacgtctgcgaacgaacgcccaacccaaagttgtccccaagggctgctcggcgtgccgcgtggtgtcgaaccaagcccccgaaatgtggcgctgccgcgggataatgaaatccaaccgtcnaacggcaacctgcggtgggaccctgcnaagaaagtactggatngggntcaatgcccgggaatgaatatgtttcccgccctaaaaatnaaaataaaaaagctcaaggggaagaattgangcangcggtcattcntgcccnaatgcngttttnngttgtggggcaaacnantgcntataccaantnttg

SEQ ID NO: 96336 - DNA, 450 bp, Triticum aestivum
  Clone ID: PAT_TA_96336
agaaatcaccgaccaaaatcccctcctctcccgcgtccggacgagcaccggcagccagacatggacgcctcagccaccgtagccggagcgaaggcgaagggcgccgcagggcgcaaggccggcgggcccaggaagaagtcggtgacgcggtccgtcaaggccgggctccagttccccgtcggccgcatcggacgctacctcaagaatggccggtacgcgaagcgcgtcggcacgggcgcccccgtctacctcgcggccgtcctcgagtacctcgccgccgagctgctggagctcgccgggaacgccgccaaggacaacaagaagtcccgcatcgtacccaggcacctgctgctggccgtgaggaacgaccaggagctcgggaggctgctggccgggcgtcaccatcgcgcacggcggcgtgttgcccaacatcaacccggtgctgctccc

SEQ ID NO: 96337 - DNA, 445 bp, Triticum aestivum
  Clone ID: PAT_TA_96337
atcaacaagaatctgcggatgcttcttttcttcttgggttcttaaaaaagcacaaaggtggtccatcttgaactgtaatttgttcggtgctgtttttctaattccctacgaaattattaggcattttggtgtttggaggtacactgtcaaggtgactaataaacttttttccttttacaatgtacaatgcatatataagttaatattatgtacttttgtaaatgaagttactatagttgagagcatggatatggcccttccaaagctctatgcagcagagaacggcgggcgtggcggagcgaccccgtgggaggacacgtcggcctgctgctacgaagtttgcgatggaacaacaaactgtctcggctttacatcctccacagatcctacgctaccatggaggagggttttttgaatcatatgagaaatcagtggctcgtcaaac

SEQ ID NO: 96338 - DNA, 455 bp, Triticum aestivum
  Clone ID: PAT_TA_96338
aggccaagtctcgcatggggatgcagcccatcctctgcttgcttccagcacggcaccggccggatccacctcggccacaaccacgacaccggcgtcggcagccatgtgcttcttctccatcaccacaaaatgagaatgcaaggcacaagcaagggaagaccatcgcttcgctcctccggggcgctgctgctccaaccctactggacgccatgcaaggtcgcggacgttgtggagctggacgaggtttaatccccagtcttatttatgtatgcctacatatgttgtgcggctgcaaggaaagatagtaacaaggggtagtgctacattgcctactcaatagtgtgctttttttcttctgaaatttagctgcagtcatggatcactaacctgtacattatgttacatctcatggttatctgacttgcttatgcaatatatctctatcgttcatataa

SEQ ID NO: 96339 - DNA, 446 bp, Triticum aestivum
  unsure (1)..(446): unsure at all n locations
  Clone ID: PAT_TA_96339
ccgttctccagtcgatnacgcacgctctcctcgccgccgagatgttcgggttcgggcaccaccacaaggaccaggcgccgccggcgtcgggccccaaccagatcttcaagatctactgccgcgcctcgcccccaccaaccccagggacgactaccagcactggatcaaggacatgaggcacagcaacaagatcagggacgaggaagggtaccctgcgttcgcactggtgaacatggtcaccggcgaatgcatcaagcactccaccggccanggccaccccgtgaagctggtgccgtacaacccggcgtaccangacgagtcggtgctgtggacggagagccgagacgtgggcaagggcttccgctgcgtgcgcatggtgaacaacatctacctcaacttccacgccttccacggggacaagggccacgggggggtccacgaaggga

SEQ ID NO: 96340 - DNA, 446 bp, Triticum aestivum
  unsure (1)..(446): unsure at all n locations
  Clone ID: PAT_TA_96340
gccaagccccctgccgcctccgtcatcggcatcgccggcataggcatggcggagcttctcccgagggtggagctcgacctcaagcgcgcctccgccagagtcatcgacaaggccaaggagcactgctcacatgtggccgatgtcagctatgaagtgaaagagggcgacgcgaggaatgtgctgtgcgaggcagttgagaggcatcatgcagacatgctggttatgggcagccatggctacggcgctttcaagagggccgtccttgggagcgtgagcgattactgcactcacaacgcgcattgcaccgtgatgatagtgaagaaaccaaagcaccataagaagcatgaacaattggggttccatagaaaggaggcttgaaaaagtttttaaagcccttaggttagagatanatatggaaggggtttaagcaatgcgtgttcaagtat

SEQ ID NO: 96341 - DNA, 484 bp, Triticum aestivum
  unsure (1)..(484): unsure at all n locations
  Clone ID: PAT_TA_96341
ntccgccttcccctcccctccccaaacccaaaaccctagaacttctccattccgctccctcgcggagcctggccaacatgagcgctcccatggagatntccttcgacccccaaccttctcatcccgccccgcccgccttcccctccaggccaaccctggagnccgcaagncgccggcaaccctcccgcggtctcgtcctcgcgcaaccgangnggaggncgtngtngcgcccaacccgccagacgacaaggtcctcgtctcantttgaggtgttgctgcacgccacgagtacggctcgcgccggaggacgttcnaaacgggggtcgagaggattgttanaaatctccgaagtttaaggctatgttccatnggtcctngtttaaanataacctccaagaaaaattctttttcttncctggaaaantgtnnaaaanggttncaaantantgtnaaaactnnaatgagntttattggagaaaacaaa

SEQ ID NO: 96342 - DNA, 189 bp, Triticum aestivum
  unsure (1)..(189): unsure at all n locations
  Clone ID: PAT_TA_96342
cgcacancngcatccntanccctagggtatatcccancgcaccttgcgcgcacgccgaaaaccanncanacgcctctgaacactctcccccagccccgctnactcctctgggtcngcgnatctattgccttacccatggnttcngtctacttgcaagctcgcaggacggtgnccagcgtgctgtgatct

SEQ ID NO: 96343 - DNA, 261 bp, Triticum aestivum
  unsure (1)..(261): unsure at all n locations
  Clone ID: PAT_TA_96343
ccgccagacccagtatctctcttcctcccatatgcatctccgcccctccttctcgatccgacttcgatttcgctcagctgcgcttcgatttgcttttgttttttctcgccctgcgcgttctccggtgatgacccaaataatactttcgttcttctgaaattcacaatgtggaagaactggagacctgaactgaggagactgcatctggcgagaaaaaaaaaaaaaaaaaaaaaaaaaaaaaaaaaaaaaaaaaaaaaaaan

SEQ ID NO: 96344 - DNA, 264 bp, Triticum aestivum
  unsure (1)..(264): unsure at all n locations
  Clone ID: PAT_TA_96344
ctccaaggnctcactcactcaccangngacaccccgaatccagcggcatatggcctcctccacgaatgccgcgccacatcgctctcctcctgctcctcctggcntccangcgcgcggngtccgcggtcggngccggcgcctgcgcggncgagaagttcccggnggggaanacatatgccanntnccaggacctcccgcatntgggcgccncgctgcactgganctacgatnaggccaantcgtcnctctcnctngcgttcgtgg

SEQ ID NO: 96345 - DNA, 283 bp, Triticum aestivum
  unsure (1)..(283): unsure at all n locations
  Clone ID: PAT_TA_96345
acaagcagattgtaagcctgtcagaccttactatacaatttgtacctgtctcgtatgtgtctagaattacactttgccatcatttcgaacaatgggcgatgatgtgatccagtaataaaatcttcttgtcaaatggatgtgaggatgtatgagatcactaaatttggatgttatggtgatctgattttactctgttttgtgtagtcttagaatcgatgattttatgtttgttaaaaaaaaaaaaaaaaaaaaaaaaaaaaaaaaaaaaaaaaanaaaaaaaaa

SEQ ID NO: 96346 - DNA, 443 bp, Triticum aestivum
  unsure (1)..(443): unsure at all n locations
  Clone ID: PAT_TA_96346
gcgcgangtgtcgcacatccacagcctcatccaccaagatggcggagttcgagctcctcancgacctcttcgccgccacccacgaagctgctggcctccacgctcttccccacgccccggtcggcccccttcgcctccttcaccgccctcatcctcgatctgtccccgtccnccgcgccggnctcgggcgacaccgtcgggttcccgccgccatgngacntctccgcggtcncccccggtccccgacccggaggccggnggcctttcccgtcccccgcgngggaggnnggccgcgntganngtccgggttcgttaatntgtnttccccaanctaccccactcttccntggtcangnccgggggctgtacagtgtganggaaatccttcnttgctncgtctgnctgtgantngancacccggcnggggnctgggggctcgccat

SEQ ID NO: 96347 - DNA, 462 bp, Triticum aestivum
  unsure (1)..(462): unsure at all n locations
  Clone ID: PAT_TA_96347
ctgtgtactactttgcaacttagagcgagaaaggagatccgagtccctatcaacaccacatctagtactaagctaagatgaagactacacagacgctgctcctgatgctcgcctttttcttgctatcaccaggggccataataaaggtgtcgagttattgcgcaggagcaattaaaccgacgcctttaccgtgtgatcgtccaggttgcctgttcgtttgtcgccaggctctccatatttgccctgagtgcacttggactgctgagtgcagccccgagggatgcaagtgcaatgtgtgtggtcctggtgaaaaacgaaaatgagactgtactangtatcttgtgaatatactgtaggacggtgtgcgtgttatgataattaaaacgatgtcgtaatggattgtatgtatttgtatggccttcttggtcttatatcaagaccttacaaaanaaaaaaaannnc

SEQ ID NO: 96348 - DNA, 224 bp, Triticum aestivum
  unsure (1)..(224): unsure at all n locations
  Clone ID: PAT_TA_96348
actcccctaacctccgcaccccgtcggggctctttcccanacgtcctccgctgncgtggtngtagcgnaatggcgcgntcaccgttcccaaaaagactcaantgncaatcccantattcccanctgnccaaattgtttcttncgtntcgctggccgttcancttntccctggagantcancncaagccggaaggaangtctggcaaagaaaatnttggtgaaac

SEQ ID NO: 96349 - DNA, 276 bp, Triticum aestivum
  unsure (1)..(276): unsure at all n locations
  Clone ID: PAT_TA_96349
ggcgacgctcgcatctggcgaagcccaagcgcccggtgaggccacctctcccctccgtcccatggcaccaccgccccaacccatacccagctccctctccccctcgcatggtagcagatctgagcgggacaaggccccttcggttctggtggttcggaacggggcgggtgacctctgctcccttatcttctggcgacttggagcgtggcggctggtgcccccatcttcttagcctncatggggggaaaganatcccggaggccccccccccccccc

SEQ ID NO: 96350 - DNA, 288 bp, Triticum aestivum
  Clone ID: PAT_TA_96350
agcagcagtagcaagtgcttaagctagtgtctgataattaattaatccatggtacaaattaattaggctaatttctagtagtagtaccttcctataggagatcttggacactttgcatgcatgcttgggatttatatttgtgatggagtatgattgttaagcaccttagggtctgtttggattatttgctagcctcacctagccaggctaagttaagctagcccgcttgtggcatagcccacatgagctaagcgatgttgtttggttgtaaaaaaaaaaaaaaaaaaa

SEQ ID NO: 96351 - DNA, 467 bp, Triticum aestivum
  unsure (1)..(467): unsure at all n locations
  Clone ID: PAT_TA_96351
gcgccttcctctgggctccgccgcactcttttcgtttcggtttcccgcccccgaagccccggcgaaatttgagacgcgggccaaggcgcgaggcggcacagcttctcgtcctcggcggcgcggaggcggacggctgcgtctgactccgcggacatggcgccggcgccggcggctgaacaacccttggagtatgagctgcgacaagagctctccgatatcatgctccagggctacattaccggtctgcgccgcgagttcgagacgaagctatgtgagaatcacaaccgtatcagcacactgagcaagaactgcaaggaaaacctttccgagatcactgctctacgagacgagctgaccggcatcctgaccgctgtggcaagcttcagagtccagtgtgctccctccccacagcagtctcgagaaagccgaggagacgaactccctgaagatgaaagatganantgaca

SEQ ID NO: 96352 - DNA, 479 bp, Triticum aestivum
  unsure (1)..(479): unsure at all n locations
  Clone ID: PAT_TA_96352
tcccaacacagacgcaagcgatacagagggcgccgttagcatgagctcgtccgcgaagctcaagcggctgtaccagctggcggtgagcaacatcgtggccatcgcggcggtgcccttcgccgcctcggccctgctcaaggcggcggagctagggcccgaggagctgctcgcccggctgcgcgcgctccggcccgtgcacatgttcctggccgcgttcgtcccggccgcggcggccgccatctacctcaagctccgcccgcgcgcggtgtacatggtggactacgcgtgcttccgcaccaagccccagctgccgcgtcccgttcgccgcgttccaggagcacgcccgcgtctggccgggcttcgacgaagcgcagcgtccggttcatgtcgcgcctgctcgaagcgctcggggctcggggaggagaactgcctcccctacgcgcagcactaaatcccgccgtcccgcgaactncgagtcn

SEQ ID NO: 96353 - DNA, 486 bp, Triticum aestivum
  unsure (1)..(486): unsure at all n locations
  Clone ID: PAT_TA_96353
ccagccatgccgaaaaacaagggtaagggaggcaanaaccncaagaggggcaagaacgaggccgacnacaanaagcgcnanctggtgttcanggaggacgggcaggantacccccaggtgacncggttnctcggnaacgggcgctgcnaggcnatctgcttcnacggnaccaagcgcctctgccacatccggggcaanattnacaaaaaggtctggttnnccgccgggganatcttcctcgtcggcctccncgactaccaannacgaaaagggcgacgtcatcctcaaagttaatnaacnaccaggcccnccttgncaagggctaaggggagctccccgaaaagcnccgcctcaannagggggtnnaagtccangggccccaagngggcganggngaaaaaccactnaatccaattncnngggcgaggncctccccaaanatttnaagttttttcccctcctccttccctnggtngnaatnttttt

SEQ ID NO: 96354 - DNA, 444 bp, Triticum aestivum
  unsure (1)..(444): unsure at all n locations
  Clone ID: PAT_TA_96354
atctccatctccatctccatctccaaaccgcaacaacccacctccctccccgccgaccccgcagcangctcngatggcccgcaccaagcagactgcccgcaagtccaccggcggcaangcgccgcggaagcagctcgccaccaaaggcggcgcgcaagtcggccccggccaccggcggcgtcaagaangcccaccgtttccgccccggcaccgtcgcgctccgtgagatccgcanagtaccaagaagaagcacgggagctgctcatccgcaagctccccttccagcgcctccgtccgggagatcgcccaagacttcaagaacggncctccgctttccaagtcctccgccgttctcccgcgcttcaangagggccgccggaggggttnctccgtcngggttcttcnaagganaacaaaccttgtngcgcccatccaatncaaagg

SEQ ID NO: 96355 - DNA, 467 bp, Triticum aestivum
  unsure (1)..(467): unsure at all n locations
  Clone ID: PAT_TA_96355
gatgcacatttcggttttggggcaagcgcttataaggtctcttggagtccagatggtgcaccttctgagaaaggatttggttcaagtgcttatgcggtacattgggatccagatcatccaccttctgaaaaaaccggttttgatgcaagtgcttacgcgggacatcgggatccaaatcatgcacactctccttcctccattcctgaagcaccaacaaaacacaagcatataaaagttcaaaccggcatgttattcctgaagaagaatctgcacatcggcactacacttcctaaaggaaccatgtttgcacgagacggtgcaccaaagtctgttcattttgcctctactccattggagtcaaagtacttggcaaccatcctttcatatttcatgatacctcatggctcgaccaagggaaaagcaagtagctgacacccttcgttcatgcggnaaaaccggttggacag

SEQ ID NO: 96356 - DNA, 480 bp, Triticum aestivum
  unsure (1)..(480): unsure at all n locations
  Clone ID: PAT_TA_96356
ggcatgcagatatttgtgaagaccctcaccggcaagaccatcaccctggaggttgagtcctcggacaccatcgacaacgtcaaggctaagatccaggacaaggagggcatccctccggaccaagcagcgcttgatctttgctggcaagcagctcgaggatggccgcaccctggcagactacaacatccagaaggagtccacccttcacctggtgctcaggctccgtggtggcatgcagatatttgtnaagaccctcaccggcaagaccatcaccctcgagggttgagtcctcggacaccantgataatgtgaagggcaanattcaangacaagggngggtatccaacggggcancaacgtctcaacttcgctgggaaagcaacttttagggtgggcgcacccctncagnactncaacatccaagaangggtcccaacccntcaactttgtggctcaaggctcccgtggtgggtatncnan

SEQ ID NO: 96357 - DNA, 357 bp, Triticum aestivum
  unsure (1)..(357): unsure at all n locations
  Clone ID: PAT_TA_96357
agggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaaaaaaaaaaaaaaaaaaaaaaaaann

SEQ ID NO: 96358 - DNA, 519 bp, Triticum aestivum
  unsure (1)..(519): unsure at all n locations
  Clone ID: PAT_TA_96358
tgccgatgccgccgnccctcccgtgcttgctcctcctgtttttccgtccctctcctctccctcgccgccgtaacgcccacaaagatcccgctctaacgccacctcccgccgctcccgcccgccgccgcgcannancacccgctctcccgcctcgcccaggcctccctcgcgcgcgcctcccgcctcagagccggncacggtcaccacgagggccaggggncacccacaancacaacaatcctcccccgtgcgcgccgcgctgtactcgcactcctacggcggctacgccttctccctctccctcgggacgccggccggcanccgctgccggtgctgctngaacacngggcagccanctcaacctggggtggcctggcaccnccaactaacaagttgcaagaaantgttnccgcccgccnggttcctttcccccgttctttncaancccaaaagaagnttcntcntcctccgtctncggtcngtctnccttgcnagcaagccccctncctgncctctttg

SEQ ID NO: 96359 - DNA, 300 bp, Triticum aestivum
  unsure (1)..(300): unsure at all n locations
  Clone ID: PAT_TA_96359
ggaacatgttgctgganccgnggntantggatgggaagtatgatttcttttttggngtcttanttgtgacggggtgtcaaatttgaaagttcgacaacgtgtgcgtantgtangcatcgtcgtgccctgtgtttacttgctccccgtccaccgttggttagtggcgtcatgcgncnatcgttgggnttaattggnctaattancgtggntgtatcangtgtggcncatataaactgatnaccgccacccaaatagtaaccnggcccattccaatcganggaggttatnttacaattcggt

SEQ ID NO: 96360 - DNA, 537 bp, Triticum aestivum
  unsure (1)..(537): unsure at all n locations
  Clone ID: PAT_TA_96360
agagagtgctagggttttctctctctcccggcggcganggcgatgtctatggcgggggngggcgacnagggccccgggcagggcggnggcgcggttcgttgcaggccaggctccgctcctccggtaaggtgctcaccgaggaggaggcgggccgcccgagaacgtctacatcaagaaaatggaacaagagaatcgggangaaagctcgcacgcaaggggtcccaagcactggagagcaagctccgtccaccccaaagcgccgcagcggggcgacgttaacactgggaggcgccgcttcganccgcgtcgggcgtccggcaagcaagggcaacgttcnacccgacaagnaaacagggaacctacgcccgttgcctggctgggnaaccccttgggccgggtcttgaancngcccttggggcttgggtacctccttgtcanaaagcccaaagnaaanacnggtaggaaggttgtncnaactgnatnnggcccaanncntggcccctngggttttttanctttcccttactggganaaatg

SEQ ID NO: 96361 - DNA, 374 bp, Triticum aestivum
  unsure (1)..(374): unsure at all n locations
  Clone ID: PAT_TA_96361
tttgnccaagccncctactgccggtnggnggcagacnacngaaacatggtgcatcgcctgacctancggaagaagcacaagctatgncaccanntccaaccatacgcgggtcntcaagaccccaggtggtaaggctagtgtaccacgtacaccantgaagancggcgatgcggtcccaagntgccctgtgatcngggaanaaagatccagngggattccccacctcangctctactgaatacaaannatcaaggtttgtctanngcaccncanggacctgtgaancccgtccctatgggntggnaggtgctcctctgggaacctgcaagtgtacgggaaaaggattatcccgcgcctttcttggggttgaagga

SEQ ID NO: 96362 - DNA, 463 bp, Triticum aestivum
  unsure (1)..(463): unsure at all n locations
  Clone ID: PAT_TA_96362
agccgaaccccgtgcgctgctgcgctcgccctccccttccctcccacccgctcttcgtctcggctcgattcgttccccccactcggtcttcgtctcccttcccccctccctcacccctcacgcctctcgccagcgccgcgctctcgcgttccggccgccgtttccaccatttctccgtgccgcttgcctcgccccgcccctgttttctccgcgggggcnanatgaggtgaaggcgggttttcttccgggacttcgcccagcttccgtgcgcgcaaagatcnganggagaaccaaccgggtgcgggaagcggaggacccgcgggtgatgcaananggaggtgggggccgcaaggtgggctccccngctctactgcaccanattgcaagccgctggnttctccatgncgggggnggngggccannaaanctcggggagcccgttggcccncccgtgggagccncc

SEQ ID NO: 96363 - DNA, 439 bp, Triticum aestivum
  unsure (1)..(439): unsure at all n locations
  Clone ID: PAT_TA_96363
aacccaaaccctaccccgccgccgccgtcnccgacgcagcgcgcggaggcgacctcccaccgccgccaagatgcagatcttcgtgaagaccctgacgggcaagaccatcacgctggaggtggagtcctctgacaccatcgacaacgtcaaggccaagatncaggacaaggagggcatcccgccggaccagcagcgcctcatcttcgccggtaagcaagctcgaggacggccgcaccctttgccgactacaacatccaagaagggagtccaccctccacctggtgctccgccttccgcggcggggcccaagaangccgcaagangaagacctanaccaaagnccaannaaggaaaaagcacanncacaaagaacggngnaggctccccgttccnccaattcttanaangggcgncgacccccacccggcnaaggtcacca

SEQ ID NO: 96364 - DNA, 365 bp, Triticum aestivum
  unsure (1)..(365): unsure at all n locations
  Clone ID: PAT_TA_96364
gatggcttcaacggcactgccttcgcctacggccagaccagcagtggcaagacgtttaccatgaacggctccggtgccgaccctgggatcatcccgctcgctgttcgcgacatctttgacacggcggccgaggccgcagacagggtgttcctgatcagggtctcgtacatggagatttataatgaggagatcaatgacctcctgacacttgggagcgagaagctgccaattcntgagagcctcgagcgtggtgtatatgtgtccggtctgcggggaagaaattgttaacaantgctgaancaagtgctacaaactcctttgagcttnggtggaagccaaaataagacattttcgggagaaaacaa

SEQ ID NO: 96365 - DNA, 411 bp, Triticum aestivum
  unsure (1)..(411): unsure at all n locations
  Clone ID: PAT_TA_96365
ggccagcactcaccctcccatccctcctctccggncgnaaccccccccgccgccgccatggtgaaagtactcgaggggatcgtccaacccgatcaagtcgnccaaggcctgtggcaaaagatctcagggtccacttcantaaacacangcgagacaagcgtttggctctttcgcaaggatgcctttggggcaaggcctaaaganggtacccttgaaggatgtttctncgctcacaaancaaagcgattccctttcccgngagaatactggcanaaggtgtggggtccgtanccgccgccaagttaaaagaaaccacccaanccaaaaatnggggcaaggggttcccctnggggccntgcnaaaantnccggncccanntttccctggttttgnatttttnctnncaaacaa

SEQ ID NO: 96366 - DNA, 457 bp, Triticum aestivum
  unsure (1)..(457): unsure at all n locations
  Clone ID: PAT_TA_96366
ngagggnttcangatcagcccagcagaacccaatggnatcctcatacgccaaaaagtgaaacanatccatgtgatntcggaaccggccanacctgattttaanggtnaacagaatactttttaacttcttaaacancaaaggtnaaggtcaacttccaaanaaaattacagggggtttagnaatggccacgnacangcaacaagcacaagcnanctttgacaagccttanncggtttggaaaaancnttacagcttaggggggggggcccnggtacccaanttcgncccttatagntgaagtcggtaattacggcngccgncncaactgggcccgttcgtttttaaanaatacgttcgnttggacctgggganaaaacccntngcgcngttanccccaaacnttaaatccanccttggcaagtcaanaatnccccccttttcggctcangcatgggt

SEQ ID NO: 96367 - DNA, 180 bp, Triticum aestivum
  unsure (1)..(180): unsure at all n locations
  Clone ID: PAT_TA_96367
gcantgcgtnagggagtnagagaatggcggggtggnaaagccgctctcctggtgggcctgctgttcctgagcctggccttggtganccancangcggacangcggcgggtangatcccncccccgattccgctcaccacgtcncacaggnataggaaagcctcccaggccgcgtccggat

SEQ ID NO: 96368 - DNA, 525 bp, Triticum aestivum
  unsure (1)..(525): unsure at all n locations
  Clone ID: PAT_TA_96368
cctggcggaacccgctcccccacccatccactcctacctctcgcgattagggtttccgccgccgccgccgccgcgccgcccgtctcgcccgccggcttgtcctccctccacctccccaagcgaagcgccggtcgccgccgccgccatgtacgggcaccgcnggggcaatgctgggaagcgggggggtttcggatgggtacgangggatcaaagaggccacgaaattgatggnatcgaaatccatacttcgcaagtganaacgcaagggagcccgttggncgttctcaaaagcggggccaggantgaatggaggccaggcccccccatattttgcanggcatgggaaagcancngctggtggcaagcggcagcggntttctaacccaaacctnacgggcggncaacattgggcttgggtggcntgcaagggggtttaacangtngggaattcnaaaaaattttccnaccgggttccgttctggcgaaggggnctcccctttttgnactggtggaaggatntttnan

SEQ ID NO: 96369 - DNA, 567 bp, Triticum aestivum
  unsure (1)..(567): unsure at all n locations
  Clone ID: PAT_TA_96369
ccgacgacaanaagaaggttgaggaggcgatcgagggcaccatcagctggctggacgccaaccagctcgccgaggccgacgagttcgaggacaaagatgaaggagctggagggcatctgcaaccccatcatccgccaagatgtaccaagggccgccgcgccgggacatggggcggcggcatggggcatgggacgaagggacatgcccgccggtgctggcgggcgcccgggccccaaaagatcgaaggggaggtggggactaaaagctgtttcgtccaaattgtctgcgcgcctaactttgattggggtggttcctgtctccgggtggtccctctggaatgcccgttccgggtgggtggtcaagtccgtnctgtccngtccgtngttcatctaagctngcaaaagntaagtaanttagttggtttccgttngggaggtnccgtttngattctngaaaaaggacaatgnattgggatggantgaactgtttttgcccttggttnggnttttgggnaanccctntggatgcctttaaaaagccttccccgttttttttaaagntttaaan

SEQ ID NO: 96370 - DNA, 234 bp, Triticum aestivum
  unsure (1)..(234): unsure at all n locations
  Clone ID: PAT_TA_96370
tgcanatcnggtcagnccacntacacanagcagagnggataanctcgagggcantanatcatcancaaccatgtcnngctgcggaggcaactgcgggtgcggntccggntgcaantgcgtgnaacggctgcggagggtgtaaagatgtnccctgaagattcaactnanggggtgatcaccacctcccagagcctcatcatgggacgtcncccccntccaagggnaccccgtccc

SEQ ID NO: 96371 - DNA, 368 bp, Triticum aestivum
  unsure (1)..(368): unsure at all n locations
  Clone ID: PAT_TA_96371
ttctcttttcttgcttgtttcccaagaaggagaaggagaagagcggcggcgtctgatctcgtcggcggcggcgatggcggcgattcggcgtctgatcccgtccttcaaccgggtgctggtggagaaggtggtgcagccccaagaagagcgccggcggcatcctcctcccggagacctccaangcaagctgaactctggtaaggtcatagcctgttggtccctggcaancccgtgacaagggaacnggaaagcttgatccccttgtttgcctctcaaagggaangggtgacnaatggtgccncnttgccctgaagttatgggtnngggncctttgaaantccaaangcttggcctccctngaagaaaag

SEQ ID NO: 96372 - DNA, 280 bp, Triticum aestivum
  unsure (1)..(280): unsure at all n locations
  Clone ID: PAT_TA_96372
gatnagattaaggcagncgacacagagcagagcggngtaaactcgagnggagattcgatcatcaccacaccaaccatgtcntgctgcggaggcaactgcggggtgcggatccgggctgcaaantggcggtaaacgggctgccggagcggtgcaaagatgttacccctgcanatgggacgaagggggggtgtancaccacctncngaggaccctcantcattgggnggtcngccccccttccaaaggggnacccccgttcctttcgaagggccngcccgcc

SEQ ID NO: 96373 - DNA, 174 bp, Triticum aestivum
  unsure (1)..(174): unsure at all n locations
  Clone ID: PAT_TA_96373
gttcggagttaggtacacagntcggnagggtctanaagcttccgttccgttggtggtgancgattggcgggcctcgctagngtccngccgccgcgggtggtcgcgctcagcggctgctcngctgtcggcccgtcgcccggcgaaggtccttcttccaggcanaagtttcgaacc

SEQ ID NO: 96374 - DNA, 494 bp, Triticum aestivum
  unsure (1)..(494): unsure at all n locations
  Clone ID: PAT_TA_96374
ggacgatagtgagtgcggtacactttgtattagcaaaccaccgattgtcactgactctttcagagacgatgagcttccagttctggaacttgaggatgttgcattctttgatgaaaagttgtacgtcttggcggggtttggccaactgatcatatttgaattagacaaggaccttcgtatttcattcatggagtgcataattgactctgtgatggacttaggtggaacactgaatcctttccgagagaggcgtgtatgataaggcagtatctggttgaatgtgggcgggtagactgttgatggtngatacggtggattcnctcctatgggcccaancaaacaaagtgatgactaatccggggcaatgaaccgtacctttttgcncctggtgggttttggaggcaaaaatttgcccccccnccnaaacgtgntgggntggagaaannantaaagttgncttgggttggggcaagnccaantntttgtcnggnaag

SEQ ID NO: 96375 - DNA, 328 bp, Triticum aestivum
  unsure (1)..(328): unsure at all n locations
  Clone ID: PAT_TA_96375
gcgcgagggacgaaggaggggcagggcgaagaccttccggggaagactcccanccataccgcgccaccgagcgagcgaagatcccgccctttccccttctccacccaccccgccctgccgggaccccgagtccccgatnttgatctccgccgccggccngcccgcgcgccgggacaaagattggccccccgtgtccgngctcttgggccananatacaaagcctgngtccttcctccgtgngaaccaggtcnggtcgngcatntaaccaagcaattantcnncccgcnttcantggttcngaccanngcttccgagcaaacaacctta

SEQ ID NO: 96376 - DNA, 354 bp, Triticum aestivum
  unsure (1)..(354): unsure at all n locations
  Clone ID: PAT_TA_96376
tttttttttttttttttggaatctggattctgcacttctatggcagggaaagaggaaatggnattctatgctcaacaattctccatggggaacggaaacaggaggctccaccgncgctcaggctcaagctctgaatctatcttgggangctccggcggcgggggtccaacgcgggccanagcttggngtcncggtantccctgacgaccatggtacgcgccgggngggggactgacccttgtggctcccgggctctcactcncgaatagccacgaccgggnanccccgcggccacgccggggctgcacnccgacgacgggngtcctcgaacaccanaagaccgntccgccggac

SEQ ID NO: 96377 - DNA, 405 bp, Triticum aestivum
  unsure (1)..(405): unsure at all n locations
  Clone ID: PAT_TA_96377
ttttttttttttttttgcctcaaggtgactgaataataactaactctcttgcctcaaggtcactacaccacctcattcatcttctcatggatgctttgcttcattttcatttcactacactgaacagagcagcagcagcagcatcagaaagagagacagcattgttccaccaacaacaaatcagccaggtcaattgcctactactactactactactactactagtactagtactacctattacttggngaatgagttaacaggcatgggnatcaacacccttcaaatcctgccttctcttcttcccaantcccattccttcaggcggctgaacgatgcccaaatggcccggancgacctttcctccgggnanggtaacnttgccntcccacacaagggcaactc

SEQ ID NO: 96378 - DNA, 467 bp, Triticum aestivum
  unsure (1)..(467): unsure at all n locations
  Clone ID: PAT_TA_96378
ggacgcggcgtcgtcttccatgacccaagcatctccaccgtctccacccccggcaagcccgcgaacgcctccaccggcggctcgccggatccttcgccgtttcgcggcggcgctggagcagcaccgtcccggcctccgctccggctcctgggcccctgcaggcctccacctccccggctatgctgcgggggggccgtcctcctcctgaagatcgccggcgctgggcgccatcggcgacggccggcgggatcccgtggggatggcggttggaatggggggaattgaccccaaccgccccacctcccaagttccccttatccgctccttcggcggcgctgccatgggcctgggccgaaaggcctcgtgggctgtggcccacgttgcaaaaaccagcangaaaaaaaaacaaaacaacgggggataagctaaattgcannaaaatcctcaaattatcgggaanttncgtn

SEQ ID NO: 96379 - DNA, 462 bp, Triticum aestivum
  unsure (1)..(462): unsure at all n locations
  Clone ID: PAT_TA_96379
gtcgccncctcctaaaccactctccctanccccgtgtcnagaagctancccccggctccaatggcngcgaaggaancgatncncgtgctcgtcaccggcgccgcaggacaaatccgatatgctcttgttcccatgattgccacggggagttatgcttggtgcanaccancctgttantctgcatatgctggatattgantttgctgctgnanctcttaanggtgtcaanatggagttgattgatgccncatttccacttctcaaggganttgttgcaccaantgatgttgttgaggcctgcantggtgctgaatgttgcnagttatggntggtggnttccccaggaangaaggaatggnaaggaaggatgttangacgaaaaatgtttcaatctacaaangctcatgcatctggctcttgaagctcatgcaagcccccaattagaaaggtatctggttgttt

SEQ ID NO: 96380 - DNA, 309 bp, Triticum aestivum
  Clone ID: PAT_TA_96380
gcaggacaacaccaaaagggctatgaaaacagcactcacaagcacagggaagttggcaaaaaggctacattatattggcatgaaatcggagcagtgcctggacaccagggatagtatctggtgagttcggtcagcacatcgtacccaacatgcttagggagcattgcctttgcccttttgatgttcttctatatcctgttatgtttgtaatggaaggtaccacctggtagtatgttgctgttctcactttgctttgaacaagtcatgtataaactttaagttttagttcccaaaaaaaaaaaaaaaaaa

SEQ ID NO: 96381 - DNA, 232 bp, Triticum aestivum
  unsure (1)..(232): unsure at all n locations
  Clone ID: PAT_TA_96381
gcggtggaggntagccggggnggnggcggnnaccctgtcncanagatgagttcaagggatgcaccttgtatncccaacattggttacggntcngacaagaanacgaggnattaccttcccaacaaagttcaaaaantttgttgtccacaatgtctccganctggntctgcttatganncacancaggtaatgtgtntttatcatgccnccangganttcgatgtcgctcaac

SEQ ID NO: 96382 - DNA, 276 bp, Triticum aestivum
  Clone ID: PAT_TA_96382
gagaagctagatgccgccggagaacccttgccttcctactgtctagatgaccccaaagctagacctagcttgttccatcttctatcttcgttttgattcgatcctggcgagccctagactggatcgatccatctccttttagttcctagtgtttttgctttttattgaatcctggtggttgagttcttgatccatggatggtcttgatctgtgcgtggttgagttcttgatccatgggtagttgagttgtatttatctgtctgaaaaaaggggggg

SEQ ID NO: 96383 - DNA, 502 bp, Triticum aestivum
  unsure (1)..(502): unsure at all n locations
  Clone ID: PAT_TA_96383
caacaaatcccatcccgaaacctcgtcgacctcgaatggcggtcgcgacctcctccttcgccacgctcgccatcacccgcccggnggcgtctggggaggcggatanagggcgctcctcgcctcnaaggtcccctcgtcggccctctccctccgcggnggccgcgtcgcttccccggacctctcngtctcccancagaagccgcgcgcgcttcgtcncctccgccagcgccgaacccctatgcacctgagcttcagnccaancttacanncanggtgtactttgataatanggcattggcaaccctgtctggggaaagaatgtttgggnaagggattgtccntctngggcctctaatggggggatnaaatgtttccancaanacccggtntgangaaantttccgtgnaacnctggaanctgggggaagaaaaangggtttcgngataacaaaagggaatcaacggtttttccaacccngtgntcantttaannganctttat

SEQ ID NO: 96384 - DNA, 319 bp, Triticum aestivum
  unsure (1)..(319): unsure at all n locations
  Clone ID: PAT_TA_96384
cggcggcggtggtggncanccngtcacacggngcgcaaangcngcggtggctncngcggcggcggcatgtcactggggctgctgcggncacnggctgntccaatcaccaaggactgccgctgctgtgtcgcgcgcggactangttccggagcccatgtnccgggcgccggcggcaggtctacaactgacaacacnatcgtanacnaaatgtagccatggcacacgtgcntacngtangcactaactgctgcncagtgacctanccctgcngatcgcaacctctaacnctgcatggccggttgcttcctggcacctccta

SEQ ID NO: 96385 - DNA, 469 bp, Triticum aestivum
  unsure (1)..(469): unsure at all n locations
  Clone ID: PAT_TA_96385
tttttttttttttttaatgaatggnaactgtttccaaccttcctgcacatcactgcattttgcaaatcgttgcttgcacatcgacagcatatggcacttgagcgggaaggaacgtgaacgtgcgaccatggatgaatcacaaaagctcccaacacttgcagatatcagataagcatgtgtccacatctgcagcctggctagaatggcttctgcagcagcgcggtgaggtagacgagctcgtccttggcgccaatgccggttttgtcggcgacggcccacttgatggtcttgtagcccagcctccgcagcatggctgcgtacacgccgtcgaggtcgcccttccggcaccagaggtgatccacccagagcagcccgcccgggcggcaagcacccggtccgcgtcgtaccacaagaactccagtgccggctccgggatccaacgggttcaccgcgtgccccgccccgcacn

SEQ ID NO: 96386 - DNA, 476 bp, Triticum aestivum
  Clone ID: PAT_TA_96386
cgcgcgaggtggagaagcagggcacgtgcatccatttccagctcggcattcccggcgtccggccggccggctgccgcggccttgcctggctgggtagtgcgtcgctcgatccggccgtgcgccggcggccggcccttgcatgcatgtgcctttcttctccaccgtgcacacctcgcctgcgcgtgctcgcccgcatgttgtggtgtcagctctgcgtgatatcggaagctagctagccatcgacacggccggccgagcttgctgctccacacggcaggaagctaaccgcggttatttggtgttttggaagcagattgcagtctgcagcagccaggtatgaaactgcggcatatggcttcactttcgacaacaccactcttctgaatttgcccttgcagatatatatgttcttctccatcttttcaatgctctaaaagaaaatcattttatgctagtactccctccgttcctaaata

SEQ ID NO: 96387 - DNA, 459 bp, Triticum aestivum
  Clone ID: PAT_TA_96387
cccaagtcggactcgccttcctcctccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctgggagcggatggtgttgctaacatcaatgttactgactgccatatcccccttactgggaccaaattcaattgttggccgtgctgttgtcgtccatggtgaccg

SEQ ID NO: 96388 - DNA, 193 bp, Triticum aestivum
  Clone ID: PAT_TA_96388
atcaaggaggatcacgcttccagatgaatatagcgtaaatgaaggtatccgcaagcgatcctttgtacttgaacacattatccgtcatctacaactattacccttcatgtgtttaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 96389 - DNA, 246 bp, Triticum aestivum
  unsure (1)..(246): unsure at all n locations
  Clone ID: PAT_TA_96389
atcagatacgagatngntatnagggnctggaggaggaacgcggcgnagattggccccggcgcacctgtgnctgtggntggnnctcctcaccgccaccctgttgntcgcccagggtacnaagtcgnacctgtctcgaggtgacgcacacaggtctacttcgacattnntatcnatcgcaagcccncaggtccgnttgncanggaacttttctnnaaggntgttcctaaattcgcagngaacttcatg

SEQ ID NO: 96390 - DNA, 424 bp, Triticum aestivum
  unsure (1)..(424): unsure at all n locations
  Clone ID: PAT_TA_96390
cgananggggtttcccggcgggtcnccggcgggctctgggaagtgggcganatntcggacggncgcaccgcggttgtaaataatggtgttttangacttgattaaggcatttgcgggcangcggggccgacgtcnacgcantggaatatggtttctccggttccttccccgtcgtggcggtgctctctccggcggggctgcaaggttanggaggttggtctctctccggttcgggcaaccggcgaggtttggtcngtgaaaggcgtgtacaagagttgggattttgtggaganggatttccanatncggtcaacgcgggacgaatggcaaactgcgggactgtaatgggcgaatgggtggagcctaactgctccactcccggngaaangctttcncctgggggcaacttccaaaaaaaaaggaa

SEQ ID NO: 96391 - DNA, 478 bp, Triticum aestivum
  unsure (1)..(478): unsure at all n locations
  Clone ID: PAT_TA_96391
ngctcgccggcggctcccgccctaacgaaagcggtggtgaccgcnggggtcncggcggcggtggctaccgtggaggcggctatggcggtggcggcggcggctacngaggtggcggcggtggctacagcggcggtggcggcanctaccgcggcggtggcggctaccgangtggtggtggcggcggccgctaccgaggangcancggtggcggccgtnagtgctacaaatgcggcgaggagggccacatctccanggactgcccccaaggcggcggtggcngtggtggtggctacagaagcggtggcggccgtngcggtggtggtggcggtggcggctgcttctccttgcggcgaatccgggcacttctctcgcccagtgccccaacaaagaccaaactaagcgggcgctgcccgtcaaatttgaagtttcccgtttccccntccgctnccttttcctaacngcctgaatcttncaacaa

SEQ ID NO: 96392 - DNA, 227 bp, Triticum aestivum
  unsure (1)..(227): unsure at all n locations
  Clone ID: PAT_TA_96392
ctccgttcaaccctcctaaggntcnacgccctcnccaaaangcggggaaaccancgnccanctcgccgggggggttcgcgggcaaaaaaangggtggngggtttcgggtgntgcatctggncangnccttcttgggcttnttgccggaagtgcaaantgctgacaagnaaataccanttatagaaaaagtgntntacancggcaattctcncctcaatttcccgggg

SEQ ID NO: 96393 - DNA, 202 bp, Triticum aestivum
  unsure (1)..(202): unsure at all n locations
  Clone ID: PAT_TA_96393
gcaataangngcttcctcnccctcctcaagcaaagngaagaagcaagtcacganagatngnaagggcagttgaagggccanagatnctcnccgcggccgccgtccnccgtggncttcgtctcgtccttgnttcgccactngnactncgcggctcgacgcgcccggccngtgtttacccaccctcctgtgngnccanccgccg

SEQ ID NO: 96394 - DNA, 481 bp, Triticum aestivum
  unsure (1)..(481): unsure at all n locations
  Clone ID: PAT_TA_96394
ccgccgccccccatgccgcccagacgacgccccggccacccgttgatattccgtcttccagacggtcgaagcatcaatgtctacaccaacgacgatggggattttgtcaccggcggatcggagccacgactcgtctctgatctctgcagagaaatcaactccgaaatgcagcgccagcgcgacctttcccgcagccgcctctcccttcctccatcagctaccacctcccctccaccaccagccgatcctctcttctcctccaccaccaccaagccgaccctctcccctcctctcctgtccgacatcggccgcagcgtccagtgccacctcccctccgccatcaggnggcgcatccagggncacctcccctcctctcccctccaccaaaaagccggattccctcccctcctttcccctccgccaccagctgcagtctccacaaggccgattccctcaacaacaactggangcctccacaacn

SEQ ID NO: 96395 - DNA, 470 bp, Triticum aestivum
  unsure (1)..(470): unsure at all n locations
  Clone ID: PAT_TA_96395
caggactcttcatcccttcccgtctgacccggccttcccctccccgactacaaaatccccgccccgctctcctctcccgtccaccaaacctccaatcccccctccgcgatctcaccgagaaaatcctcgaccgaccgaacgacaaggccctctcatcctcctcctccaagatgcagatcttcgtgaagactctcaccggcaagaccatcacccttgaggtcgaagtcgtctgacacgatcaacaatgtcaaggccaagatccaggacaaggagggaatccctccggaccagcagcgcctcatctttgctggcaagcagctagaggatggccgcaccctggctgactacaacatccaagaaggagtccaccctccacctgggtgctccgcctccgcggaggcatgcagatttttgtcaaagaccctcaccggcaaagacatcacctttggagggtggantcctcggacacc

SEQ ID NO: 96396 - DNA, 478 bp, Triticum aestivum
  unsure (1)..(478): unsure at all n locations
  Clone ID: PAT_TA_96396
gcttattgattgtaccgtccaaacaaggngtcnggtgcagctaccgaaacattcaaaacacangtccaggttgattctacnaaccacctcnaagangnttatnagtacaccaaaggtgctgntacatcatcncaacgccaggagaaggagggtcctcntcctggaaagtactttggcaaaacggnatgcacattaactgggcaccactangtgggaattggtgaacaatgggcaaggntttttgatantaatgctanggntaatgaggngcatanatgataggtcatcnaactacnatgacacgcncattctcnttacancgttctcgggganantcncatcccgcaccaattgncacntgngcngacatcgcctgggnttttgcaacccttcccatcaagganaagagcaaatctttcaaaaaggnggcacccaaantttnttctgccaangggaanaaactgctggaagattncnn

SEQ ID NO: 96397 - DNA, 479 bp, Triticum aestivum
  unsure (1)..(479): unsure at all n locations
  Clone ID: PAT_TA_96397
gaaactaaagcangtgttggatttaaagctggtgttaaagattataaattgacttactacaccccagagtatgaaactaaggatactgatatcttggcagcattccgagtaagtcctcancctggggttccgcccgaagaancangggctgcagtaactgccgaatcttctactggtacatggacaactgtttggactgatggacttaccaatcttgatcgttacaaaggacgatgctatcacatcnagcctgttgctggggaagacagccaatggatctgttatgtagcttatccattaaacctatttgaagagggttccgttactaacatgtttacttccattgtaggtaacgtatttggtttcaaaaccctacgtgctctacgtttggnggatttacgaattcccccnacttattcaaaaactttccaanggccgcctcatgggatccaagttgaaagaaataaagttgtacaang

SEQ ID NO: 96398 - DNA, 380 bp, Triticum aestivum
  Clone ID: PAT_TA_96398
gtactattatcgacttctttatttttttcattcaattccgtggtgatatatgctgcttggacgaaacaattggttcttatttttaataaaagttaacgtaagtgatttgtttgtgccaagcccaaatagtcaaaataataataataataataaactgttcccaaccaaacaaccatctgtaaaaattccctaacaaaaatgctcaaaaaatatctgtaaaaaaagttaacacggtaaaaatagctttaaaatgttcatagttttacatatgttcacactatttttgtttcaaacaattatgtttgcatttaaaaaaataaaaaaaaatcccaaaacaaagttccatttttactaaaacaaagtccatttaaaaacgtaca

SEQ ID NO: 96399 - DNA, 400 bp, Triticum aestivum
  Clone ID: PAT_TA_96399
actcgtgtcgactagttctttttcttcccgccaagtctcgacactgcagtctaaactatgttagcctctacaggatgtgagatgcacatctctgtctaagcaggctttgacgaaacccaccacatgaaacacaaggcaagcctgtagcagattcgtccgtctctcaacttcaaagggcactgctacccttttacaatctcccggtagaacatgttgatgaaatcatcattctgcacaagcctcagcaatgcacctctcaggttgtctcttgatagtatcactgggccatacgatgctgttggggcaagcagtggaggaggaggattaagtgggtggaaatggctgaagcaacagcgcaccgtatggtggagggaggcattcaatggggccgtgcaaagtg

SEQ ID NO: 96400 - DNA, 495 bp, Triticum aestivum
  unsure (1)..(495): unsure at all n locations
  Clone ID: PAT_TA_96400
gagaacaaccttnntgcggttcgacgccctcgccancacncggcgaaaccaccgcccanctcgccggnggggtccgcggncaaaaaaaangctggcggctttcggggggngcatctggncagggncgtcttggncttcttgccggaaagtgcaagagtgctgacangaaaataacatttagagaaaaagnnatctacaccgtcatttctctcttcaatttccctggagtgtaatcagctccccgctcctatgggatccattcaagcactgggagcaaatnccttcnaccggatgcgtgttattcntgcaacaaaccgtggtactgtcatgggaantgggtaataccccaatttgttanatctggaaaggggtatgnaacntcntgttgggatnccaaagcattaatgaagtttgncaancangtgtttagaanaggattnttnctcctgcctnaaatgggngganaaaaaaanttgcttgggtatnccngaattg

SEQ ID NO: 96401 - DNA, 474 bp, Triticum aestivum
  unsure (1)..(474): unsure at all n locations
  Clone ID: PAT_TA_96401
gagaagatcgatcgttcacccaagctaagacacagatggtcgtcacgaacaaagcgcgtgcgagagagatgacactgataaccgctctcttcgtgctcagctgcctcctcaagacaacgacgacgagccccgccacctgggcgtactcacgtgatgatgcgctcgcctggaggccggcctcctccttactccaccagctccgccacctcggggtccgcgcgctgatccgtgacgacgccgaggccaccgcgctggcgtccgccgacttcggcaacatgtcggacgcccaaccgccggcggcggccgtgctttacccgtcgtgccccgaggacatcgccacgctgctgcgcgcctcgtgcacgcgcccctccccgttccccggtgtctgcccgggggctgcgggcactccgacccgagggcaagcgtccgcaccccgcggcgtcgtcgtccganatgatgtcgctccgggtgccn

SEQ ID NO: 96402 - DNA, 504 bp, Triticum aestivum
  unsure (1)..(504): unsure at all n locations
  Clone ID: PAT_TA_96402
atctcagtcagctccaagccgtcagccatgtccggccgcggcaagggagggaagggcctcggcaagggcggcgccaagcgccaccgtaaggtgctccgcgacaacatccagggcatcaccaagccggccatccggcgtctggcgcggcggggcggcgtgaagcgcatctcggggctcatctacgaggagacccgcggcgtgctcaagatcttcctggagaacgtcatccgcgacgcccgtcacctacaccgagcangcccgcccgcaaagaccgtcaccgccatgggacgttgtctaacgcgctcaaagcgacaaggggacgcactcctctaccggtttccggcgggctanggctgnngccccgcttgctggctccaatcgagttcnactcctgcttggattcttgccgttccctcctgccantggggttncgnttnctgaagtggcctngtccctgctgtttccnataaggtctgttgttanttnantaaaaaaggggaatgg

SEQ ID NO: 96403 - DNA, 350 bp, Triticum aestivum
  Clone ID: PAT_TA_96403
atcataccatctttcgggactgattggtcgccgtgcgcccatgctgtcattctgcaattctgaggacaaattgaacatcttagcgtaatttttctaagtacttctgaacttatttgtcatctacttttcagtttttttatttgttgtttactatttatagaatatgactggacaatgatgaaaaccatgaacaaaacacaccatctttcgggactgataggtgcactctttgtgccatgctgtgaaaatctgcaattctgatgttcacatgctatgctgtaattttggagactgaatttaatgtcgaaatgttaattgggctagaatttttcaaaaaaaaaaaaaaaaaa

SEQ ID NO: 96404 - DNA, 212 bp, Triticum aestivum
  unsure (1)..(212): unsure at all n locations
  Clone ID: PAT_TA_96404
gagagagacaganagagaggangcaattnagctgtgacgcaacctgtcgcaattgtgtcatgtacgagatccactttgccagtttcatactatcggtacantgggctggtgaagatgtttttaatgtacaaaagattaaacnacaggaatgatnaagangaagctcgcaaggaagtcagtcntgagactgaaaatggntcttcaactagtat

SEQ ID NO: 96405 - DNA, 430 bp, Triticum aestivum
  unsure (1)..(430): unsure at all n locations
  Clone ID: PAT_TA_96405
ctctctctctctctcnctctctctctcactctctctctcttttcangggctcaantncaccgccggcctccccgtcagccgccgctccaacggngctagcctcggaagcgtcagcaatggtggaaggatcaggtgcatgcaggtgtggcccatcgagggnatcaagaanttcgagaccctgtcttanntgcnaccgctcagnagggaggccctcctcaagcaggtcnantacctgatcngctcnaagtgggtgccttgcctcgagttcagnaaggttgggttcatcttccgtgagcaaaacgcatctcctgggtantacnatggccggtattggnnaatgtggaagcggcctatgttcgggnngcactgacgccacacaggttgatnaacnaaggtggaggagggtcnaanaaagagtaccccttgaccc

SEQ ID NO: 96406 - DNA, 464 bp, Triticum aestivum
  unsure (1)..(464): unsure at all n locations
  Clone ID: PAT_TA_96406
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcaagcacgngaggccctccttaagcaggtcgactacctgatccgctccaagtgggtgccttgcctcgagttcaagcaaggttggggttcatcttccgtgagcacaacgcatccccctgggtactacgatnggcggtactggacaatggtggaagctgcctatgttcggatgcnaccgacnccacgcacgtgatcaaccaggtgggangangtcaanaaagaataccctgacgcctatgttcgcaatcatcggn

SEQ ID NO: 96407 - DNA, 472 bp, Triticum aestivum
  unsure (1)..(472): unsure at all n locations
  Clone ID: PAT_TA_96407
gaattcttaattcaagagttatagggagggacttatgtcaccacaaacagaaactaaagcangtgttggatttaaagctggtgttaaagattataaattgacttactacaccccagagtatgaaactaaggatactgatatcttggnagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacagccaatggatctgttatgtagcttatccattagacctatttgaagagggttccgttactaacatgtttacttccattgtangtaacgtatttggtttcaaagccctacgtgctctacgtttgggaggatctacgaantccccctacttattcaa

SEQ ID NO: 96408 - DNA, 461 bp, Triticum aestivum
  unsure (1)..(461): unsure at all n locations
  Clone ID: PAT_TA_96408
gcccccctcatcacatcccaccccaaactcaacctccccacacgctccaaccagcagcacccatggcacccaaggcagcagagaagaagccggtggccacggcagagaagaccaccgcggggaagaagcccaaggcggagaagcgggcgccggcgtccaaggaggccggcggcgaggggaagacgaggggcaggaagaagggcagcaaggccaagaagggcgtggagacgtacaagatctacatcttcaaggtgctcaagcaggtgcacccggacatcggcatctcctccaaggccatgtccatcatgaactccttcatcaacgacatctttgagaagctggccggggagtccgccaaagctctccgctacaacaagaagcccaacatcacgtcccgggagatncaaacctccgtccgcctcgtcctcccccgngaagctcccaagcacgccgtctccgan

SEQ ID NO: 96409 - DNA, 469 bp, Triticum aestivum
  unsure (1)..(469): unsure at all n locations
  Clone ID: PAT_TA_96409
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgccctcgaagttcaagcaaggttgggttcatcttccgtgaggcacaacgcatctcctgngtactacgatgggccggtattggacaatgtggaaagctgcctatgttncggggtgcactgacgccacacaggtnatnaaacgaaggtgggaggaggtcaaagaangagtaccctgacgcgtatgtccgcaatcatccng

SEQ ID NO: 96410 - DNA, 491 bp, Triticum aestivum
  unsure (1)..(491): unsure at all n locations
  Clone ID: PAT_TA_96410
ctcgtctggttctcctccgatggccgccgcgctccaccgccgtctcctcctactcgccgtcctcaccgtctccgctctcctcccccgcgccgcggccgtacgccccttcgtgctggtcctctccggcgaanacttcctcaaggacccctctggcgcgcacccctcgctgccatccgccgacggggacagcgaggactgggatgacttcgcggacgactcccccgccaccgaccccctcctctccccgtcctcctggatccccctccttgaccccaacaccccctccccgtcgggcgatnagcangacccaccgtccgatgcgctcttcgtcncgggcgtncgcgccatgatntcancggggatcatcgggggacgaanccgctttntccactgcgtncggcgcaagattcaacgctgnaagccactggggggganaaccccngggnaacaaatcaanngcatggggtttcntcttncgngagctnggaatg

SEQ ID NO: 96411 - DNA, 475 bp, Triticum aestivum
  unsure (1)..(475): unsure at all n locations
  Clone ID: PAT_TA_96411
agaagctcgaggccatggccgtggacgcgctcatgatccaggccgagatggccgacgaggagccgccgttcgaggtagcgccggctgcgggggaaacgaacgtgttcgacgcgctggtgccgtccgacgagtggtccgagtcccgtggcggctcggacggccgcgtcacgctggtggcggccatccagctgcgtgacccgtcccggcgctacgaggcggtgggggcgccgatgatcgccgtcgtccagtcggcgcggatgctgggcgcggcggggctcagcggggggaggttcaaggtgaggagcctgcacctgggcggagtgcanacgaggtgcttgtcgggagtcggcggaagcgcgagctggcgcgcccagccggcaaaaagttgacgggcgatngcagttgggacgctcccccaaggggccggggccgcgccngccnaaanagggtggnaaacnccgccaatccgtcccng

SEQ ID NO: 96412 - DNA, 317 bp, Triticum aestivum
  unsure (1)..(317): unsure at all n locations
  Clone ID: PAT_TA_96412
cgccaccgcgcccccaccggccgcctccagggacagcgagcgagagaggagggagggggctcgtcggtgaanatggtggncgtgtcgcgcgtgcatacggaactgatctgagtgcanccgggantcgcgatatctccaggcgtctcnatcgngctccacgacgggggctccaggcatcacccanctcatnggnaccatcgccggggcctcgcnacagcccctancagggcntcaccttccgcatcgacatccgccctaccangtggctatnccctttgagcctccnaagatgcagttnatcancaaaagtatggcac

SEQ ID NO: 96413 - DNA, 469 bp, Triticum aestivum
  unsure (1)..(469): unsure at all n locations
  Clone ID: PAT_TA_96413
ggcggcggngtaaggtttcacctgcatccattctcaacgttagcaagagcgagtgggagtccggccatggcgccgtcccancccaagtcagggctcttcgtgggcatcaacaagggccacgtcgtcaccaagcgcgagctgccgccacgcccgtccgaccgcaaggggaaangtaccaanagggtgcattttntcaggaacttgnttanggaggttgctggattcncncccnatgagaaacgtatcacngagcttcttaangttggnaaggacaagcgtgcactcnacgtcgccaanagaaancttggtactcacaacagagcaangaagaagagagaggagatgtcaantgtccttatgaanataagtctgctggtggtggtggtgctgntgacaacaanaaataaaancntggctanttggtgaanttttttccgcnaaaccccgtcccngtnnttacaaatcccct

SEQ ID NO: 96414 - DNA, 406 bp, Triticum aestivum
  Clone ID: PAT_TA_96414
gcagtctgcagcactcctgcccacgcttcttttctgcggtgttgtgcgaggacagcttagttcgtccatatggtcggcaacgtcagtactatggaacttaagcaaacgaagaagaatgattgatgtgttcccgcagaatgccgcactgctccattgttttttttttgtcttccatcagtcagatcagtattttggaggcatatccagtccaagtgtgattccctgggaattttttcataagtgacacccaatagttttacctcgtggtttggagaactatgctgcctactgcgtctaaaatctgaaagtatgttatgtggccgtagtttgcatcatcttttgtcgctcttccctctagttattgattcaaatccctgtcgtacaaagactagtagacctgtcatat

SEQ ID NO: 96415 - DNA, 513 bp, Triticum aestivum
  unsure (1)..(513): unsure at all n locations
  Clone ID: PAT_TA_96415
aatctcctcagcctccctgccggngcatctccgactccatgggccgcaccaagcagacggcgaggaagtccaccggcggcaaggcgccgaggaagcagctggtcaccaaggccgcccgcaagtccgccccggccaccggnggngtcaagaagccccaccgcttccgccccggcaccgtcgcgctccgcgagatccgcaagtaccagaagagcacggagctgctcatccgcaagctccccttccagcgcctcgtccgtgagatcgcccangacttcaagaccgacctccgcttccaagtcctccgccgtctccgccctgcaggaggccgccgaggcctacctggtgggcctcttcgaggacaccaacctctgcgccatccacgccaagcgcggtcaccatcatgcccaaggacaatcaagctcgcccggcgcatcgtggaggagagggncctagggctgcagtctgcaaatcatcgtcgtcctgtttaagattccctgttagccctgaagttng

SEQ ID NO: 96416 - DNA, 488 bp, Triticum aestivum
  unsure (1)..(488): unsure at all n locations
  Clone ID: PAT_TA_96416
gctaactgtgccctgtatgtaagctgatnaatccacctcacgcgatnccgcgagccgatgcgctctgccgcgcgatccatccacgccctcgccggcgccgaagtatctacctagctgcgcagcgccgccatgtccggcgagctctccacgctctcgtcgccctcgttcgccgcctcgccctccccggccgacgacgcgcggtcagcaggagagtcgaccccgctgcaggtcgaggccgaggccggcagcaggtccggcggcagtggcagcaccggcgtgaagctccggcggcggtggcagcggcggcggcagcagctggggcagtggcagtggcgcgtcggggacacgtgggcgctggacccgcgcgcgcggtgggtgcgggagtggaaacgcgcctacctgctggcctgcgcggnggggctcatggtggaccctctcttcctgtacgccgtgtcggtgagcggcccgctaagttcgtctcctcgacg

SEQ ID NO: 96417 - DNA, 599 bp, Triticum aestivum
  unsure (1)..(599): unsure at all n locations
  Clone ID: PAT_TA_96417
cgtttctctccttctcctccggcgggggcaangcattttggcatcttgagccccaaacagctagcanatggcaggcnggcagaagttgcacatgcnaccctcaaaggggcccgagcgtggtgaaaggagatcttcattgggnctcacccttgggctgggttgctggtgggtatgttggaaagatgcatcactgggnaacgagcangaggaaagaccccgattccttctatgacaatgctccgagaaagggggcagattcaagccgtccgtttgtcnnaagggagtanttcttgaaagtggcttgaaacccaanaaaagttctacatcctcgaaaagtcttttgtcaattttggggttttttgcccaggtaaatttcttgaaaactcctctggggaggaagcaatgaacaagaagttgatttggctgttgggagaatttgtcaattgaaaanaataagccacaaccnacccatttttgaggaaacaatncganatccanttttgaaattttgcttttttggtccctaaacnaaataatgtccttgtcctcaanaatggntggtttgcnaaacaaaatttcaaggggtttggggaangggn

SEQ ID NO: 96418 - DNA, 511 bp, Triticum aestivum
  unsure (1)..(511): unsure at all n locations
  Clone ID: PAT_TA_96418
ccacgggctcncgccgtcctcctcctcctcctcctccggcgctgccgcggcggcgccggcgaactcgccggagttcttgctgccgccgaagccgcctcccgctggaggacatcctcttctgcgtcgacgtggacgccgaggcgcgctccgagatgaaggtcgccgccgcgtccgcgtcccccgcctcctccggctccaccggctcccccggccccggcgcgctcatggatccggcggcgcccccccgccccgcgcgcccggcggtgcggcggatggacgccgtcaagcangcgtcatgctcttcctccacagcaagctcaaccatggtgtcccgaccaccgcttcgcccttcgcctccctccgcgacaaccggtctccttgataaagcaaaagaattcaccaagttgatgctgcttctttaaatttgatacaaatccggtcgtttggctggtaactgaaacgagaatatggaagtngggctgatntcactcaatctccttcaaagatangg

SEQ ID NO: 96419 - DNA, 535 bp, Triticum aestivum
  unsure (1)..(535): unsure at all n locations
  Clone ID: PAT_TA_96419
agcccaagggctcctccctccccaacctaccggcgcatctccgacgacatggcccgcaccaagcagacggngaaggaagtccaccggcggcaaggcgccgaggaaagcagtggccaccaaaggncgcccgcaagtccgcccgggcaccggnggcgtcaaagaagccccaacgcttccgccccggnaacgtcgcgctccgggagattcgcangtaccagaagagcaccgagctgctcatccgcaagctccccttccagcgcctcgtccgcgagatcgcccaggacttcaagaaccgaccctccgcttccagtcctcccgccgtctcccgcgctgcagggagggcggccggagggcctacctcgtcgggctcttcgaaggacaacaaancttctggggccatccaacgccaaggcgccgtcaaccnatcaatgncccaaaggaaaatccanncttngcccggccggnatnccttggggaaaaggggccttaaggccnccaattntggaaatccaatgccgttcgtcctggttaaant

SEQ ID NO: 96420 - DNA, 585 bp, Triticum aestivum
  unsure (1)..(585): unsure at all n locations
  Clone ID: PAT_TA_96420
cttggcancattccnagtaagtcctcancctggggttccgcccgaagaagcaggggctgcagtagctgccgaatcttcnactgggtacatggacaactgtttggactgatggacttaccantcttgatcgttacaaaggacgatgctatcacatcgaagcctgttgctgggggaagacaagccaatgggatctgttatgtaacttatccattaagacctatttgaaagaagggttccgttactaacatgtttacttccattgtagngtaaaccgtatttgggtttcaaaaagccctacgtgctctacggtttgggagggatctacgaaattccccctaacttattcaaaaaaacctttcccaaagggccccggcctcaatgggtatccaaaggttgaaaangaagataaaagttggaaccaaaagttaatggggtccntccctttaaattggggggatggtacctatttaaaaaaccaaaaaaatttggggggaattaatcccggcaaaaaaaantaatgggttagaaagccgtgtttatgangttgtcctaaccgtgggtggancttgatttttaccnaaaaaa

SEQ ID NO: 96421 - DNA, 526 bp, Triticum aestivum
  unsure (1)..(526): unsure at all n locations
  Clone ID: PAT_TA_96421
ctgcaggtttttttttttttattcgaatttattctcttcatgcaagtaaaaacagcgacaaatggcacaaaaggcagcatgccctagctgttcatggtgtaaatggaatggagaacgacgagtaagtggaggacgaccgcgacgaagccacaggcgagagcccccgtgacatggtcgcagaaagtgggcactancccgcagatcggctgccagcccgcgtggctgttcccgttcttccccagggccgatatggcggccgcggccgcggccgcgccggtgagcaccatgccgagcaccgcgtcggccacgaggacgtgcctcgcggcggggctcgccggcggnacgaggagggccaagaaggctgtatgcgcacgcgacnattttggcggccacgaaanaacacgaaaggacggggtgttattggaacttggcctgcacctgtacgccgnaagaccgtgggccgttcttngtggccccgtgncaatgactatncgccggcgaacggccgggncgccggccgccgttn

SEQ ID NO: 96422 - DNA, 477 bp, Triticum aestivum
  unsure (1)..(477): unsure at all n locations
  Clone ID: PAT_TA_96422
tcagtccttaagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcaagctgcaactgagccggcgcccaagaggccggccggcagaggcgagcacgaggattgaggaggacaagcaagcaagcaccatcaccaacagttcaacaccaaccagcgtatcatcaacaaccgccgcatgcgctcncgggggcgcgccgctgaataaaataaaaacaaccgttcgtgtttccttagttctgtatgn

SEQ ID NO: 96423 - DNA, 548 bp, Triticum aestivum
  unsure (1)..(548): unsure at all n locations
  Clone ID: PAT_TA_96423
ctctaagtcgattacacacgctctcctcgccgccaagatgttcgggttcgggcaccaccacaaggaccaggcgccggcggngtcgggccccaaccagatcttcaagatctactgcngggcctcggaggactactgcctcgccgtccgcgacggcgaggtggtgctcgcccccgtcaaccccaaggacgagacccagcactggctcaaggacatgcgcttcaagcaccaccgtcaaggacgaggagggcatgccggccttcgcgctcgtcaacaaggccaccggcctcgccgtcaagcactccatcggccagtcccaccccggtgaagctggtgccgttcaacccggcgtacgaggacggcggtcggtgctggtggacgggagaagcaaagggacgntggggcaaaggggtttccgctgcatcccgcnatgggtcaaacaaaacccgcctcaaacttcgacgccctcaaacgggcggacaaagggaccaacgggcgggcngtggcacgaacnngcaancaaccggtcctgcctcttggggagntgggtg

SEQ ID NO: 96424 - DNA, 479 bp, Triticum aestivum
  unsure (1)..(479): unsure at all n locations
  Clone ID: PAT_TA_96424
ccggcctccatggatttcgcaccggagtccccgaccgcgcctcgttcctggatgcaggagcacgagctccctcctccttgttgcacgcatcgctcgccaagccgtcgagccgcccgagtacctcctccagttcgtagccccggccaccaaagctctcaccgccgacgagccttgccaatccccccgccaggtcaaccactccccgtcgntcctcttcctcgcctgtctctctctccctgaccctctctctgcccttggacaggcaccgccgccggagtgncgtacctcgccgccttatcgccccacctgncggatncgccccttccccgccgtccgccggcgtcctgcttctctggagccgcancnccntcccctgcttcacgaaacgagacgaagtgcaacgctcctgcttcgttganctcgaccgcccganccggggcttctantgntgttgaccacctgcccaagggccaattctn

SEQ ID NO: 96425 - DNA, 506 bp, Triticum aestivum
  unsure (1)..(506): unsure at all n locations
  Clone ID: PAT_TA_96425
gggattgttctggtcacatgctcttgataacccatgtggaccagagttccttgctatatccccatcagggtatgtaggcaaaccctggttaaaacttgtacttgtcgatgaacttggcagtacatattgtttatcaggagcaagctggagcagagcagctgtaagccaggtcatcttatcattagagaccctcaactgtttttcagcttcagagagtgttttcaaggcctggcgcagtttttccatatcctcctttgataaggttggacgtttgaagaattttcttcgaattctttcctgtgcgaatgtgtaggtgccancaaggatgtcaagttattattgtggcgaagttgagacattaagggacaaaggctcaacacctgtttcagtaatatcacgcaaagctttcaccgtgntttgcaagtggtcagcnagataagtggccaaatcaaagcanatttaccaantttatcatccagaaaccaaagcccagcnaagttccttgg

SEQ ID NO: 96426 - DNA, 471 bp, Triticum aestivum
  unsure (1)..(471): unsure at all n locations
  Clone ID: PAT_TA_96426
cgccggcgcgccgcgcgcaaggtggctcgccgcggcgctggcgaccgtggccgtggcttccacgctggcttagggtattttatttccctccctggtgcttgatccgttggcgtgatcgatcgtggtgtgacggcgtgctcgtgtagtgcttcttccgcggaagacatactagttgtgtgctcgattttcatctgctttttcttcttctctttagatgttcttattatccgtgagttgccgccatgattctgctcgtgctactacaagagtacaagaccacgcatgagaggtttcatgccatcttgagctccccaagacattgatgttcttttggtcgatccggcgaccggcgaagtgaaaccttggagcgaacttgctccatgccgtgttaacngacgagcgtaaaaaaaaaaaaaaaaaaaaaaaacccaaggggggggcccgggtanccaattcccccctaaangtgan

SEQ ID NO: 96427 - DNA, 466 bp, Triticum aestivum
  unsure (1)..(466): unsure at all n locations
  Clone ID: PAT_TA_96427
catctgaccaaagctcctccgaatcatttcccctctctggctctctgtctatctgctaccgcttcttcgtgatctctagccctgtcaacgaattgtccctccaccccgcgatcgcacgcaagctcgcccctttgatccccgcatagttcttgcgcacacacagaagggtttacataatcaggagggagatggatgtgcaataccacgaggagtacgtgaggaatccaaggggggtgcagctcttcacatgcggctggctgcccgcttcttcctcgcccaaggngctcgtcttcctttgccatgggtatggcatggaatgcagcgtcttcatgagagcgtgcgggttcaagttggccgcggccgggtacggcgtgtttggcatcgactatgagggccatgggaaagtccaatgggcgncaagatgctacaattcaaaagttcgaccaactcctccgccgaactgtng

SEQ ID NO: 96428 - DNA, 172 bp, Triticum aestivum
  unsure (1)..(172): unsure at all n locations
  Clone ID: PAT_TA_96428
aaactccgaccactgccaaaactggagccggcacgccggccgctccagtcnnacctcgccccgcagctccccatactcgcgcncaccctgatgcancaccgcancagnccccaggagccatncaggnagcctacccgcgtggagatgaaggacccgaagngaggnagggggg

SEQ ID NO: 96429 - DNA, 174 bp, Triticum aestivum
  Clone ID: PAT_TA_96429
gggctgcaagttggtttacctgtgtgtatgtggctgagcttaatgcagctgatgccgcaagtatatgtaagtaaatatttcaggaagggaaaagacaatgcagcatgtagtatggacatgatcatatctgtaagatgtgggatcaagtcttgattcaaaaaaaaaaaaaaaaaa

SEQ ID NO: 96430 - DNA, 319 bp, Triticum aestivum
  unsure (1)..(319): unsure at all n locations
  Clone ID: PAT_TA_96430
gacgacggccgccggccgggcaagaaggcgtcgtccatggggccccangcaggaccgggtcggcgtccaaggcgctcgccaacggcacggcggtggcgcccgagaggaangacggcaaggtggtgcactacaaggagtgccagcggcaaaccacgccngccggcatcgggcggctacnccgntggaccggctgcccgcgagtttcattggcgttccgccccccgccgggcggccgaagggcgctcctcttgcgccggncgntgccggnttgccaaccgcnagccttcccacaaatccgcngaaggtggagggcccgttc

SEQ ID NO: 96431 - DNA, 462 bp, Triticum aestivum
  Clone ID: PAT_TA_96431
tggacaagtgttagtatctgggcactacaggattatgaaggcgaggtctctggaccttaaaataccgtgttaaattaccggttgcagaaatcggggtccatgataagctcgacagcgattgggatgtggtggtcggttcttgggatggtgatgtcgtcctgctggttaccattgatggcagcaacatgctatttcaggttgacatcaatggcaagttggttgcgactatcgcctgttgcagagacctctactcagctcatctttggctcaaacaaactctagctttgcatacgttctttccgacacttgagggttatgccgtgaatgcttcgccatttatctgatagcttttatgtgaggtggtgattcaagatggccttactgtcagtatccccatcagttgctgcaatgtgtatgattgaattgagtcacactaaggggccaactagtttcattttgatg

SEQ ID NO: 96432 - DNA, 474 bp, Triticum aestivum
  unsure (1)..(474): unsure at all n locations
  Clone ID: PAT_TA_96432
tcttcccatcggtttgttccccttcacatttgattttcaatccaagcgcagaacgacttggtgggcttctggccagagagatggcaggggaggccggcggagttttgccttgtgagctatgtgggaacttttgccatggcggtgctgacaacaacttcaagatcgacattcgtgatgagttcctgtctaaagcgactgtcccatgcaatgcaagagtctacgtcaatggtgttaccggggactacatgcgttttgaagcccatggacgcaagtgctctgtcgacattgtgaagggggcacacaggaccaggatcaaggggagtggctggaagaaattcacttctgacttttctcttcagaagggtgctgtggtcatttttgacttggacaagcgtccccgccaagcatatgttgtcgctcaaagtgttgacttgcncacaattnaaggaagcaatttcaaacngggaatgctga

SEQ ID NO: 96433 - DNA, 324 bp, Triticum aestivum
  unsure (1)..(324): unsure at all n locations
  Clone ID: PAT_TA_96433
gttttttttttttttttttaaaaaatcatgcataaagaaaccgtgaccatgtctcagaaaaatagtacaagaacattaaaccttgacagaaggagatctaacactaaaaagtgaatgagctaccagaggctgaaggacattggtcaggagttaggacacagcgaggcgcaacagtgatcactcgaccttgggtactatagggacttcaggcctgaaggacattggtcataagtcaagaccatcggcgtgaatctcatcggtgtgcagggaagcatctaaagatgaaggtcgttcgtgccgccgcctggtggattgctanaaaat

SEQ ID NO: 96434 - DNA, 200 bp, Triticum aestivum
  unsure (1)..(200): unsure at all n locations
  Clone ID: PAT_TA_96434
gggagcctccccccaattcgtctggctanggtttccgccggnggngatgggtgntctcgccgacaagcgnaagcgcgtctccggcgancaacgnctccttncctccttnccttnctcgnancaactccctccaagaaanccaagctcgcaccccttctccccaacgnccctcccccgnctctcccctcgnnttttnaaaa

SEQ ID NO: 96435 - DNA, 457 bp, Triticum aestivum
  unsure (1)..(457): unsure at all n locations
  Clone ID: PAT_TA_96435
tgatcaatccactccacatccanagatgggcgccgtgacnttctancnangatgcctccatgcnggctgcgcgcatggnggccagctcnccggagagggtgngggttgccgtngatggcactggcatccatcaagcgncgcccncgccgnngcagatgncctggcactatttcttccgtcggtggaggatcgcttccgtcggtggacgctacaccgagacgtctgcagcaatttggaaggnctttttcccggcgacggatgtggaactcatcgttntccgcgntgcngatctgctgtgaangctcctanncatcgacctcttcctgcatccgtactgcngtggagntgcgggagataanccttgacaacacgctgcngttgntgttataganatnnactaatgtgatttctacgggngtnngtaaancaatctntctanaagangtaagtcacttaa

SEQ ID NO: 96436 - DNA, 477 bp, Triticum aestivum
  unsure (1)..(477): unsure at all n locations
  Clone ID: PAT_TA_96436
gtctcttcatccattgctgaggtgacaaagctagctgcattggattggagcacaanaagatggagggggagacgaccaagaggctggccacgctggtgggctgcaactacgtgggcacncgctacnagctccncggctgcatcaangacntcnacgccgtgcgggacaccctcgtcacccgcttcggcttcncgccggccgacgtcaccgtgctcaccgacgggcgcggcgccnaggtgctcccgacgggagccaacatccggcgcgcnctggcggacatggtcgcccgcgccgctcccggggacgtgctcttcttccactacaacggccacggcacgctcgtcccgccgcaccacggcgactccggcgcgggaggaangaaagcnattttnnccnaaccgncttcaaacctcatcaaangacgtgngacnttccnncaactgggtggnaccgggtttccccngggcgcnaancttn

SEQ ID NO: 96437 - DNA, 315 bp, Triticum aestivum
  unsure (1)..(315): unsure at all n locations
  Clone ID: PAT_TA_96437
acaaaacttnagaaancgcaagcnanatgggaacctccaatgattanctcnccnattgtggggccgacgancgtgncgtccctctcccgccgggggtcctccttcgccgtcgtctgcaagggtgggaaaaaaattaaggncgataaacccctcngactcncgagggggnttgncantcgacatcgacgccaacggnangaaggtcggcaanaaaggngtgtaccaatttgttgacaagtacggtgccaacgtcgacgggtacagcccaatctacacnccaaangaatggtctgagtctggtgaccgctaccccgg

SEQ ID NO: 96438 - DNA, 468 bp, Triticum aestivum
  unsure (1)..(468): unsure at all n locations
  Clone ID: PAT_TA_96438
cccattctctcgtgngattcccctcatcanatcgagagctgcacancagtgttccgcattcggatcgancagcnggaggaccaaccatggcggcgacgcaccacccggcctccccgaccggcgccggctcangcggcaagtccccgtcctcctctccctcgccgccgccggccgtgcgcctggcggcgtcncangcggcggccgtcgcggcgattcagcccanctcgncgcgctacttcttctcctccctcgcggcctcctcctcgccgcaccgccgcatcgccatcgccgtcgacctgtccgacgagtccgccttcgccgtcaagtgggccgtgcagaattatnatganncccgggcgacgcccgtcgtgctcctgcacgtgcgccccaccttcgtgctntangggcgccgactgggggtccatccccgtcttcgtcgaantancggctaacggngagcgggggagg

SEQ ID NO: 96439 - DNA, 322 bp, Triticum aestivum
  Clone ID: PAT_TA_96439
cttcgtttcctccgccgcacggcttctccgctgccccccacccccgcccctcgcctcgccgccgcgacggcccgctccacctcctccaccgcctagtctctcccgcgtgcggcggcgcccgcctcgagatcgggggcgcggcggccgcgtgtggtgtcatctctcctgaggaagcggcgcgatgccggccgggggcgtcggcgtgcaggcgcccgaggcgtcgccggggcgctacgtgcggcgggtcgacgaggtgccgcccgacgacgacggctgcgacggcgtcttcggggtcgacgtgcggggacccggggacaacgac

SEQ ID NO: 96440 - DNA, 469 bp, Triticum aestivum
  unsure (1)..(469): unsure at all n locations
  Clone ID: PAT_TA_96440
aacaaaataagcaatatccattccactctcaaccaagatgaagaatagggaggttcaaaaaaaaaagatgaagaatagggcaaccacagccccgcctggatcaatccagcaaccacctgcaccgcgcccacacaaggccatcacctccaccaatccgcgcaccacccaaagcatctcaaccgcattcctcctgagcagctgctactccttggccttctccagcaggcagctatactgcgtacattgtagaataaacgaaacttataacaaccgacatatctttctttcttttataagcatgcatatcattgcatcagagaagaagcggnaaaaacaacgcctccaccacgcccaaaccaggcctcgcctgcaccagcaccaccaagacaaccagatctggatntcggcaacagcccctccggncaagcccttccttggacgcactctgcctgcaccaagcagatacaca

SEQ ID NO: 96441 - DNA, 462 bp, Triticum aestivum
  Clone ID: PAT_TA_96441
gtcctcttgtttcactcatccaggaccaagatcatgcatttatcacaggcaaatattcctgcaacttacctcaagtgccaacctggaatggacagagcagcagagaatattaagagatctaatgtctcctacatctacatgcaactataagctactatatgttactccagaaaaaatagcgaagagtgatgctctactgagacaattggaaattttatattcacgaggttatctttccagaattgttattgatgaagctcattgtgtaagccagtggggccatgatttccgacctgattaccaagcatttaggtctcttaaaacaaaagttcccagagacaccaagtcctggccttgacagcaacagcaactgcgagtgttaaggaagatgttgtgcaagctctaggcctcgcaaactgtgttgttttcaaacaagagttttaatcgtcccaatctgaggta

SEQ ID NO: 96442 - DNA, 291 bp, Triticum aestivum
  Clone ID: PAT_TA_96442
agaagatggttcaacttgagaagataattgaagaaaaagacgatgaactagcagctagagtgcaggagaaaagagaagctatcaagcagctgagtgacacaattgattaccacaagaacaacagcgatgatctggtccgctatattcgcagtcacaaccgtccccgccttccattttgtctgtaaatttgatcaccaaaagttcattgtcagtcaatatataagctgcattttatctgtgaacatcattagacaattatttccaattcctttaatgtatcaaaaggggggg

SEQ ID NO: 96443 - DNA, 466 bp, Triticum aestivum
  unsure (1)..(466): unsure at all n locations
  Clone ID: PAT_TA_96443
tcgaattggaccgggctgaatcttgtgccacatcaaattgccatgttggatgcctacgtggcctggggaggttgctagtgactaaaacgccacaagtagacgtattttggtcataaacgtttatgaccattcttaacgtggagattacatagatcattcaggtatacagtggttgtttgtaaatgcaaatttacatatgaaagttcgtctttggttaaggtatcgggaaaaaaaaaaaaaaaaaactcnaggtcgacggtatcgataagcttgatatcnaattcggcacgagtggtggacttgattttaccaaagatgatgaaaacgtaaactcacaaccatttatgcgctggagagaccgttttgtcttttgtgccgaagctatttataaatcacaggccgaaaccggtgaaatcaaggggcattacttgaatgcgactgcgggtacatgtgaagaaatgattaa

SEQ ID NO: 96444 - DNA, 456 bp, Triticum aestivum
  unsure (1)..(456): unsure at all n locations
  Clone ID: PAT_TA_96444
catacacaggcgcacagcatccaagggagccggcgatcgagattcgagaagccagcatgggcaagtgctgaggaggaggatctaccggcaacggacatgccgcgggtggtgggcgtcctctccgcgctcctggagcgcgtaacggngcgcaacgacgcggcgacggggccgggagcgctggaaccggcgtcagggtcggcgttccgggcgatgacgaagcccggcatctccgtgcgcgcgtacatggcgcgcatcgcgcggttcgcgggctgcagccccgcgtgcttcgtcgtgggttacatctacctcgaccgcctcctgcgccgccgccgcgccctcgccgtggactcctacagcgtgcaccgcctcctcatcaccancggtgctctccgccgtcaagttcatggatgacatatgctacaacaacgcctacttcnccaaggtgggcgggatnan

SEQ ID NO: 96445 - DNA, 473 bp, Triticum aestivum
  unsure (1)..(473): unsure at all n locations
  Clone ID: PAT_TA_96445
agcaatcangccaatttggttgtttgggctgaggacttcgaacattttcttcctaaagtttgagacaacagtgtaccaaaagccatatgagcttaaaggnggggaaaaaagccctgttcattgatccaaaaataaaacgatactaccacaaaaaatttatgttgacttctgactgaaaattgaaaagaaatgggatttgcatggaggctataaaattatatggctcgtatgttggactacaaaaatacgatgtcaattcggtcaagctggaaccctatcattctcnccctcaggtgaacaagataacgccattggagtttcaaatgccttttggaataaagcaatgtcgcattcgacataataacttgaccaagtaactttgcgggagaagattcancctccccttttcggtttgctcgaccantactgattttcccnacaaaataatcacctaacgattgtcccggccaata

SEQ ID NO: 96446 - DNA, 433 bp, Triticum aestivum
  unsure (1)..(433): unsure at all n locations
  Clone ID: PAT_TA_96446
ttccttccctcgccgncacccaccaaggaaaggaggatgtcttgctgcggnggcaactgcgggtgcggngccggctgcaagtgcggcaacggctgcggcgggtgcaagatgttccccnacgtggaggncaccgccggcgccgccgccatggtcatgcccancgcctcccacaangggagctccggcgggttcnaaanggccggggagaacggcggntgcgactgcaccacctgcaagtgcggcaccgcgtgnggntgctcctgctgcagctgcaactgagccggcgcccaacangncggccggcagangggagcaccangatgatgaggacaancaagcaagcaacatcaccaacaattatcancaaccaacgtntcatcancaaccgcccgcatgcnctcncgggcgcgcgcgctgaataaaataaaaccac

SEQ ID NO: 96447 - DNA, 466 bp, Triticum aestivum
  unsure (1)..(466): unsure at all n locations
  Clone ID: PAT_TA_96447
agaagataagagagaagcaaagcttgagatggcgcaaaccatggcgtccatgaccggcctgtcgcagggcgtgcgtctcccaggcccggccggcaggcgcgccagcaggttcaccgtgagggcgtcgtcggcggaggccgaggccgccggccgccgcgcggtccttggcctcatggccagcggagtcgtcgggagcgcgttcgctcaggtggtgcacgccggcaccgtcgcggccatcaaggttggncccccgccgccgctctccggtggactccccggaacggacaactcggacgaggcaagggacttcgacctgcccctgaagaaccggttctacctgcagccgctgccaccggcggaggcggcggtgcgggccaaggagtcggcccaagacatcctcaacctcaagccgctcatcgacaagaaacaatggccgtangtcatgaacgaactccgcctcaagggc

SEQ ID NO: 96448 - DNA, 464 bp, Triticum aestivum
  unsure (1)..(464): unsure at all n locations
  Clone ID: PAT_TA_96448
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactgggacaatgtggaaagctgcctatgttcggatgcacccgacgcccacgcaagtgatcaacgaagtgggagggagggtcaaagaaaggagtanccttgacccctatgtccgcatcatcgg

SEQ ID NO: 96449 - DNA, 453 bp, Triticum aestivum
  unsure (1)..(453): unsure at all n locations
  Clone ID: PAT_TA_96449
gcctgcctcatctctcggagcaacancangaggagcttgcaggaacaatggnggnccanggtcttctctctgggaggcanctgcttgggaggcctctgcagtcttccatctccangtcgtcttcctcccggaagtccgccttcntcgtcanggnatcntccancccccctgccaagcaaaatgacaacaggcagctgtggttcgcgtccaancagtccctcanctacctggacggnacgctgcccggtgactttggtttccaccccttggggntgtncgacccggagggnancngcgggttcatcaagcccangtggctggcctanggcgagatcttcaacngccggacggcgatnatgggcgtggtgggcatgatngccccngagggcctgggcaaaggtgggcctggtgcccccngagaangngattccctggttccaagccggcgcgaat

SEQ ID NO: 96450 - DNA, 462 bp, Triticum aestivum
  unsure (1)..(462): unsure at all n locations
  Clone ID: PAT_TA_96450
ttttttttatataaaaccacagatgtttcatagcacatagtacgtactccaaagagtgaccacggtcaatccaaagtaattacatatcccatctgggcactcgagtagtaagtactagtaacgagtagtatcgtcaatctagcaaattgacactgcgacagcagctacatatcgtcaatctacgcctcacgtcccatgacgaggaccaggaagcangaggaggtcgaccaccgccaagaaggctatgatcagggtccanccgatcaccncgaagagggaccctgggtcggcggcgtataangaggacggtggcgcgggcgtacaaactgtggccgacgatggcgagcgcgagcgccaagtangcnanggcgcggcggaccccggnggtagcggcatgggganatgcaacgccancgccgcccgcgggncgcctggngnccgttgccncaccanaancaatnc

SEQ ID NO: 96451 - DNA, 450 bp, Triticum aestivum
  Clone ID: PAT_TA_96451
tcaagaatgtcataagtactgtacacggagtggagggagagataaaatatgatcctgccactggatgtattgtttcatctgtttcccataccgaagagtcttcaatgatgatgaatgtagaacatcaaagttctgattccctgcccattgaatgccataagttccaacctgattatgatgcataccaaagagaacatctaggccaagctgtactccacaaagcacagaatgacaaacggagcgaaactcatattaacctgaatcctggagggttatgccgaaattcaaattttggcaagaacatcaaaagggccacggtgtcaggatgcgtcaaacaagttcgtatcttacaaaaagaaatgatctctgctgacggtacggatatgtgggttgagggagctgagcaaaagaacgtagtgtggaattctatttctatgccacaacaatgca

SEQ ID NO: 96452 - DNA, 443 bp, Triticum aestivum
  unsure (1)..(443): unsure at all n locations
  Clone ID: PAT_TA_96452
gctaagacttggcaaatggaaacatgtagctatttcaggcataagatattgacattcaagaggtaaactacgcatgaatttaagcccaattcaacacataatgtctttgtgagggctcgggggctaaattacggattaattacccaatccattccgagagatacaggaggcagggagcttgaccaagcctcctccgcggccgcaggccggagtcgactggctagtctggtttactgaacgtttatgtcaggaacacttcgtttcaaaacgttaacctancactggtctaaggtggcaggtgctcaaaacaacataaangtcttgattaataaagacgcttgatgctgattttcacatcactgggcaatcggttgcaacgcctccaccaacgcgccgacacntgggtnttctttcgagcancanatnttgattctcccncatgg

SEQ ID NO: 96453 - DNA, 442 bp, Triticum aestivum
  unsure (1)..(442): unsure at all n locations
  Clone ID: PAT_TA_96453
cgatgtggaggaacgtatcgccgccccgatgtggaggaaggcctcactgccccgtcgatatgcaagcatgaatcaagcgagctccaccccgaagtggaggaaatggtacgcggccgtcgatctgcgcgcgtctagccatggagatggagggctcgccccctcgcgtgctcctccacggagtgctagcagcccacacggcgtacatcaagccatccgtttcgtccgtcccatgcgccggctgccggtggctaccgctctgttctgttcatcccccgcccgccgcacgcgatggcccacactgccatgttgttttgctgcaagccagaccgccatcgctgccctcgcgctccgggcanaggctcgttcttgctggtacgcgttcctcccgaagggggggctctgcccactggcggtcgcctttctttcaacggntgcgccgttt

SEQ ID NO: 96454 - DNA, 443 bp, Triticum aestivum
  unsure (1)..(443): unsure at all n locations
  Clone ID: PAT_TA_96454
gccgccccaacgggggaggccggaggatccaagaagggaagaatccttcctctggacttctccaccaccgtcgacgacaacgaggaggactggccaacaagggccaagcccctcgcaagatcgtaagtgtccggatacccatggtttttcataattgtatagtgttctctaatgccgaacaatcatgcaagcccgcccaagggcgagctcgccaattcatcgaacgggtccctaggctcgtcggaaatggagagtgcctcgcttccggccgcctcctcgcctcacaccgcggacgacaccgcggtggggccccaaggagggcttggtcaagaggaggtagcgcaggaggcaccacaaggcgacctcccggactccaagcgcgaggggggcaagacccccaagggctctaancccggacccttgtccggactccaangccggga

SEQ ID NO: 96455 - DNA, 442 bp, Triticum aestivum
  unsure (1)..(442): unsure at all n locations
  Clone ID: PAT_TA_96455
gagaccaaggggccggccggagacgcgcaaagccatagcttggttcctgtttgcatcgatcgttgcggttgcggagatgggtcgcgggaagatcgagatcaagcggatcgagaacgccacgaaccggcaggtgaccttctccaagcgccggggcgggctgctcaagaaggccaacgagctcgccgtgctctgcgacgcgcgcgtcggcgtcgtcatcttctccagcaccggcaggatgttcgagtactccaaccccgcctccaacttgagggatctcattgagcagtaccagaacgccaccaacagtcaattcgaggagattaaccacnatnagcaaatatttgtggagatgacaccggatgangaaacgaaatggnnaaactgggatgggcgccatccggaggtacacgggggngaangaaactttcctcccctcttccct

SEQ ID NO: 96456 - DNA, 241 bp, Triticum aestivum
  unsure (1)..(241): unsure at all n locations
  Clone ID: PAT_TA_96456
gctgtccgggtgtgtttgtggccgtgtaatcgtgtaagaatcgcaccgtgatgtttctggatctcgagaaatagtaacggtgcctgcctcaatgttcggtactaaaaaaaaaaaaaaaaaaaaaaaaaaaaaaaaaaaaaaaaaaaaaaaaaaaaaaaaaaaaaaaaaaanccnagggggnanngaaaacaaaaancccctaaaaaaaaananaaaaaaccccngggggggggggnggtct

SEQ ID NO: 96457 - DNA, 538 bp, Triticum aestivum
  unsure (1)..(538): unsure at all n locations
  Clone ID: PAT_TA_96457
ggtgggcgggncgctctaagaactaagtgggattcccccggggctgcaaggaaatttcgggaacgaggattctccctttcttgctggaacctgaagcaacggcccctttctctcctcaaacttttggggctcgaagggnaatgggcggnggctccgctcccgacgaaaagaatgcctccgggcaancccgggnntcaaactttcgcccgggnttccctccaaggttacgccaacaagcggggaaccaaactgggctgggcggcnacaagaaagattcgtctcccctcttttggattcggctttcnaannaaaaaancccntgncccccgaaaagccgaaagccccgnccccccgtggggccaccctccnanncggttaggnaatccgaacgaacnaagctccnccaaaagtggggtancnggcccttggacnaagggagggatttnattttgnccaaacggggncctcctttgnnccggttcgggaagggntgcccgggagttaccctccanangggnggaanggtttccccgggagg

SEQ ID NO: 96458 - DNA, 378 bp, Triticum aestivum
  unsure (1)..(378): unsure at all n locations
  Clone ID: PAT_TA_96458
ccctgaagacctctctctctctgccgagtgacaacaggatgttcagttgtgtcaccactaactgaagatcaattgtcaagtggaggattttggtgataccaccaagggtctgagcctctgatccttccggtcggtccgaccgaattatttctctttagctgcaaaagaaattgaacgctccacttgtaactttgtcctgtccatgtggtatttctgtccaccgaaggagattcacaacaaaatgtaccataatgcctttttcagttcctaaatgggagtccaatgttctggggggnaaatgtagtgacactgtaagggatggnccaactgctgataaaaaaatcttgggcacttgcatgcaaaaaaaaaaaaaaaaaa

SEQ ID NO: 96459 - DNA, 252 bp, Triticum aestivum
  unsure (1)..(252): unsure at all n locations
  Clone ID: PAT_TA_96459
cgggtggggggcggctcctaanaaataatggggtttcccngggctgnaaaggaattttcgnaacgaagaacaanactcatntggattacccactanntaaccnactngcaaacttnaggnaataacttncaactaacgattcatgggtcctctcaaaaaaaaaaggtntnggggggcgccntngtcccttgcgggggggggggcttattaatggcggcnaggaaggctcccncngggcttttcttcggggca

SEQ ID NO: 96460 - DNA, 487 bp, Triticum aestivum
  unsure (1)..(487): unsure at all n locations
  Clone ID: PAT_TA_96460
tcagcataacatgttaatattcacaagcaatcaaattattcggattttaatcatttgtgaacccatgcataataacaagtactaggncaagtgaaactatacattgttaagcataattagtaatattacctggnggncctccacgccctggnagtatgcagtgcactcactggcaaaaattcactgctgaanaagttgacttgggatcccaanccgcacttttgggaaggggggagaaccttgctaatgcctcaagtcnaaaanaaacaaacactggnctttggaactcccgtgtcaccggtccccctgtcacgntcaaaggcnagtgggaagaacaaatagacaaangtcttcttccgtccaagctcaaaaccgggaangacgggaagacctccggnaanggccaacgaagatgtggntctcacttttccaaatgtcccgggcaaggnanaccttgnctttcttccaactgnagagggtctgcgag

SEQ ID NO: 96461 - DNA, 213 bp, Triticum aestivum
  unsure (1)..(213): unsure at all n locations
  Clone ID: PAT_TA_96461
tatgaccaccctttgggtgttaccanggggcnngccatttataaataaaaagaacccttgntttcacaaattaaananaagacgaccttccggangtttccaaanattatatgaccaccntcaaatgtnttatgggatccacnttgacatgataaaaatggnggaanaaagaacatgtgtatatgggcntgaaaatgaantggttnttatttt

SEQ ID NO: 96462 - DNA, 456 bp, Triticum aestivum
  unsure (1)..(456): unsure at all n locations
  Clone ID: PAT_TA_96462
acaacttccatttcaagaatanctactcaaangngcaatgctgattcctcttcangagctactgaaatcaaccgcctttctaattgatganaattgtgtgtttgggngtgggcgaaattaaaaaantgatgtccccctccccctgaaaaagaaangctgttgtggttcanaaagaaggnataccacaagttcaagaacctcnttgttcagaaanaaagggttcgtcaaagggacatacacttgggacaagaacaatttcccttgaactggacctgggtcactttgtccgttcctccctaacattttgnagttgggnggggcataaaatggggacaacccgcaatctatcccaccgtgggtngncnaaagtacaggcaactgatttgccctcaacctttggtaccnttattccctgggatgcaatccggatggaagctcccaacctcaaagtccaaa

SEQ ID NO: 96463 - DNA, 466 bp, Triticum aestivum
  unsure (1)..(466): unsure at all n locations
  Clone ID: PAT_TA_96463
gacggngatggttgcatcaccaccaagggagctgggaacaatcatgcgttcgctggggnanaacccaacggaggntgagctccangacatgatnaatgaagtcnacgctgatggnaacggnaccattgacttcccanagttcctcaacctgatggnccgcaagatgaangacactgactcanaggaggagctcaaggaggncttcaaggtgtttgacaangaccaaaacgggttcatctctgctgctgagctccgccacgtcatgacgaacctcngggagaaactcaacnaccaangaggtggncgaaatgattcgttnagccacgtcnacngtgatgggcanattaactaccaaggagttctcnaagncatgatggnccaaatgagcaaacgtgctccgtgctccccaaacaaggaggagaaattttgcaatgnnnaattaattttaagatncnactcctntttt

SEQ ID NO: 96464 - DNA, 332 bp, Triticum aestivum
  unsure (1)..(332): unsure at all n locations
  Clone ID: PAT_TA_96464
cgcggggggggngggcgcccctaaaaaataatgggttccccngggctggaanggggaactaacttgcgccgccccaaggcaacccccaaatcctgggaactaatggaactgggggaagggggggaaaacaagcntaaccctgtttgggtgttaangntgggcctgganggacttaaacnggaggtggaaaccaaccntcctccaacgnccgaattggaatgttgttgnccgccccccccccccnaccggganctnccgacnaactccaaactctgaacaactgnnaanggttttgggttggngggaactggtcaaatttaattgaagtaagg

SEQ ID NO: 96465 - DNA, 296 bp, Triticum aestivum
  unsure (1)..(296): unsure at all n locations
  Clone ID: PAT_TA_96465
gtactctgatttctcccaacttgtgcgcccttctcgtttcgcgcccaaantgntctttgcttannttcaaatccgttgncttgcacccanccacccctcnncgggaaaaaagaaagagaaggaagaaaaaaaanctcntctgccggncanggaganntcctcctccnctctgctgntgagctcgtatancggcgggaacaaaaaagggcanggagggngacctggacncggctcntcccgccgagggggngggcgccaanaagaatnagggncgangaactgcttnntctgctcca

SEQ ID NO: 96466 - DNA, 212 bp, Triticum aestivum
  unsure (1)..(212): unsure at all n locations
  Clone ID: PAT_TA_96466
ccaaaatttgaaatntgggggttaaccnagggggaancgggaaaaaagtgttaacccaaaaaactcttcctatgtgtgcaaaaaaatntatnttgggggtngnggggacaaaaagtgcatcatcntccacngcgccgtgaaaaanagggaaatnnttggaaaanntccctagcggnttttaaaaagaacaacaacnantgttataatggggg

SEQ ID NO: 96467 - DNA, 173 bp, Triticum aestivum
  unsure (1)..(173): unsure at all n locations
  Clone ID: PAT_TA_96467
aaattaagttnaacaaagctgntggacancaacaaaagtttngnagatacaaaccatnaaaactggcatcaataagtacnggataagaaaccaaagacaagttaaaggnaacnggcanggcaatatncccanacccccctttgnnggggcaaccggaagaccnagaccttttg

SEQ ID NO: 96468 - DNA, 176 bp, Triticum aestivum
  unsure (1)..(176): unsure at all n locations
  Clone ID: PAT_TA_96468
accagttcatccatccgatnccatctgcccgctcgcagctccaaggaaggaaggnagccttcaaccatgtctggncgcggcaanggcgggaangggctgggcaaaggcggggccaaacgacacccgaaggtggtgcgggacaacatccaagggntcaccaaagccngggatncggc

SEQ ID NO: 96469 - DNA, 507 bp, Triticum aestivum
  unsure (1)..(507): unsure at all n locations
  Clone ID: PAT_TA_96469
ngtggccttggtgggctccgacgtggaaggggacacgtatatgaaccacgccgccgtctactcatcagctactcgcgagtggagcgacgtgacctccgttgagcaagaaaatgtcatcgatggcacggggcacaatgctgttgtggggaatacggtctatgccccctgcgtggaggatgacagtgtcgtggtgtacaacacgcgtgagaaaaaactatctgtgattgccgcgccccttgaggtcnaggaccaagagcancaaccgtaccttgaccctcatggggctggaggacggcatgctgctgtttgccgtctgtggggaaagccctaaactctaccctaattgacaaatggagggctgggtccaanaangagctgccnggatggggcgcgacgcaagggtcatccagcctcggggcaattgctccctccttccctgtccctcnaaggaacaaatccggaacgtgntcttgccgggtttggtttttgcananaaggtgtttttgt

SEQ ID NO: 96470 - DNA, 163 bp, Triticum aestivum
  unsure (1)..(163): unsure at all n locations
  Clone ID: PAT_TA_96470
gnaattatcnaaaaacngaagagaagcaacaangagggatctggtccctggtccgncggtcctcctcctaagtccgncctttcaacccggcggaaaaggccggntgganggcccancgggcggccaattttnggnaaagggggnaaggtcaanaaaaccctgg

SEQ ID NO: 96471 - DNA, 385 bp, Triticum aestivum
  unsure (1)..(385): unsure at all n locations
  Clone ID: PAT_TA_96471
gccnggtgggggggcggcccaagaaacaatnggattccccnggctgcaaggtgaacgtgctaaaggacaaggagcctcccaaagggcgtggggggccccaaactgggaaaatgcaacaacaatggggaacgaaacaaacggagtaaattggagttggntccccaaacaaaatcgtannaacaatcaatgttggnttaaacaaagcgtgtcctggaaactttgctgacaaaagttaaaccgggtccggataatttgctangttgaatgtngggggnggtccccggagggcgcttttatacggggtcccgttataactgggngttaagtaactcccaatgaaaacctgggaacctccggaccctcctttaatgncctgggtaagncc

SEQ ID NO: 96472 - DNA, 464 bp, Triticum aestivum
  unsure (1)..(464): unsure at all n locations
  Clone ID: PAT_TA_96472
tagattatcannactttattaataattttacatatatattcanacaaaaccaccaggtccaccatagnaagtatgcacaccanactgactatatccatcaacagaaccttttgcaagtatatttggataaattggtggngacatacccaaatttattttcatctggaataacatacttgtttttcttanttaaaatttcganatttctcacaaatgctgcttttccaaagtccttcggaagcaaaatggccactacccatttgtggagaagtctgatnatgctgtcggaccttgaacatatccaccccataatgcataattacattgatccttcnangaaaatgggaaaattctcntgggcagtatccaatatgtatgttttgtgggaccanaagccacccaccaaatgtttagtccacngggnccttggaaatancaacnncctaccaangtattgggggggg

SEQ ID NO: 96473 - DNA, 594 bp, Triticum aestivum
  unsure (1)..(594): unsure at all n locations
  Clone ID: PAT_TA_96473
gcaacaagggaaagncaaagtacattgggtttatcngggggntaaccccggacaacaatccgggcgtgctcaaccctggtgcaccccaactctggccgttgcaaatgggagttggtctctgtggggctccccngaaatccaagcccngagattcgtgnctctcctgcaangggaagctaagggantgggaatttttcccctaaaagcccgatttgcccgtngggtttttcccggtggggaaagggganttgacaaanacnaagtnttctggctgaaatccaaatccngaaaaagggcaaaccaaccttttttccgggtggaaaaaacctggggngaaaaaaanaancaaactcctntccnaaaaaatngggaagaaactggggccaaaaaaanaaacaaattgcancccccggctcanactaancntttatccctggggggttttgccaaccaaaagggggaaggatgttnggttccccctnccnaaggggctaccaaagattntaagaaatncctnaacnccccaacnaatttgcntcccttttaaanggggggnggggccccccgggaaaattaccccccaaaaaaaaattn

SEQ ID NO: 96474 - DNA, 381 bp, Triticum aestivum
  unsure (1)..(381): unsure at all n locations
  Clone ID: PAT_TA_96474
ccccaactcccctccccggggccgccgcaacaanaagatggtgaagggacgcaccggccaacgcgtgangntctangtccgcgggancatcctcngatacaanangtccaagtccaaccaataccaaacggngtccctggtgcaaattgagggggtgaaaaacaaggaggacgtggcctggtaacgngggaaaangatggctacgtttaaaaaggcaagnacaaaangaaagggaaccactancgctgcatctgggggaaagtctcccccccccaccgggaaaancgggggtcgtccgcgccaanttnanctccaaaactggccccccanggcaaggggaaaaaagncaangggcttnatgttcccancaacaacttaaaa

SEQ ID NO: 96475 - DNA, 401 bp, Triticum aestivum
  unsure (1)..(401): unsure at all n locations
  Clone ID: PAT_TA_96475
caattttgcaaccaagggtgggggcggtaacccctgtttgtttgnnattggnacaaagtgtccggggattcaagggangatcctccagttttanggaggnatatccgcaaaagcttgtaccgggggcccggtacaagactaatttgtggcttcctanggggaaaattttacctgcctgaaaaaaaaaacttgagtaaagccttcngttcaaagtttttgtgttcaactaaacttctgctccgggatattttccaaanacaatagctggagcaaggactgttcttcncctgtnactccaaagaaatccatgtgggtgtggggcaaaaaaaaaaaaaaaaaaactccaggggggggcccggtaaccaattcgcccctaaangngagtcntattacgcgccgcc

SEQ ID NO: 96476 - DNA, 261 bp, Triticum aestivum
  unsure (1)..(261): unsure at all n locations
  Clone ID: PAT_TA_96476
ggttcccccggggtggaanggaattcggaaaaaaagcccctcccggcggcggacctcccnttcttctcctggggnaatctccggnggggnggctccnaaattttccancnaataaaacttgatttgccggccctaacctncctccccccaatcctggggtnggggaactnntcccccaaangtggnccgcttgaacgntcaaanaaacaatccttgggacctcaattttggtggccgaagggcttgaatnaaaaaaaaaaa

SEQ ID NO: 96477 - DNA, 525 bp, Triticum aestivum
  unsure (1)..(525): unsure at all n locations
  Clone ID: PAT_TA_96477
gtgactttggncacaccgtgcatgccaaccatctcccacgtggggatgcaacaatggngaggncattggttaaggcattcaagccatttgntgagctcccntgttgacancaaggantttgatgtttccgcnttggngaaattcantgatgctagcancaccccnaaagttgttacttttttcaaagaancctgacaaccaaccttacctcntgaaanactttcaaaanaatgctcccaagggcaagctcnttttgnacttctccacngggaccgtttgngtccttcaaatcancccactaagggggtgtttgaggagntcaatggcaaaggtggttaaagttccttaantggngggcaatttaaagcnaagncaaagggggccttccaataacnttgggcctggaaagaaaggattaanggnaaccaacttaatcctcnattcaaagaaaaagtggctcccnangaaatttttttaagggaanaaggttgaggggcggnccaaaaattggttggcctggggnng

SEQ ID NO: 96478 - DNA, 543 bp, Triticum aestivum
  unsure (1)..(543): unsure at all n locations
  Clone ID: PAT_TA_96478
gctgcangggtcactttctcccctcaagctccaacggaacccaacccaaccaaccagtcatcccccgtcgctctcaanctcttccgtggntcgcccggctcccttngcnntgctgccccantggcttcaanccccgggatttggccgttgtcctttcnnccaaccccgtcaaanggaaatnaaaaagaanncgccnctccttctntngggggcaaaggaggggnaaatgcattttttncgncctgcaagcccaangnccgaangaaaaattgtngtttggctggctccancaaaagcaaggataaaagtngggnaaagggttggtgaaaaattgnttaaaaaaaccaanctttgctggttccctnaaagganctgaaagttttgcggggacccaaccaaaattttcctggaccttgggagccggaatcaaangggnacaacanggtcgaaaanttntgtaaggnggccccccnaggaggggngntccanaantaanacatgggggggagnaaaaannggcncaaaggnaaacttnngaaaaag

SEQ ID NO: 96479 - DNA, 469 bp, Triticum aestivum
  unsure (1)..(469): unsure at all n locations
  Clone ID: PAT_TA_96479
ctcccaaccccaacgtctcgccgncgncaacaacgncggagctagattagaagaaaaaaagagagaaaaaaactcntcgggagggntcganatttgtgtcngganaaanggaattcttgagatnggnatcnggacaagcgggcgccctcgggatnggggttaccaaacaatttttcccaagaacctttaatgaatgtgntaatgggngtcaaagggggggcaaaaagtctagcaantaataagttccctggatgtacgaancaaccctccggctacangaattgaangacgtttcgnccctgctggggggggggcnaaaaaaattctctggctgcataatcccaacctgncgcngaaagaaanccaaccctgaatatngttttttgggaatcccccctccncntagttttaaggatttttntttcaaantttttttctggnntccnttttctcccaacnaaatctcccc

SEQ ID NO: 96480 - DNA, 245 bp, Triticum aestivum
  unsure (1)..(245): unsure at all n locations
  Clone ID: PAT_TA_96480
agctctcaattctcctaagattcggcaacggcccctccccccaacaaacccctggcggggggtggtgaacttctccccgttcatccccnctgggccgggggaagcctggccggcctcccctttnaaacgggcaaacaaggttccccaangaaangggtttactccccttcttcccccgctttcctaaaaatggaaatntccnantcgggggccctncctcngaancccctnccttttttnccccc

SEQ ID NO: 96481 - DNA, 518 bp, Triticum aestivum
  unsure (1)..(518): unsure at all n locations
  Clone ID: PAT_TA_96481
ggtngcccaaccgggccatntccggggtttgggtaactggacgttttcctcagtaagagggatgcaaagaatgttggtaactccgagcaaaatccttgggngaccggaacccggnagtgaanaaaacgaaccccaaaggnanaaatgccgagntccanggaaacaaagaaaagctaccaaggatattttgttggctcccggattccaacaatcctggtgggatgagtcaatggttccncaaggcaanttttcaaaactttttggggngnaaaanaacaanattcttttataatgccccaaagggaactgggggttcaaaaaagaaacaancctgggggaattgggnttttgtcnccttcccgggagtggcaaaantgcggtgggaccaaatgtccntgcaaagaaaaatcntgaagaattggatgggcacaaacaantttgtttggttggatccntgccaacctccccaaagggattgaaanaaantggagggcaccccccccccccccaangggggg

SEQ ID NO: 96482 - DNA, 458 bp, Triticum aestivum
  unsure (1)..(458): unsure at all n locations
  Clone ID: PAT_TA_96482
ctcanctacacccttgacgagatggaagggccgctcgaggncggggccgacggcancctcaagttcgaggagaaagncggnatcgactaacgcggncgtnaccgtggcanctccccggaggngagngggtggccttcctcttcaacgtcaagcaagctcgtccgcaccggnaaggccgagaggttcancgggcccttccctcctgcccaagctacaagggtttcgtctttcctccacccaaaagggggcgtgggggggtctaaatgggntaccaanaacgccgttgggngctaccccgccgggagggcaagaggaagaacgagggaggagnttggccaaagggngaaacgnggaagaaacgcggtccctcctccacgggggcaaacaatcaacgcctcaangggtcaaccaaanaagnaaaacccgggngaaccggggggaggggggatttggnggtc

SEQ ID NO: 96483 - DNA, 329 bp, Triticum aestivum
  unsure (1)..(329): unsure at all n locations
  Clone ID: PAT_TA_96483
caccaagcaaacaactctcccctcccctggaagctcaagccanatntcgtctcctttcttcctcgaaccaaggatcaccaatggggaacnacgggaagccgacgccacgggcgcgggngcccaaaggagcangcccgccaagnancgggggggggagcaagtcacgcgttcactcccgaggtcgggcaacaaaangcctgctccaaaagcgaacgcctctacaataaattcctgggagaagaagcgtgtnncccgcgcggagcacgagtgcattgaaagggnggttccgccgaggattaaccgccaaccaacccatgggnaaccttggt

SEQ ID NO: 96484 - DNA, 678 bp, Triticum aestivum
  unsure (1)..(678): unsure at all n locations
  Clone ID: PAT_TA_96484
ggtgggngggcggctcctaagaactaagtgggatnccccgggggctggaaggaatttcggnaacgaagaacaagtnaatcaaccaagcaaccaagggntgaatttacatatcaaaaaacaatggcctggccaagcggtttcacaaactcaagctaaaataaangntaaaaacaatcaattgactcctagtttcctgggccaagggntattcaagacacaaagaatggccccacaaactttagtccaaacaagacctggaaaggcccaatggtcaatcaatcaactcctctttcctttctccaanggaaactttctcttcctttcttttgactcaanctgcaagggggcaagcaagcaaccctccaagcaagcaaggggggaagcaagcctggaaacaaggccacaaccaaccaaccaaccaaggattgggnacccgcnagcaaaactttctcccctacccangcaagccaaagnggctcgggtggatggtccctttggccccntcaactttggggancaagcaatgaaggtttccaaccttccccaattggtcaaattttcaacaaaccaaactggnnctccaaagaaaatgggntggtcaagggccctcctggcaanaaggggggnnngggcggttgncaaaangaagggtaaagcaaaagcangattanggnnagg

SEQ ID NO: 96485 - DNA, 276 bp, Triticum aestivum
  unsure (1)..(276): unsure at all n locations
  Clone ID: PAT_TA_96485
cacacaccacaccaaccgacccgtctcgtctcgcgttccactcttctttcttttgtttcgctccgtggncccacgtgctcccanccatgtgngggggggccatcctctccgacatcatcccgccgccgcgccggggcancggggggaaantctggnggggggncaanaaaaaacggggcaaggncgatnccgccgcggggaggncccnccccccncccnangagtncaagangaanggcacnccganttccaaggcccgactttttaagggttttt

SEQ ID NO: 96486 - DNA, 285 bp, Triticum aestivum
  unsure (1)..(285): unsure at all n locations
  Clone ID: PAT_TA_96486
gcctccccgcggattcaaatccccccgggaaaaggtcttgggtgntttcttccccccccgancggctcccaaaggttcttgggggtagctttttgncaactcctcaccaaagagaatttaatgtnctgnntttggncggtnaaaattccaantgggccttttggncccccttttccgaaggngaaatggtngggggaaagctgggnggaacttgcccgggttaaaaaagactnacgttcaaantttngncaanccaaacaaanggttaatngggccgcaaaagag

SEQ ID NO: 96487 - DNA, 400 bp, Triticum aestivum
  unsure (1)..(400): unsure at all n locations
  Clone ID: PAT_TA_96487
ggacgcctgaccgaccgagcgagcgaagcaagcgcacgtgctaataattaaagcgaggnaaaggaacacgtcgtcatcccacccgcgtggggtaaagtgcaagctaaaggaaatgatgctatcnatttgcatgtaactgcatgcaatgccgctgggttaagggttgagctttgggtaanttgtgcnggggntgtagcgggttatctattattaaggggnttaatcataaactacgtnccanaatgcgcangtgtatgtgcgcgctcctgtgaaacntatgttggactttgattatccaatgtgcaaatttcaataaaaaaaaaaaaaaaaaaactccaggggggggnccggtacccaaatccccccaaaagtggngtcctattancgcgnccctcaactg

SEQ ID NO: 96488 - DNA, 326 bp, Triticum aestivum
  unsure (1)..(326): unsure at all n locations
  Clone ID: PAT_TA_96488
aagggttgactttccacctcctgaaggttatggggngattccccttgagcaacccccanaccggggggngtactgggggnaaatgtttaacccaaattgggggtccanggagctgctaccaataagggtaagcgtggtttncttgagaanaccggatgtttccgccctacccaaaaagggaagccaccggnnatttgggattccngttttgnccaggganttttcaancaccctntngggcccctaagggnggaaacnacccactggatggcccgtnttttttanaaaaatttcnaattggcccaangncaatttcttngggggaa

SEQ ID NO: 96489 - DNA, 498 bp, Triticum aestivum
  unsure (1)..(498): unsure at all n locations
  Clone ID: PAT_TA_96489
cgcgggggggnggggcgctcnaagaactaagtgggattccccggggctgcaanggggactttggggcacaacgtgcaatggcaaccatcctcccaacgtgggtggatgcaaacaatggggagaanggcaatgggttaanggctaatcaaagccaatttgatgangctcngntgttgacancaaanggaattttggatgtttctgccttggggggaaaatcaanttgatggctaggcaancaancccccgaaaagntgtttacnttttgacaaagaaaccctgganaaaccaatcccttaactccttggaaaaananntttcaaaaagnaaanggcccccccaaggggcaanggnccccttttttgganacctccncccacccngggccgggtttggngtcccctccaaaaacnaaccccanacaanagggnggccnggttnaagggnggnttcanatgggnaaaagggnggtngaaaatttcccttttttgggngggc

SEQ ID NO: 96490 - DNA, 486 bp, Triticum aestivum
  unsure (1)..(486): unsure at all n locations
  Clone ID: PAT_TA_96490
tgcacatctgcatcaagagcatcaagaaggatgggttctacatgcccgcgagccaagcctgcaaaaacgangtgaagaanggtgacatgccctgnnatctgncgcgtcctcaccccctccgangaaacanancgtcagccccgtgaagctcgtcctcctcgcccacnagtgncacatcnaantccccgtcnggagcaaacncggaacttataccatcggggggggggtgnnaccaccatccgcgcatgcgtgaggagtttctgtcatggggatctcncnanaagaaggccagtgaangagatggagaagatcatggcagaataactataactataaataaagtccgccgcgtgcgtgtattctgagctagtgaagctatcccatcgtcagaatgtaatctgccaaggcatgttaccgtngngattccaactaaataataataagtntaangaataaaagggccntccatccaaaataagntagttg

SEQ ID NO: 96491 - DNA, 612 bp, Triticum aestivum
  unsure (1)..(612): unsure at all n locations
  Clone ID: PAT_TA_96491
gcaacgaagggacaagcaagcaagcanggcnacaagggagggcctaacgaacgaagggaccgaagggacaatgccccgggtgggcgggcnggncaaacggggttgcaagtgccgccccaagcaagtaaggcaaggcaaggatgtttggtggatcggtcaagtccaagcaagaatggaattccgtttctgttgttctcaaagttttccaatgttatgggttccttaacccttttggtggctaagtaatatgatgtaactacntcactggaaacaataccggggtcgtccaaggaaaaattattttgcccttcccttggnttttgctttgccgtggcaatttttgcccgggagtaagtttgggctggctgaatgaagcaaaagnttgccaatgttaagttgggctaactcccnaaatggggcaagagctggacnagcaatgttttggtttcaaaaaaaaaaaaaaaaaaaaaaaaccncgaagggggggggccccgggtaacccaaattcnccccctaatangnggangcccttatttacgccccgccncnactggggccgtcgnttttacaaaccgtnccnttggaacgggggnaaaaacccctgggngnttt

SEQ ID NO: 96492 - DNA, 445 bp, Triticum aestivum
  unsure (1)..(445): unsure at all n locations
  Clone ID: PAT_TA_96492
gcaacaaggctcctcctntttcctccccggccggcggccggcgangttgggccccnggcgccaatggctcccaacaaagaaagtccgaaagaagaggcacgggggaacatcaacaacaanctgcagctgggtggatgaaagaagcggnaagtacaacgctccggctacaaagaacgtccctcaaagacgctcccgggagctccaaagggggaaagtttgattaatcctccgcaaaacaactnggcctcccgctcaangaaagtctggagatcnaagtnattatgctatgctgtccaaagatttangcggtcaacantttcatgggaaacaatgttggatntttggnaactggcgtgcgggnaaagtactaaccggggggtgctgttttgangcancccnttaccctnggggaatccggggaatnatcanccaaccgttccctcaa

SEQ ID NO: 96493 - DNA, 260 bp, Triticum aestivum
  unsure (1)..(260): unsure at all n locations
  Clone ID: PAT_TA_96493
gcaaactgttgcctccgaaattctttgtgggatagaaaacctcaccaaccaattcaaaaaaaaaaaaaaaaaaacccaggggggggccgggtaccaaattccccctnanagtggagtncgtttnnacgcnctcaactgggcntcctttttaaaagtcgtngactngggaaaaacccnggggtttcccaaatttatncccttgtaagaaancccccctttttncanatggggggtaanaaangaaanagggccnncccacg

SEQ ID NO: 96494 - DNA, 370 bp, Triticum aestivum
  unsure (1)..(370): unsure at all n locations
  Clone ID: PAT_TA_96494
cgcaactccgatttccctaacgcnccntgccttcangacctgcaagccaaggnancaagttcaagatnaaaatggagctggagcaacactttgcggnatgtggtccnaaatangagtaattgaganggaaagggnaaaaccccaagcgatctcncncaanatggggngtatgtatcactgaagangtgtgcanttttcaatgggtgtttggctttggagggtgcgcccnngataataacaaaatctcctcccaaaaatccaaagcttgcaacccctatgaaaagaaacttgttatgaatttgtgtcaattgtgtcaacttaaacaaggtttcctgtcctgggatgtttgggtgggttgttggggaccttt

SEQ ID NO: 96495 - DNA, 479 bp, Triticum aestivum
  unsure (1)..(479): unsure at all n locations
  Clone ID: PAT_TA_96495
cagcaatcccccaaatctcctcaagcctcccgcgcatctcctccgacatggcccgcaccaagcagacggcgaggaagtccaccggcggcaaggcgccgaggaagcagctggccaccaaggccgcccgcaagtccgccccggccacaggcggcgtcaagaagccccaccgcttccgccccggcaccgtcgccctccgcgagatccgcaagtaccaagaagagcaccgagctgctcatccgcaagctccccttccaagcgcctcgtccgcgagatngcccaggacttcaagaccgacctccgcttccaagtcctccgccgtctccgccctgcaagagggcgccgagggctacctggtgggcctcttcgaggacaacaaactctgcgccatccacgccaagcgcgtcaacatcatgccaangacatccagctcgcccgccgcatcgtgggagagaggggctaaactctgttcgtcgtcgtct

SEQ ID NO: 96496 - DNA, 412 bp, Triticum aestivum
  unsure (1)..(412): unsure at all n locations
  Clone ID: PAT_TA_96496
cgcangtgaatgccggcggngtgaacaaaatcgttggtgtgggcgcncaagctgacgtggagggcatcttccnagattccatccccaaaaagaagntggagactttccaacccaactgggntgctgggnccccaaaaactattgcgagggagaaatgggggcgtcccgttgctaaggcaagggtccnggccaattccgggctggtccgtcatgggcctccaaacaaaccttgcaaggagggaacaaagggcnatctttctttcanaaatggttaaaacacaaacccanaaagtncaaaaggttctcaatgtnggaaccccccctccacaaaaaatnnanttggggaggggaaaaaacntgtttaaaancccaccaaanttggggggggtttgtnggccatnnaacaatcccc

SEQ ID NO: 96497 - DNA, 180 bp, Triticum aestivum
  unsure (1)..(180): unsure at all n locations
  Clone ID: PAT_TA_96497
aaactaatnggattnccccgggctggcnagggaattccggcaacgaagcaaaaagctgttgncccttgcnatcccccnccgtaatggaacnggggaagaattttgttggnttgtttgttgaccngggaaatgaaaccgttcctttgctccgggcctttggnngggaanggttaaaccaat

SEQ ID NO: 96498 - DNA, 551 bp, Triticum aestivum
  unsure (1)..(551): unsure at all n locations
  Clone ID: PAT_TA_96498
agcctctcccttctcttaaaccaatcaaacgctagaatccttgggaattccccgctcctccgatncgttcgtcgccgccgggatnaacatgtcgtaagcctanctcttcaagtaaatcaacatcggggacaaaangggtggggaagtcaatgcctgctggctgnagttcaacngacaaagaaggnttcaaaccccgtgcaacgancctcaacaatcnggngtncgagtttcgggnggcccgccatggttnncaatcgacaanaaaggcccaacaaagctccaaaanttnggaanaacggtggggcaaacaatcattcaanatttnattaacaaagatnatnacctacaaaanggnggngtggccggggggnccccttttggggtttangganaacccccaaagaggggggaaanttttnaacaaanctttgcgannntgggggangaaaaaaagggaaggaaaancaatgcaaaattgccnaatnattannagtgatgttnaatcccggaaanaaaaagtggatntggnctcaaaaaaaacgggggnggtt

SEQ ID NO: 96499 - DNA, 200 bp, Triticum aestivum
  unsure (1)..(200): unsure at all n locations
  Clone ID: PAT_TA_96499
aatgggnaagtgatgacntggattcccatgcanaaaaggnttggcgaaatgaaatatacgnaaaagacaagccggatgaaccctgttaataaagatntgggcattgaaaagcgctgaacaaacccatgggctcccaaaagnagggcagagaaagcatcnnaattggnganngagagttggcggggaagcnaacccaaagc

SEQ ID NO: 96500 - DNA, 469 bp, Triticum aestivum
  unsure (1)..(469): unsure at all n locations
  Clone ID: PAT_TA_96500
ccgccnctgacgcatctcgagtattttccatgttcgccggagaaggagcaagatggccggaaggaagggcggcgacaggaagaaggcggtgacccgctccgtaaaggccgggctccagttccccgtcggccgcatcgggcgctacctcaagaagggccgctacgcccagcgcgtcggctccggcgcccccgtctacctcgccgccgtcctcgagtacctcgccgccgaggtcctggagcttgcaggcaacgcttccaaggacaacaagaagacgcgcatcatcccgccgccacctgctgctcgccgtcngcaacgaccaagaagctcggcagggctgctcgcttggcttaacaatcncccnacgggtggcgttgatcccccaaaaataaaatctngttgttgctcccccaaagnaattccnccgcaaccngnagaanggaggcnaaatncccccaaaaaaaaaaaggcc

SEQ ID NO: 96501 - DNA, 195 bp, Triticum aestivum
  Clone ID: PAT_TA_96501
gctaccccaggctgaatttcgcggttctgctggcaatcaaaataatggtactgcctgcttgtgtgtaggtcgattgattgcgaccatgtgtgatgtattggtgtttcagttccggcctaaaaataaaaaaaaaaaaaaaaaaaaaaaaaaaaaaaaaaaaaaaaaaaaaaaaaaaaaaaaaaaaaaaaaaaaaaa

SEQ ID NO: 96502 - DNA, 389 bp, Triticum aestivum
  unsure (1)..(389): unsure at all n locations
  Clone ID: PAT_TA_96502
ctccaggtcacacaatccgaaatgctaaccgatttggttcnagtgctccaatcagtatccctgtcccttagtgaacantgcattgccanatgtatcacagncacttcaagctatannaggaactaatactgctcangtatctcagcaagttcanccacaaggnancaatcctttcantggcactgncacgaaaagtgcccctcagnnatntctcattgcgccaatagnatcctcatggggnnacaaggtcagntgncaccatcttcccangctgccctcaaatgtnantgcatggntgtagnaccctcaaactttcccggnnccgacnctcgcnttantgacgatnnangacactnccctggcaagaanccaantgttcttangnttcc

SEQ ID NO: 96503 - DNA, 474 bp, Triticum aestivum
  unsure (1)..(474): unsure at all n locations
  Clone ID: PAT_TA_96503
tcgcggatcatggcgtcctgggtgggcgaggagaagccgcaggtgaagccgaactggatggggccgagggcgacgatnagcgtgcagaggagcgccgagacgtgggactcgcgcagcaccgccatggaggaggcgccgactatctgccgcgacgacgaccccaccatcctgtaccagctgcccgtgttcttgagcagcagcggcttccgcgtgccgccgccaccctcatggtcgctgccgctctcatcgccgccgccgttcatcgccgaggcaacaagctaggctgcaaccgcgagggggtggcgacaagatcggagggagacgacgagaggagcaagagcgacagtgggaagaagaggtcagccggaagttggtgccggatttgggacaagcccgtgtctgagctggaagaataatccanttttgtccgaggccaacaaaaataaaaggagccagattttgtctctcctgctn

SEQ ID NO: 96504 - DNA, 461 bp, Triticum aestivum
  unsure (1)..(461): unsure at all n locations
  Clone ID: PAT_TA_96504
aggcgatggagcgggcggccgtcgtctgaggctaggccacgtcggnccgggaggagaccatggnggtcgtcctcgttcacctctgctccagcagcgtcgccttaggagatggggacaccggcggctgccggagcgtcccgtggactggagcaaccanggccggaatggggcctgggaggagctgccggtgccgaccggcggatctgataagccaaggcctatgctgctnaagccgaacacatggaagtatgtctgcaanggttganctactgttcccaaaggcttggaagaggtgttgtctgcaaagcacgtacatacgggtggaaaagagagatcccttggngtataactaagtgtcncgcangacctgccggggatcagcacctgttgccnccatgttcgtttttgtgatgttgttgccntggaccaanacgccgacangaatgttgttnccnatggtt

SEQ ID NO: 96505 - DNA, 470 bp, Triticum aestivum
  unsure (1)..(470): unsure at all n locations
  Clone ID: PAT_TA_96505
aagaagctgcagcggatgccgccggtccgtgcgtccgcaatgcgtggccgcgctccttctcggcgccgccgtggtcctctccgccctgttctggctgccgcccttcgccgggcgccaccgcggccgccgagctgggccgccggatcccccgggggacgcgctcgcagctgatatagtggcaagctttgtgctacaaaagacggtttcagagttgaatgaaagtatacctaagcttgagtttgacatctatgaggaaattggcatccctaactctactgttgctgtaaattttctacaaccatcaggtgcatcaaactggacaaatgtcatcttcagcgttgtgccttatccaaaatactcaacnatgtcatcaacatggttgagcattcttaggttctcaatttaatgtcctttggttgttncaagcaatncaacactncaaattgacaagagtcnctgtttggggaact

SEQ ID NO: 96506 - DNA, 405 bp, Triticum aestivum
  unsure (1)..(405): unsure at all n locations
  Clone ID: PAT_TA_96506
nncgagttttttttttttttttttttttttttttttttnacctttcnntnatttcctttgggggtcaaaaatataatgaccttattgaaaatgtttantggctcncatntgcatgattgtttatttaatttagagcccanantacctantcntccctcncttgatttgaatgcttgcagatnccagcttatcccaatncacgtgcaccantantattatacacatcgttcggncgtgcaagtnanaggcantaatgacnancctatnatgggnctggttgagatgnanaaaagctgggtannaacccgatctcncttgtttttgtaaacannattgacgtctcatcgctccctaattcaangcttacttatnaangnaacacatatttgcantggncattncaaa

SEQ ID NO: 96507 - DNA, 158 bp, Triticum aestivum
  unsure (1)..(158): unsure at all n locations
  Clone ID: PAT_TA_96507
ngtctccctcacnctcntcgngctcgcngcctcccttcgcgtgcngcctcatgggttccatctccggatctgccgtgtccttcgccaagcccgtcatggcaaccaacangaacncactctctttctctggngcanggaggggtaacncatttcttcgc

SEQ ID NO: 96508 - DNA, 497 bp, Triticum aestivum
  unsure (1)..(497): unsure at all n locations
  Clone ID: PAT_TA_96508
ccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttccagcgcctggtccgcgagatcgcgcaggacttcaagacggacctccgcttccagtcccacgccgtgctggccctccaggaggcggccgaggcgtacctcgtcgggctgttcgaggacaccaaacctgtgcgccatccacgccaagcgccgtcaccatcatgcccaaagggacatccaagctcgccccgcccgcaatccgntggcgaagaagggcctaaagcttgtcctccnccgttgaaagaacggttgtnggattcgggatgaagttgatttccnggtggtaannttggttcctaaattgctgntcccnag

SEQ ID NO: 96509 - DNA, 360 bp, Triticum aestivum
  unsure (1)..(360): unsure at all n locations
  Clone ID: PAT_TA_96509
nactcgaccaaggaccgccatcacaaggccgcggggtcctactactacctcgacgacggactganaggcgcgccgcccctcccgagagaatttggtttgactgatcttgtttttaggtgaattgaattacgcccggatagacagacanacagacctgggtttgtccccgtttttgtcctgcgttttgtactgacgttgnagagatttggcagatgagacagcnaactgcacctgctctgtcccaggtcaaaagcaactctgttatcttggctacttaattancacctangaattganttancatancatgcaaagccagacctgatctgaatctganggttatgtntctgccaaactcta

SEQ ID NO: 96510 - DNA, 272 bp, Triticum aestivum
  unsure (1)..(272): unsure at all n locations
  Clone ID: PAT_TA_96510
ggcacagttccgacttgcacataatgaaccacacattgtgaatgactgaaataaacaaggcataaatgaccagtataagccactgaaaactggacagagtctcatttcaaccaacctaacangcaaatacagataaacagggcatatgcttgaaaactggacaaatgctcacttcaaccaacctaacaagcagataaagataaacaaggcatctgcttgataactggagaaatgctaaaaaaaaaaaaaaaaaaaaacaanaaanaaaaaaa

SEQ ID NO: 96511 - DNA, 160 bp, Triticum aestivum
  unsure (1)..(160): unsure at all n locations
  Clone ID: PAT_TA_96511
ggctatttatacataanntggaagggatggnaaatttcngatatgntgtttgccaccaagcgtggcttggctgntgcctgcatcatagttngcaaacacttgnctcaggtttcacaaangtgctcatgcttcaaaaaancatttggctggaaggntcgac

SEQ ID NO: 96512 - DNA, 474 bp, Triticum aestivum
  Clone ID: PAT_TA_96512
aattcagttactgtgggtacaatcatcattcgattttatgttatttagtggacaacttgtatcgaattttacttgtgtgtatctgattctaaggtccatgcagacacatatccacttgcagtggcataaaaattgttatttatctatataaggtcaaatcaacttgtttgttttctcaagttttatttgttgtttatgtatatttttacagctctcctctcaatggcacaaccaagtggcagtgaatccagtggtaggggaaaagacaatgatgacttaactcctatccccttcactcttcatagagatggtaacactagtctgcgttatctctatttagagatgccttctggtatggaaggcatcttcaaaagtaccgctttgtgacgcccggataattaaggttacaagtgatcccacgcctaaatgggtgccaacctcaaccacggtttaccgcctactaaatccaatcgg

SEQ ID NO: 96513 - DNA, 458 bp, Triticum aestivum
  unsure (1)..(458): unsure at all n locations
  Clone ID: PAT_TA_96513
gcaaggactcccccaacccccatgcgttgtccccgtcgaggagcagccatggcctcttgacctccgcgccctcgtccgggtcgttacccgagctgcccgcgaggcggcatagcaagtcggggttgtcgacgaccttgaggaggaaggcgaggatctgcttgggccggtgctccgtctcctacacctggcgccacatctccgccacgctctcctcggaggctgtctgctccctcctcagccggaccatccccatcaccagcatcgtgctgctgctctccccatcatcctcctccttgttcttaccgtccttgccgccgcgcttgccaacgctctggcgccggacgatgcggggcaagaggtgcatctggctgtggaggaaaaangcgttgcgcgaactcccaacggtccgggtccacggactccttgancaagcaagatctcaacactggtgcgggctc

SEQ ID NO: 96514 - DNA, 476 bp, Triticum aestivum
  unsure (1)..(476): unsure at all n locations
  Clone ID: PAT_TA_96514
ccaccacccacctacccaaatcccagccgccctaaaaccctaggccgccaaacccgccgccgccgccgccgcaatgcaggccgccgcagccgtccaccggccacacctcctcgcggcgtccccgctcgggggccgcgccagccgccggccctccacggtccgcatggcgctccgcgaggacgggccctccgtggccatcgtgggcgccaccggcgcggtggggcaggagttcctccgcgtcatcaccgcccgcgacttcccctaccgcagcctgcgcctcctcgccagcgagcgctccgcgggcaagcgcatcgacttcgagggccgggactacaccgtccaagacctcgcggcgccgggggccttcgacggggtcgacatcgcgctcttcancgccggggggagcatcaaccgcgcccaagcgcccgccgccgtcgccaaggggcgncgtcctcgtggataaaaanctccgccct

SEQ ID NO: 96515 - DNA, 469 bp, Triticum aestivum
  unsure (1)..(469): unsure at all n locations
  Clone ID: PAT_TA_96515
gcctcctcagtcctcacagcatcctctcantccttagcttccttccctcgccgccacccaccaaggaaaggaggatgtcttgctgcggcggcaactgcgggtgcggcgccggctgcaagtgcggcaacggctgcggngggtgcaagatgttccccgacgtggaggncaccgccggcgccgccgccatggtcatgcccaccgcctcccacaaggggagctccggcgggttcganacggccgggganaccggcggctgcgactgcaccacctgcaagtgcggcaccgcntgcggctgctcctgctgcanctgcaactgagccggcgcccanggaggncggccggcagaggcgaagcacnaggattaggaggacangcangcaagcaccatcancaccangttcaccancacncagcggtatcatcaccagccgcccgcatgcgctcncgggccgcgngcnnctgaataaat

SEQ ID NO: 96516 - DNA, 460 bp, Triticum aestivum
  unsure (1)..(460): unsure at all n locations
  Clone ID: PAT_TA_96516
ttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggnctgatggacttaccagtcttgatcgttacaaaggacgatgctatcacatcgagcctgttgctggggaagacagccaatggatctgttatgtagcttatccattagacctatttcaagagggttccgttactaacatgttcacttccattgtaggtaacgtatttggtttcaaaggccctacggtgctctacgtttggnaggatctacgaatttcccccnacttnttcaaaaan

SEQ ID NO: 96517 - DNA, 459 bp, Triticum aestivum
  unsure (1)..(459): unsure at all n locations
  Clone ID: PAT_TA_96517
gcttcaactgctgatatttctcagaagactgtgccagcactgtcagtgccctcaacccaaccagtgacggagacatcgctcattaacaggaaggttgtgacgagatggnggcccctcaagctggtgtatggccatgacattaggcttggggagatgcctgaaaaatgcagcttccagacgctccgggaagttgtggcgaagcgcttcccatcatccaaggctgtgttgatnaagtanaaggatgccgatggtgatctagttaccatcacttgcacatcagaactacgattggccgaggcttgtggtgttggcaccgatgcaatggaaggtgatactaagctccccatgttnaggctgcacattgttgaagtaagtccanancaggagcctccgctgccaacagaatnagcacaanctggatgaggaggacttgttgatcaccggttatgatagctnttn

SEQ ID NO: 96518 - DNA, 287 bp, Triticum aestivum
  unsure (1)..(287): unsure at all n locations
  Clone ID: PAT_TA_96518
nagaanctcctccccncggcgcatctccatggnccgcaccaagcagncngcgaggaantccaccggcggcaaggcgccnaggaagcagctggcgaccaaggccgcccgcaagtccgccccggncaccggcggngtcaagangccccaccgcttcngccccggcancgtcncgctccgngagatccgnaagtaccannagagcacngagctgctcatcngcaagctccccttccagngcctcgtccagcnnnatcgcccangnacttcangancgacctccgcttcca

SEQ ID NO: 96519 - DNA, 331 bp, Triticum aestivum
  unsure (1)..(331): unsure at all n locations
  Clone ID: PAT_TA_96519
aatccccacacatctgtccactccccgaatcctctcctcaccaccagcgcagcagctcgccatggacgcctcagccaccgtagccaccgggaaggggaagaagggcgcggccgggcgcaaggcgggcggccccaggaagaagtccgtgtcgcggtccgtcaaggccgggctccagttccccgtcagccgcatcgggcgcttcctcaagaaggggccgctacgcgcagcgcgtcggctccggtgcccctcgtctaacctcgcggcccgtcctcggagtacctcgcccgccgagctgctggagctccgcggggcaacgccccccangggaaaa

SEQ ID NO: 96520 - DNA, 442 bp, Triticum aestivum
  unsure (1)..(442): unsure at all n locations
  Clone ID: PAT_TA_96520
gcaacacggaggatagcaagggcatcatcacgaccacggtgagttcgcatgtggtgcagaactcgtacgcgccgagccggactctggtcatcggcaaggtggccttcatggggctccggtcgccaccaaaggggttcaccgtctatgtgaacggtgctgagctcaaggcagccggcaccaagtcccggacgaacggagtattcagcgtcagtgggttgtcgctggtcatcggacagcagttcgaggtaaaggtcgtcacgtctcactaacatcgagacatttgtgcaagttctttatcttaatnaacaattaaaattgggaataaccgtctaacaattctcangcatagttnttangctacttccaatacaataaggttcctatgtttaggngntaaacaanattttaaaaccttaacaaactgggccctccccaagtngat

SEQ ID NO: 96521 - DNA, 439 bp, Triticum aestivum
  unsure (1)..(439): unsure at all n locations
  Clone ID: PAT_TA_96521
accactcccagccgacgtccctggagacagcttccgtgacccaaccacggcgtgggtaggccgcgacggcctatggcgtatcgccgttgcagccaaggttggtggccccaatggcattgcctccacgctcatctaccggagtaaagactttcggcactggaagcggaatgccttgccgttgtacacatcgcgcgctgcaggcatggtcgaatgcccggacttattcccggtggcggagcctggcgtggaggagggacgacttggctacgcgtccggaccagcgagcagtgctgtgaggcacgtgctgaagctgagtgtgatgaacacgacccaagactactacgcggtcggcaggtatgangacatgggnggacacctttggtgccgggagggtgggatgtaagagcgcaaacgcccgaactattngccgggacctggt

SEQ ID NO: 96522 - DNA, 327 bp, Triticum aestivum
  unsure (1)..(327): unsure at all n locations
  Clone ID: PAT_TA_96522
ggaaatgttgccaggaacctggctgcgatgatatcgtcagtggnagggtaatgtactgcaatantcacactacgagggcattcatcccaacagcttggttacctccagagttcacagaaaacctcagntttatacatgccccctgttaaaggcanacagtgtacttnaacccantgccagtgcatgagcangatgtcagtaccaagtcngangggaatnatcaangcaaactcaatgntggatctggggatacccagggaaacactggncaactnatcttgggtggtccnngganacacttttgcangcancnataanctgtcaaac

SEQ ID NO: 96523 - DNA, 461 bp, Triticum aestivum
  unsure (1)..(461): unsure at all n locations
  Clone ID: PAT_TA_96523
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcaccccgggggcaacggcaccggnggcgagtccatctacgggcgaagaaagttcggcccgacnnagaagttcggtccaacaatcacaacnangccccggggatcctcctccaatgggccaaacgcgggggcccnaacaacaaacggggtcccaagttntttcaatctttg

SEQ ID NO: 96524 - DNA, 451 bp, Triticum aestivum
  unsure (1)..(451): unsure at all n locations
  Clone ID: PAT_TA_96524
aaccctagcagtagcgccgccgccgccaggtaagaggcgagatggtgtccggctccggcgtgtgcgccaagcgcgtggtggtggacgcccgccaccacatgctcggccgcctggcctcgatcgtcgccaaggagctgctcaacgggcagcgcgtggtggtggtccgctgcgaggagatctgcatgtccggcggcctcgtccgccagaagatgaagtacctccgcttcctccgcaagcggatgaacaccaagccctcccacggccccatccacttccgcgccccggccaagatcctctggcgcaacaaccgcggtatgattccgcanaaaaacgcgaggggngaggccgccctcgccangctcaaggcntnagagggcgtccccgccnncttncgaaaaggaccaangcgcantggncntcccccncgggctnaagggtcttaggggtncat

SEQ ID NO: 96525 - DNA, 441 bp, Triticum aestivum
  unsure (1)..(441): unsure at all n locations
  Clone ID: PAT_TA_96525
gcccagatcgcctccacagaagaaaatccggcacgcgaggccgtagccgtacgcacccacgcacggagggccagcgggtactccggcggtcctcgagggcgcccggcgaacccgtacggccgcgcctcgcttccggctcctctcccactcttctcccccatctccatggccgtggggagcgggccgtgcttgctcgccgtggcgcttctcgccgccgcttggatctccgacgcttcttcatcggataagcaggcacacagcaaccaagcaatatgtcaattgcatgccttgctctaggacgtacgtcgctnacgcatatgcccgatnccttaacaagccangctttctcaacatcatgactttacccaagtatctgaaaacacttaacttntgtaaagggacttgctgaatnaacntgattgtggctacncttttaaaaat

SEQ ID NO: 96526 - DNA, 457 bp, Triticum aestivum
  unsure (1)..(457): unsure at all n locations
  Clone ID: PAT_TA_96526
atcccccgtcgccctcacgctcttcgtgctcgccgcctcccttcgcgtgctgcctcatggcttccatcgccggatctgccgtgtccttcgccaagcccgtcaaggcaatcaacacgaactcgctctctttctctggtccaaggaggggcaatgcatttcttcgcctgcagccagtgccnatgagatttgctgtttgctgctcagcaaagcaggatacagtggagaaggtttgtgaaattgttaagaagcagcttgctgttcctgaaggcactganagtttgcggtaccaccaaagttctctgaactttgggtgcttgattcaactggacnacggtccataatgtgaatgggcctcgagggagggagnttccaataatcanttgtnganggaaancgaattgcgcnanggcaatttgcgaanaagttngaaanaattctgccaacnccnantcctnct

SEQ ID NO: 96527 - DNA, 461 bp, Triticum aestivum
  unsure (1)..(461): unsure at all n locations
  Clone ID: PAT_TA_96527
ggagtacctgatactttcccctatggctttgtggtttgcaaaaataaaattgaggggggatacatgtgaagtggatctgcagtcaacgggggacattggtttgcgtcaaataggttagcgacgcagctcccactgggccggcccattggccagcgttgtagcgagcacggtagtttgcagtgtgctagtacagtgcgatgtaaaattaatcaaaaaagggtgaccccgcanggaatcaaactcctgaccactccgctcgtgaactcgtggcggtaactantctaacggacgaagtggtaactaacaanatgaacagcatgaaaagtttaagaattaatttcccgaacgggcgttatccttgaaacaactttctaaaagattttttgnacaattggcaaaacctggnngantaatttttcccaaaanggaaaattaanngtttggccaaaatcctgnntgan

SEQ ID NO: 96528 - DNA, 450 bp, Triticum aestivum
  unsure (1)..(450): unsure at all n locations
  Clone ID: PAT_TA_96528
agtggttctattccataatttaatttgaattaatactattcaaaacatctcgtttttgtttctccacatgagggtcgaattccatttttgtgacattgtatgcatgtgctctctatgtgctcaaacaagcgtagtatttgccataacattaagaatcaaaataagttatagacaacaagaaaataaagaaagatgagccccatccctcaaaaagagaaaaagaaaaaaaaancagagccccatccaaattctgctagcaacattttcctttttttggtttgttcgatatatatctcagatgcatatatttggtaccaactttaaacancataggttcgtcaaaaaaaaaacaatatcannatcaaggtacaatatggttcngaattaaatnaaaangtttcctcngaggggggggccccggtanccccaattncgccctaatcngtgang

SEQ ID NO: 96529 - DNA, 440 bp, Triticum aestivum
  unsure (1)..(440): unsure at all n locations
  Clone ID: PAT_TA_96529
catcacttcctcttcttcccaatctcgcacacctctcggagctaggcggagcggngatgtcggggcgcggcaagggnggcanngggctgggcaagggcgncgccaancgccaccggaaggtgctccgcgacaacatccagggcatcaccaagccggcgatccggaggctggccaggaggggcggcgtgaagcgcatctccggcctcatctacganggagacacgcggcgtgctcaagatcttcctcgagaacgtcatccgcgacgccgtcacctacacagagcacgcccgcccgcaagaccgtcaccgccatggacntcgtctacgcgctcaagcgccaggggcccgcaccctctacgggcttcggaggctangatncgtgggttccgcgggngggcggttccggnagtttggactggtgntcngtcntgtgtcctctnt

SEQ ID NO: 96530 - DNA, 523 bp, Triticum aestivum
  unsure (1)..(523): unsure at all n locations
  Clone ID: PAT_TA_96530
gccatccaacaaaatctcagttcgactgccgatgcctgctggtaaagctcatcacaaacaacatccattatctgctgcggcatcgtggggttgtgtgatgaacaagtttttctagatgacggccagcctgatcaacatccgttaactgctgctgtatggcatggccaagaagtcctggagcacacggtcctgtatgcccttctcctacgtatactacactaaataaaacacaaagactctgctacgtagtactccattagttactctatgagtcgtgtgagtccttcatgccaagagctggattattagttaaagagggtcctatatattggtcccatccattgggatttgtgggagatcaaattcacaaatgtatgccaaattaccggccangggaattatatgtgaaccttgtcttgctttatcttatcattatttgggggccaactaaaatatatattggtangtcttcccttaaaanaaaggggggggnccggtacccaantccgcccaatagtgagnc

SEQ ID NO: 96531 - DNA, 418 bp, Triticum aestivum
  unsure (1)..(418): unsure at all n locations
  Clone ID: PAT_TA_96531
ccggcaccaaaggctgctccgcaccccgcgcggcccaccgacgccccatcatccccgccaccaccccggcacgcccggccaaaaccctatccgctacgtcccagccgccgccccgatctccccgcgctccgccgccgccgcggccgccgccgccatggaggacgacgccatcaccacgctcatggacatcgacgactccccccgcagcgccgccggcgccggcttcctcgacgatnacnacgagggggacctcctccactcccaccgcatgggcggncgcgggaacgaggcgcgcggncccctcccccttcgccgggctttttcaacancttngaacgggngccgactttcganngaactcccgatctgggctnatccgaaggcgtcctccgggtactagtatattgngggcttgggg

SEQ ID NO: 96532 - DNA, 205 bp, Triticum aestivum
  unsure (1)..(205): unsure at all n locations
  Clone ID: PAT_TA_96532
aagaggataggnggaggcggcngnggacaagcttggtangganatcnatggggctgtcnttcgggacnctgttcggngcnctgttcgccaacaanganatgcggttcctgatggtcgnnctctacgccgccnngaataccaccatcctgtacatnctgangctcggcgaagatcgtcancatcatccccaccatcggngttcaat

SEQ ID NO: 96533 - DNA, 411 bp, Triticum aestivum
  unsure (1)..(411): unsure at all n locations
  Clone ID: PAT_TA_96533
aaatctaaaatgcaaaggtcgtcttattcaaaacctcaatcatcacatcccctctctcccacttcacacctcggaacgcactgttcttatagagagaaaggcgctttcccatcttcttaacctgaaatgaaggggtacccccgggaagagatccagtggagacagctgggcctgtagctcagaggattagagcacgtggctacgaaccacggtgtcgggggttcgaatccctcctcgcccacagccttccaaagggggaagggcctttactttccccctgagggtaggaaaatcatgatcgggataacngacgtaangctatttgnacttaagggtatggtctttccttttgtcgaaagtgggaatcgttnaanaagaatgttgattacgatgaagatngggtggnattgg

SEQ ID NO: 96534 - DNA, 443 bp, Triticum aestivum
  unsure (1)..(443): unsure at all n locations
  Clone ID: PAT_TA_96534
cccacccccaccgatcaagtcaccatctcttctccggtcaccgtgtcctccgatcaggtcaatccctctcacctcgcccacatagctccccggccggccgtggtctgatcgctgcagaagaaggatctgtgaacgaggatgttgtcctcgcacccgcacgaggcggccatgctgccgtacgtgccgcggccgccgtcgctgctggtggaccggcgctacagcaccggcgccgaggtggcgcccaactgcccggcgctgcgactcgcccaacaccangttctgctactacaacaagtacagcctnagncaagccgcgcttacttctgcaaagggctgccggcgggtnctgggaacaagggcgggtctcctccgggaaagtgcccgtncgggggggatgcccgggaanaaccnccgggggggaagtccgtccngttgnggtccgt

SEQ ID NO: 96535 - DNA, 338 bp, Triticum aestivum
  unsure (1)..(338): unsure at all n locations
  Clone ID: PAT_TA_96535
agaattcttaattcaagagttatanggagggacttatgtcaccacaancanaaactaaagcaggtgttggntttaaagctggtgttaaagattataaattgacttactacaccccacagtatgaaactaaggatactgatatcttggcagcattccgagtaagtcctcagcctggggttccgcccnaagaagcaggggctgcagtagctgccgaatcttctactgggtacatggacaactgtttggactgatggacttaccaagtcttgatcgttacaaaggacnatgctatcacatccangccngttncctggggaangncagccaatgggtccgtt

SEQ ID NO: 96536 - DNA, 519 bp, Triticum aestivum
  unsure (1)..(519): unsure at all n locations
  Clone ID: PAT_TA_96536
cacagatagagatttatctgtaccatccagacatacgtatgtccattttttagagtagcctaggaagtacactgcatacaacattcataaatcacaatcacatattgtgctcattgtccaatgtgttgtaggactcggttaggatatcatgtttgtggggcaatctgttgtggttgcaatgtttagttcgtaagttaactgcgattgtgtttcacgcatttagcttataaattaatgaagtttacacatgttcagttggcattcatgctttatttcttttattagttagtttactgaccatattgagacaataaatataaaaactttgcagcttatgtttccttctggaaacattattttcgataaatgtgaataacaaagagtgtgttactgtctttatctttattggctgtagttttgatctacctttggtacaaagatatttcatcaattcctgggtagaacatacatttattgggtttaccttcnngaaaggcatcttaaaccggacnttgtagg

SEQ ID NO: 96537 - DNA, 504 bp, Triticum aestivum
  unsure (1)..(504): unsure at all n locations
  Clone ID: PAT_TA_96537
gtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgaagaagttcgtccaaaagcacaacaagcccgggaatcctctccatggncaaacgccgggcccaacancaancggntcccaagttcttcatctgcnancgttccctggaattgggtccaccggaagcacgttggtcttcggcgaaggccnccaagggatg

SEQ ID NO: 96538 - DNA, 327 bp, Triticum aestivum
  unsure (1)..(327): unsure at all n locations
  Clone ID: PAT_TA_96538
gatccatccatccatccatccggccgccccaaccccaacaccccccgcgaagttccccgcctcagcgacgcgcgtcggcgcatgtacatttccctccccgtgccgtgccgctccagtgtgtgacgacgaaccgacgccacgccacgccacgccggcgattgtcaacccggccggccgcgtgcatgctaggaagaagaagaagaagaaacagtagccgttcatttgtacttaggttcttgttagcgtcttggtttgtgggtgtgtccgctaagctaaatccgtaaatgcatgagatttttccgtaccatcaanaaaaaaaaaaaaaaa

SEQ ID NO: 96539 - DNA, 537 bp, Triticum aestivum
  unsure (1)..(537): unsure at all n locations
  Clone ID: PAT_TA_96539
ctcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaaacgaggagttcctccaagaggaaagctcaacaacgacaaagctgaaggcggganggcaaaggttccgtggtgagggtatcagcaaccaaagagggcaagccaagcaaggccccaaagcctgggttnatggtgggagggnancaacaacnnaaganggtnaacccccatccc

SEQ ID NO: 96540 - DNA, 213 bp, Triticum aestivum
  unsure (1)..(213): unsure at all n locations
  Clone ID: PAT_TA_96540
gntttttttttttttttttttttttttttttttttttaccancacgggaaccaccggaccantcagccacagagcantcaaagaggtcacggcctgganaaggcacccggantgacgggtanctccattcgggatggcggtcnaaanacaagcaagtgcantggncggagtcccnntctggagtgagagcancagcggacgtcccgttcanga

SEQ ID NO: 96541 - DNA, 494 bp, Triticum aestivum
  unsure (1)..(494): unsure at all n locations
  Clone ID: PAT_TA_96541
ttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacagccaatggatctgttatgtagcttatccattagacctatttgaagagggttccgttactaacaagtttacttccattgtagggtacgtatttggtttcaaagncctacgtgctccacgtttgggaggatntacgaattccccccacttattcaaaaacttccaaaggccgccccaaagggaaccnagttgaaaa

SEQ ID NO: 96542 - DNA, 225 bp, Triticum aestivum
  unsure (1)..(225): unsure at all n locations
  Clone ID: PAT_TA_96542
tcaggcttctcacccttttcatttgtagttgtctgtactcagacaagttaagcttcctcatgtgctattgcttgtatgatttgaatgctgggtcatgagacccatgtttgtaatatcttgctcttcggagtcttatgaataaatattttcagtcgtaaaaaaaaaaaaaaaaaaaaaaaaaaaaaaaaaaaaaaaaaaaaaaaaaaaaaaaaaaactcaanggnc

SEQ ID NO: 96543 - DNA, 195 bp, Triticum aestivum
  unsure (1)..(195): unsure at all n locations
  Clone ID: PAT_TA_96543
gagatcactagcagttgttttttccttttgtttaacggacagtcagaagcgttgggcttcctaattgtaaggcgatcactagtgtttacttgttcgtaactttgcatatgtcgaagcagaacgaatgttagaatttgtgctgagtaaaaaaaaaaaaaaaanaaaaaaanaaaaaaaaaaaaaaaaaaaaanaaa

SEQ ID NO: 96544 - DNA, 314 bp, Triticum aestivum
  unsure (1)..(314): unsure at all n locations
  Clone ID: PAT_TA_96544
gagagatggagtgggttgagggtgtcgttgccctggttttgaccccccacggattcctaatacttgggcttgacccaatgctataaaaaagatcaccacataaaaaactaaaaagaaaatggaagtgtcatatcacatatctgaaggctcaaaactatatatttcaantcttaaactaaaaataaaaaaaagtaaatttaaagtctcaaactacatattttttaaatatgcaattatttccattttaaaataatataaatttaataaaagtaaactataatatactataaaaatgtcaccacacacnctcattc

SEQ ID NO: 96545 - DNA, 303 bp, Triticum aestivum
  Clone ID: PAT_TA_96545
ttccatccaccggccggctgccacggttacttgctccagtacgtgttggtagccactagacttggactcaaatggacgccctgccaggagagcaccgtggagaagagcgccaaggtgaaggggcagtccttgcacagattggtggcagtttccgggacctgaaacacccacatatcgtgttttgatttcttgtttgaaactactgggcgtccatattactaacacttcaccatccaagtgaagaatgggtggacaactctaatatgattaatgtcatcttccttggggctttttttttaccaa

SEQ ID NO: 96546 - DNA, 167 bp, Triticum aestivum
  unsure (1)..(167): unsure at all n locations
  Clone ID: PAT_TA_96546
cggnaacgagtaancagcgaaagcgggcgatggcagcggcctccgcctacgccgttgcggtcgccctcttctgcctcctcgccgccgatggctgctgcggntgcttttggtttctgcctgccatattctgccctggacactcccccangcctacacncgccccccgc

SEQ ID NO: 96547 - DNA, 470 bp, Triticum aestivum
  unsure (1)..(470): unsure at all n locations
  Clone ID: PAT_TA_96547
cctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcangacggcgggcaagcccaaggtggnggcgtccaagcancccgtggtacggctccgaccgcgtgctctacctcggcccgctctccggcgaccccccaangctacctcaccggnnanttccccncctantaccngttgggacacngggggggggnccttcggcctatccccggagaacccttcnccanngaaccggggagctggagggtnnttccaattgccnnctggggccaatgcntcgngcgtcgctcggggctgccgntctttcccnngaagcttgctccgccccngncaacggggnntcagantttcngtt

SEQ ID NO: 96548 - DNA, 454 bp, Triticum aestivum
  unsure (1)..(454): unsure at all n locations
  Clone ID: PAT_TA_96548
ttttttttttttttttttttttttnaattttttttttttttctctaaacatcaccatgcttcaccgcgtacttcaatcaaacgagttcctgtaatttttatacataaaatcctcaaacacaaaattcacggtatgcactgcatgtgcagatacnccaaactgtatttgctaaacacatgtctaggcgtgaactgcattcaaatgagtccgtatttttacacacaaacgcaacatttttgcactgcatgttcctgtgctccaaactgcatgcacgacatgaaccacaccatgtattgccccgaataacatggcagcggcgccncactaaaaccngggntcctgaccgacgccaaaaacaacccccatgggatgaaaccatgggatcttgnccnnaattagaggannggagggagaanctncccccagcccaactgcccgnctnngccatnttcnn

SEQ ID NO: 96549 - DNA, 444 bp, Triticum aestivum
  unsure (1)..(444): unsure at all n locations
  Clone ID: PAT_TA_96549
gtaccattcaacgggccagataatagaaacaacgagttacaaaggcgtagagaaaatgtagtccctagcactggaaggccacagcaaagattggttatgaaaaactggtccccttacaatgatgtttccaacaacaagcagtacaactatgttcaggactcatttgcacgtagaaatgttggtgataatgttgtatcatcgccgcaggtgccacgatctgctgcaaataatattaatcttaatattggagcacgcaatgatggatcacatgcantgtcagctcacaataatgacagttttatggctggttcctctgccatgaanatgccttctgtagctgagnattgggaangctgctgaaattgnctatgncgtggtgattttgagcaaaggtcctacaaggnttcttagacctgggngggatttaaccaccattttgggaat

SEQ ID NO: 96550 - DNA, 232 bp, Triticum aestivum
  Clone ID: PAT_TA_96550
cagggcgtctgagattgctattaatttgcaccctgtgttctacaaggattctgtgaggtcatatgaatgggaggatacatacaccttgccgtttcatatgtttagcagtcaaggggcatcttacattgagtcactccagctcacctttgcatcgttgaagctgcccggcgatttcgatggccctttgaaccttagagtgctggatctccagactgttcatgtgtcggaagga

SEQ ID NO: 96551 - DNA, 363 bp, Triticum aestivum
  unsure (1)..(363): unsure at all n locations
  Clone ID: PAT_TA_96551
ccaccgttctccagtcgatcacgcacgctctcctcgccgccgagatgttcgggttcgggcaccaccacaaggaccaggcgccgccggcgtcgggccccaaccagatcttcaagatctactgccgcgcctccgaggactactgcctcgccgtccgcgacggcgaggtggtgctcgcccccgtcaaccccaaggacgagacccagcactggctcaaggacatgcgcttcagcaccaccgtcaaggacgaggagggcatgccgggcttcgcgctcgtcaacaagggccaaccgggcctcgcccgtcaagnaactccatcggccaagtcccancccccttgaaagcttggttgccgttcaaccccgg

SEQ ID NO: 96552 - DNA, 172 bp, Triticum aestivum
  unsure (1)..(172): unsure at all n locations
  Clone ID: PAT_TA_96552
ccccactccactcancggtgncgccgccgcacaaagtccatncntagatccagcgcccgatccgcggccatggtgatgngncgggccctctcctcgctcctctgctcggcctcccagcgcgtgcgtggnctccccgtcgccnctcgccccgcncgcggtnccctcccagcgc

SEQ ID NO: 96553 - DNA, 473 bp, Triticum aestivum
  unsure (1)..(473): unsure at all n locations
  Clone ID: PAT_TA_96553
atcctctccatggccaacgccgggcccaacaccaacggntcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccagctctagatccgcccgcccgccggtcgccgtcgtcgtcatcgcccccgtgtgtcccgtgtcgtgtcgtcgatctaaattagangagtccgtgtgttcntgtctttccccctgggtccgttcccgatgannatctcccgtngnctgggtttagggaaggggtttttagggtnggcctcttttgggcccgcctgggatnntgcntccgggngggncctttggnttanncttccctggngnctgcntgganatccttaacgtttngaattgacaat

SEQ ID NO: 96554 - DNA, 324 bp, Triticum aestivum
  unsure (1)..(324): unsure at all n locations
  Clone ID: PAT_TA_96554
tgananataacatgccaaaaattaaaaattatgccacctactgggccaccacggcctgaatactattagaaacccatccatgggccaggattcaggcccgcagaaggcccagtaggnccacaggcatgtncagagaggttaggcccgtaagcctgctttanagaggagctcgacagntcaggcgcaccgcaccttataaacaggtgcggctctctctcagctangcgaggtggggactanactcactaccacgccgctgtgtaaagccattggtcccgggttggtggtacnaaccgggaccaanttcccacccctttggtncgg

SEQ ID NO: 96555 - DNA, 418 bp, Triticum aestivum
  unsure (1)..(418): unsure at all n locations
  Clone ID: PAT_TA_96555
atccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtccngcaagagcggcaagccactgcactacaagggcaagctcgttccaccgccgtgatncccgacttcatgttgccagggcgggcgacttcaccaagggcaacgggaaccgggcgggcggagttccaatctnncgggcnaagaaanttcgcccgancnaagaaagttccgtcccanaaagccanaccnaancccccgggatncctcctccatggg

SEQ ID NO: 96556 - DNA, 444 bp, Triticum aestivum
  unsure (1)..(444): unsure at all n locations
  Clone ID: PAT_TA_96556
gagcacgccctccttgctttcactcttggagtgaagcagatgatctgctgctgcaacaagatggacgccaccactcccaagtactcaaaggcccgttacgaggaaattgtcaaggaagtctcatcgtacctgaagaaggttggctacaaccctgagaaggttccctttgttcccatctctgggtttgagggtgacaacatgattgagaggtccaccaaccttgactggtacaagggccctacccttcttgaggctcttggacaagatnaatganccccaaagagggcctcaaagacaaagccccctggnntcttccccttnanggatggttaacnagganttgggggcanttgggaatngtgnctngttggncccccnttanaaatgggnggcnncaaaaccnggggaaagggntgntancctttgggnccccanattgggcct

SEQ ID NO: 96557 - DNA, 257 bp, Triticum aestivum
  unsure (1)..(257): unsure at all n locations
  Clone ID: PAT_TA_96557
cgcccacgacattattaaccctttattacaagcttgattctgtctgtggcagctccaattccaaccgtgtgtgtgtgtgtcttcttcttggccaactatatatcttaagcttggacatgccaagtttgtgttggcctcatccgtttctaagtactgaagaaccattcgtgcttgatccgtttgttccagttattaaactcatgaactgtggcctgagacctaatccagtttgctaacanaattcagaanaaaaaaaa

SEQ ID NO: 96558 - DNA, 463 bp, Triticum aestivum
  unsure (1)..(463): unsure at all n locations
  Clone ID: PAT_TA_96558
atcgccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgangaaggaaagccgcnnnagatgaacaagaggtctttcaaagtattgcctgggtgcttgacaagctcaaggctgagcntgagaagggtatcaacattnatattgctcctgtggaaattcngagaccaacaaagttactcctggcaacnggtcaatttgaatccnccnggggcanccggngaanttcaatcaaagaaacaattgatcaaccgggggaccctcccaaaggctgaattggtgctgntgcttaataac

SEQ ID NO: 96559 - DNA, 314 bp, Triticum aestivum
  unsure (1)..(314): unsure at all n locations
  Clone ID: PAT_TA_96559
cccacccccgcaagcgaggatgcaccgaaaccctcgcgtcctcctccgcgccgccgcctanctcctccgcccctccaccgccgccccgcaacncctaacgancgccanncctcccctgccactttctccgnggggcctcatcntccctgcacaangccgcgncttctcgacggactacngnaaggacgtcnacgaggtgaacnngcaagttcnccgangcgcgggaggagatcgaggctgccatggacagaaaanggagacggtgtacttcaacganggaggccgcctgcnctntangacnccggccggagagg

SEQ ID NO: 96560 - DNA, 341 bp, Triticum aestivum
  unsure (1)..(341): unsure at all n locations
  Clone ID: PAT_TA_96560
gctcccagatcttcagcgagggcggcctcgactacctcggcaaccccagcctcgtcnacgcgcagagcatccttgccatctgggcctgccaggtcgtgctcatgggcgccgtcgagggctaccgcgtcgccggcggcccgctcggcgagatcgtcgacccgctctaccccggnggcagcttcgatcccctgggcctcgccgatgacccccgaggcattcttggttgctcanggtganggtgatnaatnaactggnccnnctcagcnaagtnttcnccatgcttcnggctttnttcccggcaggccaagtcngncagtcgncgngngcgcgncgcccttcag

SEQ ID NO: 96561 - DNA, 460 bp, Triticum aestivum
  unsure (1)..(460): unsure at all n locations
  Clone ID: PAT_TA_96561
gcgcctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgangaccttcgccaaannaaccggggaagcttggnnggtggatccaactngccnggtggggccaatgcttcgggcggcgcttcngggttgcgntctttccgggangcnngctccgncccggaaangggcgntcaangttt

SEQ ID NO: 96562 - DNA, 468 bp, Triticum aestivum
  unsure (1)..(468): unsure at all n locations
  Clone ID: PAT_TA_96562
gggatgcggctcatgctaccagatacggtgcgtgtcggcgggccacccggcgtgctccggcgtgccggagacggtgatcatcacggacatgaactactacccggtgtcccgcttccacttcgacctcagcggcaccgccttcggcgccatggccaaggacggccgcaacgacgagctccgccacgccggcatcatcgacatgcagttcaggagggtgccgtgccagtacccggggctcacggtcacgttccacgtgcagcacggctccaacccctactaacctggccatcctgggtggagtacganaacggngacgggcgaacntggnccaagtgggacaataatgcaaatcaacgggccgggacgtcnccccgganaaaagnggggattgncncccnacccgggggaanttggtggcccattacccangtcctggggggtcccanttngggnggggtnggcacccgg

SEQ ID NO: 96563 - DNA, 461 bp, Triticum aestivum
  unsure (1)..(461): unsure at all n locations
  Clone ID: PAT_TA_96563
ggcagcacctgatgagcgtgctccgccgcgctctcctgctcggccaccgcctccgccgaggcttgtcctcgggtgcggacctgcctccgccgcgcccatctgccagccgccgcgtggtcgtgacggggctgggcgccgtcacgccgctcggccgcggcgtcgggtccacctgggaccgcctcgtggccggagactgcgcggtgcgcgcgctcgccgcggaggacctgcgtctctccggggatgccgcggagaggacgttgggacagctcccatccagggtcgccggccgccgtgccgcgcggggaagggcgaggcccgatttcgacgaaggaggcgtggaccaagggacaagtanatntatatcggggtttatagcaanatggctctattttgcancttattgaaggttttgagaagaatgnaaaatttgggctngcctcggaaaaattannaanaagggn

SEQ ID NO: 96564 - DNA, 166 bp, Triticum aestivum
  unsure (1)..(166): unsure at all n locations
  Clone ID: PAT_TA_96564
gtcgggagccgcaaccaaccttnccggatcaaccgtcccnntctatggnggggganacnaaaangngctcggngtntnccgcggggccaccnantacgaactcaaaaaaggctaccgccgcctcgtcatgaantaacaacccggcaaaaaaccctncccgnaaagg

SEQ ID NO: 96565 - DNA, 399 bp, Triticum aestivum
  unsure (1)..(399): unsure at all n locations
  Clone ID: PAT_TA_96565
tctctctctctctctctctctctctctctctctctctctctctctctctctctctctctctctctctttcctttcttctcccctcctcntcggattgtntcncttcnctccctctgattcnattccatcggngcctggggaggcgatggttgtntnaagatcttgnnaggactgcctcgctccncanggaggcnanggcnagaccgancggacgacncgcggncagccctgaattgaatcancgntnagggccngcctttgccattggctaccagctnaaagtctgcgaaggccaantcgcacctcatcatncggcggaggagntggngngcggtngcaatactcgncttncatatcnacntgggaggtcggnaaggtcttctncntggccnccatcag

SEQ ID NO: 96566 - DNA, 232 bp, Triticum aestivum
  unsure (1)..(232): unsure at all n locations
  Clone ID: PAT_TA_96566
gctgttaatgggtcacagtgngaaacttgctctgtcgtttggattgctgannctnggatctagatncacaattccaatagnagnaaatctaaggatctgcgaggattgccattggtttatgcggcttgcctcaagagttgagcaggctgagattatagtcnggganaatatgagattccaccatttcaaagatggagaatgctcatgtggtggattcnggngaaagaaaaaa

SEQ ID NO: 96567 - DNA, 464 bp, Triticum aestivum
  unsure (1)..(464): unsure at all n locations
  Clone ID: PAT_TA_96567
aagccagcggcactcacactacanncatccactcacaagctaatctagcggngtngctcacttcattccagtcggcatggnggctccgaggggcgcggcactggtgctggcgatggtgctcgcggngatgctggtggcgccgccggcnacngtncacgccatatcctgctccacggtgtncagcacgctgatgccgtgnctgcattacgtgcagcagggcgggtcgccggcccggggctgctgcaccggcatccagnacctgctggccgatgccaacaacagccccgacngncgcaccatctgngggntgccgngaagaacgtcgccggngggcgcctccggggngggccctagatcacccgccgccggccggggcnnggcctnccnaagttgcanggtnggcccgnncccctancaaggatnaagcncccnagcgtccaactgcaancntcggattcaactga

SEQ ID NO: 96568 - DNA, 373 bp, Triticum aestivum
  unsure (1)..(373): unsure at all n locations
  Clone ID: PAT_TA_96568
gctcaccgggacttgcacgctgcctttataatccgctctcgctnccgaaccctagctcctcttgcctttctgcccgcccacccgtctcctcgcctcgccgtctcgccccacgccgccnccgcaaagatgccgttcangnggttcgtcgngatccggcgcgtggccctggtgaactacngcaaggactacggccgcctcgtcgtcatcgtcgacgtcgtcnaccanagcngggggacttgtggatgctcctgatgnggtcaggtgccaggtaaacttcaancctctttcggntgggggggacatcangattggacatcaaaggggntccctgggggagggcaggcttttgatcaaagggccaatggggnggaag

SEQ ID NO: 96569 - DNA, 369 bp, Triticum aestivum
  unsure (1)..(369): unsure at all n locations
  Clone ID: PAT_TA_96569
ccaccctctacctgccagccaggcctagggttttgagtccgcccccctccgncgcgcaccatgggccccgacnatctcnccanggccgccgccgccgaggaggccgccccgttctccttcagcatctggccaccgactcaccggacgcgggacgccgtggtncggccctggtggagaccctggncggcgacacgctcctctgcaaacgctacggcccccgtgccgggccgcccgangccganncccgccngnggcgcggnatcgaatgnccaagggccttccgacgcccgccggccgtctacncgggnnggtgccctccgccctncggtgcganggaggtgcaaccgaggggnggttgcaatcttctta

SEQ ID NO: 96570 - DNA, 403 bp, Triticum aestivum
  unsure (1)..(403): unsure at all n locations
  Clone ID: PAT_TA_96570
nctccctccccancctaccggngcatctccgacgacatggcccgcaccaagcagacggcaaggaagtccaccgncggnaaggcgccgaggaagcagctggccancaangccgcccgcangtccgccccggccaccggcggggtcaagaagncccaccgcttccgccccggcanngtcgcgctccgggagatccgcaggtaccagaanagcagcgagctgctcatccgcaaagctccccttccagcgcctccgtccgngagatcgcccaggacttcaaagacccgacctccgnntccangtcctccgcccgttctccgcgcttgcanggaggccggcgaagggcctanctcggcgggggttcntttgagggacaaacaaacctnttggggcngtcnaacgccca

SEQ ID NO: 96571 - DNA, 267 bp, Triticum aestivum
  unsure (1)..(267): unsure at all n locations
  Clone ID: PAT_TA_96571
gaaccatcaaacaattcaaaacaatttttattgctcagccacacgagcgatgagatttacactctgaaatctccacaagtgtgtcagtcaccgttgaaatgattcgctttacttgcatttccatctcaaaaattcacactacatcgtgccttttcttattgataattaaaacaagggcaggggccancgttcgcatcaaatctggtcctgaccaggggtgaggcgtctggcatcagcaagcaagatgacaaggaaaaaaaaaaaaaa

SEQ ID NO: 96572 - DNA, 491 bp, Triticum aestivum
  unsure (1)..(491): unsure at all n locations
  Clone ID: PAT_TA_96572
ttcccattcctcgccgccgccgccgcttcgtacccgctcgaagccgacccgaccatggnggncgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaagaggaagcccatggcgctcgtcaagaagctgcgcaaggcgaaaaacgacgctcctggntggtgaagaagcccggaggccanttgagggacacatcttcgnnacatgatcaattgtgcgcgtgaagattaattgggcaaaccttatcggggngnctanaatggggaangacccttcaaacaaagtttgagattnagccctgaagattaatntggnccattangctttgcaaagttcctctatctnctanaaaccagtnaaac

SEQ ID NO: 96573 - DNA, 474 bp, Triticum aestivum
  unsure (1)..(474): unsure at all n locations
  Clone ID: PAT_TA_96573
ccccacccgccgtcgactccagcctagccgcgtcgtcccctcccccttcccagcccccgcccccgcccgacagatctcctcngnagtccccaccggaggcctcccccgcgcgcgccggcaggcggaagcaagcaggngantgcggcgatggcgtcgtngcaggcgaatctggngnggntgcagctccgccagagctaccgcancctctgggcanaccgacctccccagngncatccaaggccgacttcccgtantgctgcctgtcnctctggtgtgcnccatgcgtatcananatgcttcgtanaagggctctctacaantganatgtcaaggtatnacgttcctgttgntggngtatattccaatgttgntgggcaagggtgttgggtggaaancaangtnggccngggattctggtccttggaaggnggagggtggtttctggngctnttgggnancttnaatttgnttcnc

SEQ ID NO: 96574 - DNA, 487 bp, Triticum aestivum
  unsure (1)..(487): unsure at all n locations
  Clone ID: PAT_TA_96574
accgccgcccacgcatctcgagtagtttccagctcgccggagacgcagcaagcaagaagatggccggaaggaagggcggcgacaggaagaaggcggtgacccgctccgtgaaggccgggctccagttccccgtcggccgcatcgggcgctacctcaagaagggccgctacgcccagcgcgtcggctccggcgcccccgtctacctcgccgccgtcctcgagtacctcgccgccgaggtgntggagcttgccggcaacgcgggcanaggacaacagggaaggaccccgcatcatcccggcgncacntgctgctcnctgtccgcaaangagcaagnngctccgggaagcttgctcgcttggccntcacatcncccaagggtgggggtgattcccaacatnaactcnggngcnggctcccccnaagaaagnccccccgggcnggcngccggaaaaanggagggnaagggccgcccaaaaaaggaanaanc

SEQ ID NO: 96575 - DNA, 468 bp, Triticum aestivum
  unsure (1)..(468): unsure at all n locations
  Clone ID: PAT_TA_96575
gatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatgggaaaagaaagcttgaggatatcgttccttcatcccacaactgtgacgtcccccaatgttgaccgccaagattatcaagctgaattgacataactnntgattggataatgtcaagcctttctnaactngagnagtnggtaaaaaactaaaggggatgaccctgaaagnntcccaaatntan

SEQ ID NO: 96576 - DNA, 213 bp, Triticum aestivum
  unsure (1)..(213): unsure at all n locations
  Clone ID: PAT_TA_96576
gncaagcccaanngccaccgncgctcaggcncagnccgcatggaccccaccgancagtcgccggnggaggtgtactccgtgtgggccctcccgccggngcccgtccgcgancgcctccgcggcctcatggtcggcctccgcnccgcgcacggtggcccgcccttcnatccgcatgccaccgtcgtcggtgncgtgcgcatgcgncggccccgc

SEQ ID NO: 96577 - DNA, 161 bp, Triticum aestivum
  unsure (1)..(161): unsure at all n locations
  Clone ID: PAT_TA_96577
gntcntcgtccccccctcncagctccgnttcctcgcancatttacggactttgccggcgtgngtctggtnggctcgatcgtgngagagcagaggcttacgtcttggtttntccgttaagggaggagctangntgtggggtggggtgnacctacgtcgggga

SEQ ID NO: 96578 - DNA, 227 bp, Triticum aestivum
  unsure (1)..(227): unsure at all n locations
  Clone ID: PAT_TA_96578
gaagctcttgctatccaatttgacggccggggaggatctcatctgcagatctgtgagttatgaagattgaaagagggaagtttctatcaatttcatctccaattcgaataggggcatcatttactggcaaggaaaagtttgggggcattaattcangagttattagcattgggtttgagggtggattttgagaaatgggatcaatatttctatgggtggggangaaa

SEQ ID NO: 96579 - DNA, 363 bp, Triticum aestivum
  unsure (1)..(363): unsure at all n locations
  Clone ID: PAT_TA_96579
cgacgatgtcgggccgtggcaagggatggaaggggatctgcaanggcggngccaacctccaccngaaggtgctccggnacancatccagggcatcaccaagccggcnatccgccntctggctcgcaggggcggngttgaancgcatctcggggctcatctacnangagacccggggcggtgctcaagatcttcctcgagaacgtcatccgcgacgccgtcacctacaccgancacgcccgccgcangaccgtcaccgccatggtacgttcgtctacgccctcaaagcgnccatgnacncacccttctaacgnntttccngcggnctaaggcaacgcccgggtccatcattaacccnacctccg

SEQ ID NO: 96580 - DNA, 448 bp, Triticum aestivum
  unsure (1)..(448): unsure at all n locations
  Clone ID: PAT_TA_96580
gttccctccgctgtgatgtgaatgtatctgtccggcctattggacaatcagaattcagtacaaaggttgaaataaagaatatgaactcattttctgaaataagtagggcaatanatnatgagatagcccnacagattcttcttcacaanaaaagccaggctgacaaaattgtacaggaaacccgtctatgggatgaatcttctcagaaaacttttacaatgcggaaaaaggagggacttgccgactacagatattttcctgagcctgatcttcctgaagttgttctgactaagtgattacattgatnaaattccgtaattcaatgccggagcttccanaggcaaagcgtanggcttatgaaaacatggggctcaacaaggaagatgttattttccttggcaacgaccattttgttgctcaattctttggttccacacttgagcaaggg

SEQ ID NO: 96581 - DNA, 397 bp, Triticum aestivum
  unsure (1)..(397): unsure at all n locations
  Clone ID: PAT_TA_96581
tatagggagggacttatgtcaccacaancagannctaaagcaggtgttggatttaaagctggtgttaaagattataaattgacttactacaccccagagtatgaaactaaggatactgatatcttggcagcattccgagtaagtcctcancctggggttccgcccgnngaagcaggggctgcagtanctgccnaatcttctacnggtacatggacanctgtttggactgatggacttaccagtcttgatcgttacaanggacgattctatcacatcgngnctgttgctggggaagacagncaatggatcngttatgtggnttatccattaganctatttnaangaggggttcccgttnctaacaatgtttacttccattgtggggnacgtatttggt

SEQ ID NO: 96582 - DNA, 417 bp, Triticum aestivum
  unsure (1)..(417): unsure at all n locations
  Clone ID: PAT_TA_96582
gagctcccttgtgtccgcccgcgcccgccgaantcaaggagagcacatcacctacaaccaagcctggcttgaatcctagccatgtngctgatcgcatcatcaacaccgagcatagagctgcttctcgggaggatccagtggccttctcggatgaccctttcttcgatgcgatcctatcatatcccaccatcaanaccaacnacacacctgtttctcgggaggatccngtgggccttctcggacnatcnnttcctggncgtgatgcgnggnaggngccgttacatctatacncgngggaggagagccgcttcccagggaaggacctnnacgcgggncntccaagcgaacangcccttttcttgggggggttgattccaanaaccgnggtgngggnctccaacaataaggngcgggagg

SEQ ID NO: 96583 - DNA, 464 bp, Triticum aestivum
  unsure (1)..(464): unsure at all n locations
  Clone ID: PAT_TA_96583
ccgaccgccgccgccgccgccgcctcctcctctcggttccctctccttccttcgagagcttcagccatgggtaaggagaagactcacatcaacatcgtggtcattggccacgtcgactctggcaagtcgacgaccactggccacctgatctataagcttggaggcattgacaagcgtgtgatcgagaggttcgagaaggaagccgctgaaatgaacaagaggtctttcaagtacgcctgggtgcttgacaagctcaaggccgagcgtgagaggggtatcaacatcgatattgccctctggaaagttcgaagaccaacaagtnataactggcaaccgtcattnatnncccctgggtcaacggtngacttcaatcaaagaaacaatgatnaaccggttcctcccaaagcttgactgtngctnttntcaancaacnactccaacaactgggtggttttggnggtggg

SEQ ID NO: 96584 - DNA, 212 bp, Triticum aestivum
  unsure (1)..(212): unsure at all n locations
  Clone ID: PAT_TA_96584
anagtctatggggatcagtcttaaggatgcccgtgtggaagttgaaaagattattggaagaggcagtgggttcgttgccgttgaaattccatttacacctcgtgcaaagcgtgtactcgaactgtcacttgaagaagctcgccagctagggcataactatataggatctgagcacttactcttagggctacttcgtgagggtgaaggtgttg

SEQ ID NO: 96585 - DNA, 380 bp, Triticum aestivum
  unsure (1)..(380): unsure at all n locations
  Clone ID: PAT_TA_96585
aaataagacgaagaggatcgaggagccgtcggcgagaacaagacctgcgagcggaataatcctctccgatggcggcagcgcttcgttctgcggcgaggaaaatctgcggtcacgcctttgagcgaccgcaggcgcttctcaggacggccgcttcagctgccatcaaggaggagcgggggcggctgctgccagggattagccatggccgaagctcactccgccagttcacctcctccgaatcaccgagtgttcttaataataagaacaagggttgtagatatttttctcaaaagaggaatgaatgggcttatgaaacaaaaagcttcctccaatcatcctggtttttanattgggtntcaaccngagcaatcattnaagtc

SEQ ID NO: 96586 - DNA, 457 bp, Triticum aestivum
  unsure (1)..(457): unsure at all n locations
  Clone ID: PAT_TA_96586
ccaccatcccctcgtctccaggttgtggccgactctgaaacgacgcccccaaggaggaagaagacgtgaaggcgccttcatcgcccgatcccacggatctgagatttttctccaaagccaagaccatggtgagagtgaaagagcaccccacaacaacgacgctttcaagaaagagtgtgacacccgcacgcgtcaacatcnccggattcggagaggccggaaactagatttcttccggngatgctnaaccaccacctgctcgtaccttgcacagccaacaatcaacatccttcttggttgaggncaaaccccganactggaacaatggggattccaatgattcaacatggtccaagacgcgcgccaaccccccaanccgaantcgntttgcaacggagntccgggggggcgggcaaccccgggggncctncaacaaggccggcaggcaagtttcggg

SEQ ID NO: 96587 - DNA, 462 bp, Triticum aestivum
  unsure (1)..(462): unsure at all n locations
  Clone ID: PAT_TA_96587
aaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggngagaagttcgccgacgaagaagtttgtccaaaagcaaaccaagcccgggatnctctccatggncaacgccggggccaacaacaacggntcccantttntcaactgnaaccgtcccctgcaattgggtcga

SEQ ID NO: 96588 - DNA, 462 bp, Triticum aestivum
  unsure (1)..(462): unsure at all n locations
  Clone ID: PAT_TA_96588
aagcagttcatctcctcaaccctgagcccgccgcgcccgcctgcccgccccgatggcccgcacgaagcagacggcgaggaagtccaccggcggcaaggcgccgcggaagcagctggcgaccaaggcggcgcgcaagtccgccccggccaccggcggcgtgaagaagccgcaccgcttccgccccggcaccgtcgcgctccgcgagatccgcaagtaccaagaagagcacggagctgctcatccgcaagctgcccttccagcgcctggtgcgggagatcgcgcaggacttcaagaccgacctccgcttccagagctccgccggtgtccgcgctccaagagggccgccgaggcctacctcgtggggctgttcgaaggacaacaaactctgcgccaatccaacgccaaagcgcgttancaatcaatgccccaaaggacatncaagctncgncccgncgcaancgt

SEQ ID NO: 96589 - DNA, 469 bp, Triticum aestivum
  unsure (1)..(469): unsure at all n locations
  Clone ID: PAT_TA_96589
ctgccttcgatccccaccaccagccagcgccgatgccgcggcgagcgatcgaggtccgggccgacggcgccgcgcccaagtggtgcatgtcgctgctggagaacaccttcacggcgttcctcaagtcccccggcgccgacgccgacgccaaggccgtgttcgcggagggctccctgttcagcccctacctgttcggcaagttcttcgacccggctgatgcgttcccgatgtgggagtttgagtccgacgtgctgctcgccgcgctccgccgcggcgcccggacaaccgtcgactgggccgagaacgactgcgagtactgcctcaagagcccaacataacaaggtggaaagaaaagttgcgaacntggnaggttaacgggcgaacggncgcnaaagggtggtgggacgttnaacngggctnatggngggcccccgcccggggggacnggnccggggaatggcncgccggg

SEQ ID NO: 96590 - DNA, 480 bp, Triticum aestivum
  unsure (1)..(480): unsure at all n locations
  Clone ID: PAT_TA_96590
ctcccgcatcccaccagcagccagcgaggaagcagctcccacatccgaccagcgacgcttggattggatccatggacgccccgcaaaagaaggctagatccatggacaaggacggcaagatgcctccgctgcctctgactgtgggcaagaagaagacggcgtctccgtgcccggatactgtccggctggtcagccagtggacactctccaccgcctgcttcttcctcgtcgtctttgcagtaacccagactctcgaccactaccacgtccccgttccctgcagcccgtcctcgctcgttctgcggtgcgtcgagctnacggnccgcgggggcccgttgagggaaccaacgcccgcccgcggaaaagcgccgggtgggnttngggatgnctgtggttgcggnaacgggcaacaagccggcccgccggcggnnccttggcnctgcatcccccaatgncggctnncgccngggtccgnccncc

SEQ ID NO: 96591 - DNA, 476 bp, Triticum aestivum
  unsure (1)..(476): unsure at all n locations
  Clone ID: PAT_TA_96591
agacaggtctacctcaccggagagaaaagaagagaagcgaagatgtcggggcgcggcaagggaggcaagggtctgggcaagggcggcgccaagcgccaccggaaggtcctccgggacaacatccagggcatcaccaagccggcgatccgtcgtctggcgcgtcgtggcggcgtgaagcgcatctcggggctcatctacgaggagacccgcggcgtgctcaagatcttcctcgagaacgtcatccgcgacgccgtcacctacaccgaagcacgcccgcccgcaagaccgtcaccgccattggacgtcgtctacgcactcaancgccagggacgcaccctctacgggtttcggaggctaggccaaccaccaccaagattaagaggggtctgggggttcgtggtccgtttgattgttatttgcaagcnatnctccgcgggggggggccccgggtacccaaaattccgcccctattagtt

SEQ ID NO: 96592 - DNA, 296 bp, Triticum aestivum
  unsure (1)..(296): unsure at all n locations
  Clone ID: PAT_TA_96592
tctctctctctctctctctctctctctctctctctctctctctctctctctctctctctctctctctctctctctctctctntctctctctctctctctctctctctctctctctctctctcnggancctcagctcntcaanaagctcntgccgttnancaagaagaacccattcttcaagaanttccnncctgcnaaggagganancangccatagaggattggtgtganttgatntnctttgngtntttnagtatgncatggcngtattgatccctgcangtttttttttttct

SEQ ID NO: 96593 - DNA, 252 bp, Triticum aestivum
  unsure (1)..(252): unsure at all n locations
  Clone ID: PAT_TA_96593
ctcgcaggcgcgatggtgtacatcaagaaccagaagncacgggcgtaccccaagcgtttccangtcaagtttaaaganaanggngccaggggaangaccgactaaaagggccaaggctggaggctcacaaaccangnccaaggtacnaatttncattaccccccaagntancgtttttgttnntgccgaatttaaccaacaaanggnttttcactnncaanaaattggnntatgcttaccanattgctgggg

SEQ ID NO: 96594 - DNA, 471 bp, Triticum aestivum
  unsure (1)..(471): unsure at all n locations
  Clone ID: PAT_TA_96594
cccctccccccaatcccactcgcgcagcagctccaagaggatcgtcggcgaccatgtccggccgcggcaagggaggcaaggggctcggcaagggcggcgcgaagcgccacaggaaggtgctgcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgcgacgccgtcacctacaccgaagcacgcacgccggaaagaccgtcaccgccatggacgtcgttgtacgccgctcaaagcgccaggggccggaaccctctaacgggttccggcggntaaggccgcttggccccccgccanaacgggtccgtcaagtcttccgtccgccaacctgcanatttcccgnttttgttantccggcccgtttcctnagtat

SEQ ID NO: 96595 - DNA, 442 bp, Triticum aestivum
  Clone ID: PAT_TA_96595
gcaagatctctcttccgtcctgctcctcctccagtcctctcctccagtgctctcctccggccagcgtgagcttgagagaggttggtacctgcaggtagccatggacggccaccgccgcgcgccgcgccagattctggtgctcgaggaggcgttcaagaaatgtccccaccccgaccagactcaggtcgcaaatctcagccgcgaaactggcatggaggtccatcagatccaatattggttccagactcggcgggcgcagatcaagggatcttcatcgaacacaaggcctccgaccaagggatcttcatcgccagatccgtgatgctcctctcattcgacaacttcaccttcattctttgacacaaggaggagcgtcatagtgatggaggctgatgttcgtcctcgctattgtggtctttctcggtttagtgtttgtgcgtgg

SEQ ID NO: 96596 - DNA, 253 bp, Triticum aestivum
  Clone ID: PAT_TA_96596
cataagctccataactggtcaacccctgggactccctatacaggtaaatcctttcaggcagccaattgaggagaacaatagtgcgctatacataccatgctactcgaatggttttgtttttggaatgtaaatagccattttagccccctttttatcaccagaaaatattcagaggttcagtcgtggaggtatgataatgtaacttctcctaataaatatagagaaagatgctatgaaatatgtttacatggaa

SEQ ID NO: 96597 - DNA, 462 bp, Triticum aestivum
  unsure (1)..(462): unsure at all n locations
  Clone ID: PAT_TA_96597
gcgggctgccccttcgtggagccggagttcgactgccagaagtacggccgccctgacaagctctacctcaagtaccggtggcgccccgcctcctgcgagctcccgaggttcgacgggcgggacttcctgagcagatggaaggggaagaaggtactgttcgtgggggactccatcagcctgaaccaatgggaagtcgctggtgtgcatgntgcacgcggncgcgccggcctccanggaccatctacaagcaggggcaaccccgtctccacccgtcacgtttcaaggactacngggtgtncggtggcgtactaccggagtacctaacttggtggagcatccgtccaaggaagttcattccgccggggtggctgaannntcgaatccatctccgggtgaacnccgtggnttcnggnaaccncaaaanngctcctccttcaacnacnttngggaatnggtggaccc

SEQ ID NO: 96598 - DNA, 454 bp, Triticum aestivum
  unsure (1)..(454): unsure at all n locations
  Clone ID: PAT_TA_96598
gcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccaagttcaccaccacccagcgtatcatcaccaagccgccgcatgcgctcgcggggcgcncgcgcctgaataaaataaaaccaccgtttcgtgttncgttattntgtatgccccnttcgcgtgtgtttccaacantnctgtcctttctcgtgcctncanttctaatngaatatattgggggcctcaantttnnat

SEQ ID NO: 96599 - DNA, 298 bp, Triticum aestivum
  unsure (1)..(298): unsure at all n locations
  Clone ID: PAT_TA_96599
gagagaactagtctcgagtttttttttttttttttttttttttttttttttttttttttttttttttttttttttttccanccncaaanggagattcaattattcgcagntcncaccagnccgtggctacaancgaaacagcagcacacaacgtgtaccacgctanactacttactaaaaanggncnccagccaaaancttatatanaangggnatcncatctcanctcacncanacagccnggatttcncttatttatgtanaccanccgtatctanctanaccnccnctgggggcn

SEQ ID NO: 96600 - DNA, 242 bp, Triticum aestivum
  unsure (1)..(242): unsure at all n locations
  Clone ID: PAT_TA_96600
ccctccctccctccgcccacggcatattcctccaaatctcgccaccaccccaccaacgccacctcaccggcgcatcgcatcgcatcgcatggcggctgcggcggtggcctccaacgggggcgggngcccgtgcccgggngcctcgtcgtcngtctacagnnnaggtgcattacnagtcgcattcgcgcacgcgctgnctctcccctcccgtcttccgntcccacttcattctcgcngacggg

SEQ ID NO: 96601 - DNA, 437 bp, Triticum aestivum
  unsure (1)..(437): unsure at all n locations
  Clone ID: PAT_TA_96601
cgccactctctccctccccccgatctggatcgagatcgggggcgcagacctggcgaccgcgccgccctgacgcccgccgttgtcgaccccgtcgcgtcgatgctcgcctcccggactcctcctcgccctcctctcctttgcgcaacacctgcctgaccgcgacctcgcctcatcgtcgaaccgacgccgtcgccagtcgtcatcgccaccccgtcgccgtcccgtcgtcgaccgcggccgcctcgagctccggcgcctccccgactcctcctcgcgcacactattgcacacctacagggtccggtgaggccccctcctcctttttccccatctcctttccctcatgtcgccgtaggtcgcccccgccgtcgcgcccgagctcccgaggagctcgtggttgccgcacctgtgacccgctgtcgcgcgctgggcaactn

SEQ ID NO: 96602 - DNA, 252 bp, Triticum aestivum
  unsure (1)..(252): unsure at all n locations
  Clone ID: PAT_TA_96602
ccttgctcgtcaccgccgctgcctgctgctccctctccaccaccgttgctgcttattgatcacaatatcccctctacctaattcagatcgggcgcaggttaggcgagcctgatggtgggttgggtgaggctanggggagagggaggaggccngcggcntggngaaggagttgacttgccctcatggnggnggcccatcggncangggcgtcatttgctcgtccngnnaccgtccgagctcgtctcancctca

SEQ ID NO: 96603 - DNA, 210 bp, Triticum aestivum
  Clone ID: PAT_TA_96603
tgattttggagcatctgaagttcataactgttttctgtgcaatatctgtgtgccgcgtctgagataccttaaatatcatatcgtgtttgttctgttggatgtttcagagatgcttatgcagagtttctttaaacattttggttcaaaaaaaaaaaaaaaaaaaaaaaaaaaaaaaaaaaaaaaaaaaaaaaaaaaaaaaaaaaaaaaaaa

SEQ ID NO: 96604 - DNA, 419 bp, Triticum aestivum
  unsure (1)..(419): unsure at all n locations
  Clone ID: PAT_TA_96604
gaccgttgggggaggtgatgatgctttcaacaccttcttcagcgagactggggctgggaagcacgtcccccgtgctgtcttcgtanatctcgagcccactgtgattgatgaggtgaggactggcgcttaccgccagctcttccaccccgagcagcttatcagtggcaaggaggatgcanccaacaacttcgcccgtggtcattacaccatttggcaaggagattgttgatctgtgccttgaccgtatcaggaagctttcagacaactgcactggtctccagggattccttgtcttcaatgctgttggaggtggaactggctctggccttgggttctcttctgctggagcccctctctgttgnacgatnggaaaagcnatccangcttngngtttacagtgntacccattcnaccccaag

SEQ ID NO: 96605 - DNA, 216 bp, Triticum aestivum
  unsure (1)..(216): unsure at all n locations
  Clone ID: PAT_TA_96605
tctgctgaggatcacgagtttgcacagtttcatgatgtcaaattactgcatatgtagtgcttcttgtcaacagggatagaattagctggtcataggttgtggatgttcttagttattttttgcacacaaggtgtttgggtgtttgtccgagcccgtttcagtcacagatccttgaggttaactcccacatgaatacatcatgagaataaaanaaaa

SEQ ID NO: 96606 - DNA, 446 bp, Triticum aestivum
  unsure (1)..(446): unsure at all n locations
  Clone ID: PAT_TA_96606
acgccctcggcggcggcggccgcatcaccatgcgcaaggccgcgcccaaggcctccgcctccaacagcccgtggtacggccccgaccgcgtgctctacctcggcccgctctccggcgagcccccgagctacctcagcggcgagttcccgggcgactacgggtgggacaccgcgggcctctccgccgacccggagaccttcgccaagaaccgcgagctcgaggtaatccactgccgctgggccatgctcggcgcgctcggctgcgtcttccccgagctgctngctcgcaacggcgtcaaattcggnnaagggaattctgggttcaanggcgggctcccangatnttcangcgaaggggcgggccttcgaataaccttcgggaannccnagccttgggttccacgctcaaaagcnatctttngccaatcnggggctttgccaaagttt

SEQ ID NO: 96607 - DNA, 286 bp, Triticum aestivum
  unsure (1)..(286): unsure at all n locations
  Clone ID: PAT_TA_96607
gcaantnctagcacaagtncatacgctcaccatatcacatgctcgcttgaaggttccnattcaatcgcatcactcaacaacantagggacgataatcgtcaggaaagaaagaaaaacctcaatttgtcctagtatcaaaaatctggcggngcgttgggcgccaatcgccngaattaatnatggttaggaagcnaagncctcttccccggcgaaatcgnacgnaataaagacgacttgggaanngaatnccccggggggaaattttnaagcnggtgccnacngttga

SEQ ID NO: 96608 - DNA, 273 bp, Triticum aestivum
  unsure (1)..(273): unsure at all n locations
  Clone ID: PAT_TA_96608
actagcttcagctagccagcctctgccactccgggcattttcttgcatccacgacggcaatggccaccgctgatgtccagaacccgacggccgcgcngacggaggaggcgcccacggtgganacgcccgtcgccgccgaggaggtcncgaanacggaggaggcccccgcnccggccgaggccgangtcaaggcgctctgctgcccccgtcgaangtctcatgannaccaaggcaggtggcacctgcccccgtttntacactgacgatgcnaaa

SEQ ID NO: 96609 - DNA, 382 bp, Triticum aestivum
  unsure (1)..(382): unsure at all n locations
  Clone ID: PAT_TA_96609
ccgcaaccctanagcctcgcctccctcctctcctctcccgggcgcctccaccccccgcccagcggcgcgaagcgaccatgacgttcaagcggaggaacggcgggcgcaacaagcatggccgcggccacgtcaagtacatccgctgctccaactgcgcnaagtgctgccccaaggacaaggctatcaagcgtttcttggtgaggaacatcgtggagcatgctgctgtgantagatgtgcangacgcttgtgttnnntgatggatntgtcngtcncnaagctntangncaaggtgcaccaactgtgtttcttgggccatcnatgcctcacattgtccgtggtcngctcccgtgagaaacagganggaacngtnaagcccccgga

SEQ ID NO: 96610 - DNA, 155 bp, Triticum aestivum
  unsure (1)..(155): unsure at all n locations
  Clone ID: PAT_TA_96610
ccaccttctcagccacacagagaaagagcgtccaagctccagctanctanccancaatgngccgccgcattgancctccgcncncccttctccgtgcncnccgtggcgccaccggtgccccncgtggccntggcgcccgnggccctcatcctcgc

SEQ ID NO: 96611 - DNA, 445 bp, Triticum aestivum
  unsure (1)..(445): unsure at all n locations
  Clone ID: PAT_TA_96611
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacnagccccnncatgtggccctgccgcgggatatgaaatccaccgtcgacggcacctgcggtggacccctgcaagnagtactggattngtttattcccggcatgnatatgttccggcctaaaaatanaattaaaaagctcaaggcgagaatgagcnncgttcatccgtggccctaatgcnntgtggttgtgttgg

SEQ ID NO: 96612 - DNA, 430 bp, Triticum aestivum
  unsure (1)..(430): unsure at all n locations
  Clone ID: PAT_TA_96612
ggattgaagaattatgtgatagcagagcctgacattcaggaaacgcaggtcaacagtgacctggaatacctggttctcgctacagatggtctttgggatgttgtgcaaaatgaggatgttatttcacttatgagagcaactgacgggcctgaggcagcggcggtgaagctgacggaaatggcccactcccggcacagctcagacaacatcacatgcattgtggtgcgatttcaccactgaacaatgtaggatacgtgacggagattgatggcangtgaagttttgtcacttgaaatatccgaaagaatatcttcctctgatctatggcaccaacaagacttcaacagctgtgaaagagactggccgattggttggttctttttgtagggaaattttttgcntccaataatcaataagtgggaatttgcng

SEQ ID NO: 96613 - DNA, 449 bp, Triticum aestivum
  unsure (1)..(449): unsure at all n locations
  Clone ID: PAT_TA_96613
caggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcaagtctatccttatgcaagcgtcatatcatgggttgatgggaaaggttcngcactgacaaagaactaccctgctggtttcatgggacatcaantttcattcccaaagaccgggtggaagaactacanggctttctgnnatgaaaacaanggggcccgctttccgncctttaattctgtccngggattnaagggat

SEQ ID NO: 96614 - DNA, 446 bp, Triticum aestivum
  unsure (1)..(446): unsure at all n locations
  Clone ID: PAT_TA_96614
ctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcaagcacggaggccctcctcaagcaggtcgactaccctgatccgctccaaatgggtgccttgcctcgagtttaacaaaggttgggtttatcttccgtnaacaaaacgcatcccctgggtaatacgaatggccgggttatggaacaatgttgaaacctgcctatgttcgggttgcaaccgacgccaacacaaggttattaacggaggtng

SEQ ID NO: 96615 - DNA, 421 bp, Triticum aestivum
  unsure (1)..(421): unsure at all n locations
  Clone ID: PAT_TA_96615
ctagctcgagctcgaggagctccctgacgcccatcgccaccatggccgccgcctcgagctatgcccgattccggcgatgccgtgcccctctccccgttcccccaccacctatgcgttccccgaggtccggcgcacctccccgtagccttgcccacccagttcccccaccggagcccctgttcgccggagtccgaagaccacctccgccgcgagccctgctgctccttctctcgtgctcctcgccggcaacagacaccaccaagggatgcgcctctcgctcctgagctcgtggatatgtcggccgtcgtctgaggcggccggagccgccggcaatcgccgtcgaggggggcgtctccctcgggcgaagcgcgcgtacgcncggggaggaaanaaagaaagcaaggccaagcggggcccancc

SEQ ID NO: 96616 - DNA, 458 bp, Triticum aestivum
  unsure (1)..(458): unsure at all n locations
  Clone ID: PAT_TA_96616
cctctaccccaggctttcagccgcagccaactctaccttgtttttacagtttttgagtttcaacatagaagactgcaactcttctacaaagaaaaagaaagcaggacatcaacccatacgcagcacatcctacatcaggcttcggaactacagccacactaccttacagcgacataactataacaacatctgcaccatcgttatttgtccatagtaccaactttattataatttcttactctgatttctatgttacctagggctggtattggataaaccctttccttggtattttgtttcaatttgtggcaatatggtactttaatttaattggttggttntgaaaatacngaatnagancaatgttctaaangntttgggggcctaaaaaaaagancaaagggtccggtgggtngaacaagccanccaatacataatntggtgggggtagatncccc

SEQ ID NO: 96617 - DNA, 400 bp, Triticum aestivum
  unsure (1)..(400): unsure at all n locations
  Clone ID: PAT_TA_96617
ccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcancaaggagtgctgctccggcgtgcagggggctgaacggcctggccccgcagcagccccggacgcaagataacgtngcaagttgcctcaaagaacctncccaacaagcatcaaagtccaanaaacatggggcaagggtcccccggccgttccccggcaa

SEQ ID NO: 96618 - DNA, 459 bp, Triticum aestivum
  unsure (1)..(459): unsure at all n locations
  Clone ID: PAT_TA_96618
agctcggggcggacgacaagaagaaggtggaggacgcgatcgagggcaccatcagctggctggacgccaaccagctcgccgaggccgacgagttcgaggacaagatgaaggagctggagggcatctgcaaccccatcatcgccaagatgtaccagggcgctgcgccggacatgggcggcggcatgggcatggacgaggacatgccggccggcggcggtggcgccggccccaaagatcgaggaggtggactaagcttttgttgttccgtgggtggtctccggtctgngcgttgcttgaatggggtgtcctttccgatgccgcccggtggtgtcaagtccgtctgtcgncctngtcaatcctaataanctggaagttagtnattagtangtggntcgtttgggagtcctttgggtcttgaaaggacattgaatgggatcatgaatgtttgccttgttgttt

SEQ ID NO: 96619 - DNA, 320 bp, Triticum aestivum
  Clone ID: PAT_TA_96619
aaggtcaaatcttagtgtacttgaatatatagatttgtctgattgtgttgtaatcttagtttccttttatatttttgtatgaacctactattatgtgtcattgtgttgtagtgttgaccatccgcagcaagggttaggcaaatatttatcctgtaaaatgagttaccggttcttaccacgtggttgttattttattttcaatttttatgcatcacatgatttttttaaagtgatcttaattcatggtccttagtttactgatcgttcggcggctctgtgtaccaatatagtggtgcataaaaattgaaaaaaaaaaaaaa

SEQ ID NO: 96620 - DNA, 435 bp, Triticum aestivum
  unsure (1)..(435): unsure at all n locations
  Clone ID: PAT_TA_96620
gctccctcaatcccactcgcgcagcagctccaagaggatcgtcagccatgtctgggcgcggcaagggaggcaaggggctcggcaagggcggcgccaagcgccaccggaaggttcttcgcgacaacatccagggcatcaccaagccggccatccggcgcctggcgaggaggggcggcgtgaagcgcatctccggcctcatctacgaggagacccgcggcgtgctcaagatcttcctcgagaacgtcatccgtgacgccgtcacctacacggagcacgcccgccgcaagaccgtcaccgccatggacgtcgtctaccgctcaagcgccanggccgcaccctcctanggcttcgggcggctaggccgccccaaatggtcgtcagtcctcgtccccgcctgcaaattccgctgttttantcccncccgttcccaatant

SEQ ID NO: 96621 - DNA, 476 bp, Triticum aestivum
  unsure (1)..(476): unsure at all n locations
  Clone ID: PAT_TA_96621
atcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcnaggcgcctgcccccgtcgaggttgaggagaccaagggaggaggcgccggcagcanttngaggcaaaaggagacaanggaccccgaancaagcagcttgccggnccgaaaccgggagggccganggcgnccccncntttggtccaagacaanagaaccaaaggaaggcccgttggctnaaaggcaaaaancccgncggcggncccgaaggaaggtnaaaggaaaaaggccggcgcctnnctgcccgaagggccgaacccnggccncttcccgctttg

SEQ ID NO: 96622 - DNA, 465 bp, Triticum aestivum
  unsure (1)..(465): unsure at all n locations
  Clone ID: PAT_TA_96622
cgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgaggatgaacaagaggtctttcaagtacgcctgggtgcttgacaagctgaaggccgagcgtgagaggggtatcaccattgatattgccctgtgggaagttcgaagaccaacaaagttactactggcccgtcattgatgcccctggncaacgttgacttcaacaaanaacaatgattactgggtacctcccaagntnnactggtgccngtgcncatcnattgaactcccaccantggngggtttttgaagggctggtatctccaaggggatgggccag

SEQ ID NO: 96623 - DNA, 336 bp, Triticum aestivum
  unsure (1)..(336): unsure at all n locations
  Clone ID: PAT_TA_96623
aggaggccaaggactacttcttcatctgcagctacggctactgctactccggcatgaagctcgccgtcaccgccaagaagggccccgcctcttcctcccccgactccggctcgtcctcctcctcctcgccggccgccaagtcatcctccaaatccgccgcctcccctctcgccgcccgcaacgccgcccccctcgccgccgccgtgggcgccgccgccatgctactcaggatgctctgatcagttgatctggctagcgattccgttctccgttaagtccaagtttgggctcagatcttgtcagattttctcttctctgttaanttatccccccccg

SEQ ID NO: 96624 - DNA, 436 bp, Triticum aestivum
  unsure (1)..(436): unsure at all n locations
  Clone ID: PAT_TA_96624
ccccgttcccccgcagtcccgtctgctggctgctccgcgagaccgcgaccgcgccgttccccctcggtctcggcggtgctccccggcctcggccgccgtgctgctgccgtcgatccctgcctccgctgcgccgccgaggccgaggaacgccgactcgcgcagctgctctgcgccccactgcttctcgccaacgcggcgacgtgccgcagccaggctgctgcttcgcttcgccccgggtgttgtcttccttcctttcactggtgggaggcatagatgaatcaaaccactgatttggaatattgttgtcctgtcctgaaagttatcttaaggaaaaggtgcctattaagttgagtttctgcattttcttcaagtgaccctattgttaccttaanaattacagttgggtggctccaatatgtctaatgcaccctaagtn

SEQ ID NO: 96625 - DNA, 451 bp, Triticum aestivum
  unsure (1)..(451): unsure at all n locations
  Clone ID: PAT_TA_96625
cttcctcttcttcccaatctcgcacacctctcggagctaggcggagcggcgatgtcggggcgcggcaagggcggcaaggggctgggcaagggcggcgccaagcgccaccggaaggtgctccgcgacaacatccagggcatcaccaagccggcgatccggaggctggccaggaggggcggcgtgaagcgcatctccggcctcatctacgaggagacacgcggcgtgctcaagatcttcctcgagaacgtcatccgcgacgccgtcacctacacagagcacgcccgccgcaaggaccgtcaccgccatggacgtcctctacgcgctcanagcgccagggccgcaccctctancggcttcggaaggctaaatnccgtgggttccgccggttgggcggtaagccggtaattngggaactgtgttctgtncctgttgtccnccggtgangtttttg

SEQ ID NO: 96626 - DNA, 282 bp, Triticum aestivum
  Clone ID: PAT_TA_96626
gccaagttcaacctcgagcatggcacccggacatctacggcatctcggagattgacggcttcaacttgctatgcggctcgccggcgtgatgcgtgtgcgttgtccggcgttgtacgtacgtgtgttgtgttggcatgttgatgcatgcatgcttgtgtacgtcgtcttgagccccgcccctaccgcaagcgcgacgagctccggtcatgagcgtcgccggcggtgtcttttttctgtaaaaaaagcttgggtctgtctaggacacattaagctgaaaaaaaa

SEQ ID NO: 96627 - DNA, 380 bp, Triticum aestivum
  unsure (1)..(380): unsure at all n locations
  Clone ID: PAT_TA_96627
gtttattattccccttcgcgcagccgcccccgtgtctcccgtgcgcaccttctcgaagcctcccccatggcggaccagctcaccgacgagcagatcgccgagttcaaggaggccttcagcctcttcgacaaggatggcgacggttgcatcaccaccaaggagcttggnaccgtgatgcggtccctcgggcanaaccccacggaggcggagctgcaggacatgatcaacgaggttgacgcggacggcaacggcaccatccgacttccccgagttcctgaacctgatggcgaagaaaatgaaagacaagggactccgganggaaggagctcaaggaaggncgtttcggcgtgtttcnaacaagggacanaaagggctttatc

SEQ ID NO: 96628 - DNA, 297 bp, Triticum aestivum
  unsure (1)..(297): unsure at all n locations
  Clone ID: PAT_TA_96628
ccagaaccagctaaaccataccatcttcggcttcctctccaccgcggccctccccccgcngcaagggaggcaaggggctcggcaagggcggcgccaancgccaccngaangttcttcgcgacaacatccaagggcatcnccaaggccggtcatccggcgcctgncgaggaggggcggtttnaaacccatctccnggctnatctaacgaaggagaaccnctggcgtnctcaaagattttccttcnaagaaanntcatcccgtnnacgccgttcaccataaanggatncaacnctcgcc

SEQ ID NO: 96629 - DNA, 421 bp, Triticum aestivum
  unsure (1)..(421): unsure at all n locations
  Clone ID: PAT_TA_96629
ccaaggcctagcccttcatcttcaacaacttctgcaagccttgaaacacgtgggctcctccgaggagtaacttcaccaactactaacttcctcacagcggtcttcttgattttcttcttaacagggacaaccgtgccatcactgccacacggcacgtcttcctcaacggtgagctcagccgcatgaacagatccaggaacatcagaacctttgtcaaggcgggccgccctcttcttgtcaaaatcttcttgcttcttcctcttatgttggtcctctaggagaaagctgaaagaggcacatcctccgggttgcctngacaggttnagttccnatcnaacanaactngcggactggtttctccaannttctngaaagnaaaaccacaananggattcnggaaccggggaatcaccaacctttt

SEQ ID NO: 96630 - DNA, 439 bp, Triticum aestivum
  unsure (1)..(439): unsure at all n locations
  Clone ID: PAT_TA_96630
aacaccttccggcggcgaagcaacccacccacccttctctccctcccgaagcagcgatggcccccaaggcggagaagaagccggcggcgaagaagcccgcggaggaggagcccgcggcggagaaggccgagaaggccccggcggcgaagaagcccaaggccgagaagcggctgccagccggcaagaccgcctccaaggagggcggcgagaagaagggcaagaanaagagcaagaagagcgtcgagacctacaaaatctacatcttcaaggtgctgaagcangttgcaccccgacatccggcatctcctccaagggcattnccaacatgaaactcctttatcaaacgacatcttccganaaagctcncccgggggagggccttcaaagctccgcccgcttacaaaaaagaaagcccaacnattcacctccccggggaaga

SEQ ID NO: 96631 - DNA, 309 bp, Triticum aestivum
  unsure (1)..(309): unsure at all n locations
  Clone ID: PAT_TA_96631
ttttttttttttttttggaaagtgaaccagtttcagaanaaaaccgcacgcatacagtgagaactacnaagaaccaattactacgcacatttgagtacattctttacatancaganctaacgagtacaccatcatgcacataatcatacatccatgganagtatanatgagagaactgagatacatgtacaantttncatcggtatctcaaagatcgccaccgtcggcggnggcggggcgccttnacngccacngtggagcancaggacaangncgtcccggactttggntgtanagggaccccnaaga

SEQ ID NO: 96632 - DNA, 450 bp, Triticum aestivum
  unsure (1)..(450): unsure at all n locations
  Clone ID: PAT_TA_96632
gcggatccggctgcaagtgcggcaacggctgcggagggtgcaagatgtaccctgagatggacgagggggtgaacaccacctccgagaccctcatcatgggcgtcgccccctccaagggcaccccgtccttcgaggccgccgccgagaccggggccgagaacggagggtgcaagtgcggccccaactgcacctgcaaccccgtgcacctgcaagtgattcatcaaatcgtggcaagganacngcaanggacggaccctnatgaaggagcactaagtagttgttaatgcaatggnttgtgccgtgtgtgtttcctttttaattgccaccggagaataanacgaagatnnatngtaccgttnctanttaatggcttaatgttgtggcccccttggtggcctntancgttgtnggtgtttaaaggcntcctcttgtgttngtgatgcccccttt

SEQ ID NO: 96633 - DNA, 483 bp, Triticum aestivum
  unsure (1)..(483): unsure at all n locations
  Clone ID: PAT_TA_96633
tcaccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgccgccgctggccaaggtgaccttccgccaccccgttcaggtacaaagcaccagaaggagctctttcgtcgccgccgagggtatgtacaccggccaagttcgtctaatggcgggncgccgcgcccangctctcccgtcngggaaangtccttcccgctccgcctccgtngctgaaggggaaggccgttcaatcttcaaaggtncnangcaaccaacgtncgggggaaccgtnggtngtttttcgccanggggcctccggggngacntacnccanaccgttt

SEQ ID NO: 96634 - DNA, 433 bp, Triticum aestivum
  unsure (1)..(433): unsure at all n locations
  Clone ID: PAT_TA_96634
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatnggttcaagccggcatgatatgttccgcctaaaataaaataaaagctcaangcgagatgaacagcgtcatcgtgcctatgcgtgtggtgttgggccaacan

SEQ ID NO: 96635 - DNA, 435 bp, Triticum aestivum
  Clone ID: PAT_TA_96635
gcgggcgcgtcggtgcagtctggtgggcgcgtcagtgcagtccgtccgggtagagcgtgcattgctcacgcgccacatcccccgccggttagccgcccctctgtccacctcctacgccgctggagtaacacagtcgtttttcttattcttcttcttccttttttggattttggatatgtagtacagtcggatccctcaggcagtgcgccacgcgccctcgttcggtacgctaatatctagttcatcgtagtccggccttgggcagcaagtgagcccctcccgtccacccgggctatggaggcgagctagatccggcgagatcctttcctctacggtccccggccgtccaacctcacgccccgacggcctcctgcaagcaacggatggggtcgacgccaacccgtccgcactggcattttgtaaaaaaaattcaag

SEQ ID NO: 96636 - DNA, 444 bp, Triticum aestivum
  unsure (1)..(444): unsure at all n locations
  Clone ID: PAT_TA_96636
tccagatcccaccacgcggccgccccattgtgcatcgccgccccccctctcttcccttgtgccccccgtccagcccgcgccatcagagtcctctcccctgtcgaatccggctagggattcagatctcccctgcgcgccgaagaagccggccgctgcgacgctcctcgcacgggcccaaccccctgaccatcttggcctcagtggccctccattcatcttccttcctcgatccaagcaggctgcggggccgtccttcccggtgagattccatgggctgcaagtcgtccctcccccaccaagaaggtcgggtattaaagcaaaaccgggggcggggaaggggttggggggaaanggttgcaaggtgggcttcctcttttaatccaactccccaagcaaaaagggnttccaantggagcaangggngnaatctccaaacggcaatcc

SEQ ID NO: 96637 - DNA, 423 bp, Triticum aestivum
  unsure (1)..(423): unsure at all n locations
  Clone ID: PAT_TA_96637
tatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctnatccgctccaagtgggtgccttgcctccagttcancaagggtgggtttatcttccgttagcaaaacncaactcctgggtaatacgaanggcggttttggncaatntggnagntgcctaagttcgggtgcaactgacnccaacaaaagttnattaacgaagt

SEQ ID NO: 96638 - DNA, 253 bp, Triticum aestivum
  unsure (1)..(253): unsure at all n locations
  Clone ID: PAT_TA_96638
gagaaaataaaagcaaactgggngagaccatctgttcctctccctagcaaccatcttccttancgacnaggccacccaagaggctccacaggaaangaangcncaccggncnaaagaanggacagcaantatgtccntccgggtgntcatcggcgnatgananggaggcccnttcttnngggcttccttnngcgcccgccggccggccctcgncttctcatgcatngggnggncgggccttatggggatcggc

SEQ ID NO: 96639 - DNA, 458 bp, Triticum aestivum
  unsure (1)..(458): unsure at all n locations
  Clone ID: PAT_TA_96639
nggtnagctcactgttgaggagcgcancctgctctctgttgcttacaagaatgtgattggtgcccggagggcttcctggaggatcatctcctccattgacgcagaaggaggagagccgtgggaacgaggcctatgttgcttcaatcaaggagtaccgtnccangattgaaactgagctcagcaagatctgtgatggcatcctcaagcttctggactcccaccttgtcccctctgccactgcaggcagagtccaaggtgttctatctgaaaatgaagggtgactaccacaggtaccttgcngagttcaaggcaggcgctgganaggaaaagaaancagctgagaaacactcctttgntancaatacnaantcangccccaagnacaancnccnccttggctgaacttgcctaccaaccccacccgnataaanggctttgggccttggcncncaaacntt

SEQ ID NO: 96640 - DNA, 284 bp, Triticum aestivum
  unsure (1)..(284): unsure at all n locations
  Clone ID: PAT_TA_96640
gcggcctcgggcggcgggtcctgcncgcgctctcgccgcggtggctgntggcgcggctccgggacgcgtacgtgaacgcgatgctccggctcgcgtcctccgccgccgtggggtacggctccgccccgttctgcgccgcccccgagcccttcgcgcggacgcggccgctcaaggagtacnacgagaaggtgctggtggagatgtaccggtccatcctggcccgngggaggtgtcatccctctctcnggaggacgccacnctggtggtcggacccgccctcgctg

SEQ ID NO: 96641 - DNA, 431 bp, Triticum aestivum
  unsure (1)..(431): unsure at all n locations
  Clone ID: PAT_TA_96641
cccaattccccaccagttctcccaccgtccaccgaaacccccacctcacctccgaagcggcggnggcagcagcgtccatggcgcccaaggnggagaanaagccggnggcgaagaagcccgcggnggaggagcccgcggcggagaaggcccccgcggngaagaagcccaagggcgagaagcggctgccggcggggaatacttccgccggcaaggagggcngccagaanaatggcggngaagaaganggccaagaagagcgtggagacgtanaaggatntacatccntcaaggtggctgaaggcaggnncacccccnancatcgngnaatcctcctnccaaaggncnatgtcnattcantgtagcctcctttcaantcanggaannttctttccgnttancatnccccgggcnnatggcgggntgaaagtntc

SEQ ID NO: 96642 - DNA, 389 bp, Triticum aestivum
  unsure (1)..(389): unsure at all n locations
  Clone ID: PAT_TA_96642
cctcaccctcgcctttgaggtctcaatccccggcctaatcaaaggcgacccactcaagatttgacaagtggacgcagagatagcaggggagccaatggcttatcttggatcgtgtatcaactaaacaagataagccatggagatgaattgattacttcagtgccagataaaaaggactcactctgccaacangatgatcagtcacagggtggtgatacatcgacatcttcagggccggatctacccgaggatatctgggtgccttgtacattcactaatgccattgtgtgattctgccccactctgcctgtgtctctcgcananttctacgttcnntggtgatngcaccccnangctttatcttcaccngaggaanacacnnagggctt

SEQ ID NO: 96643 - DNA, 420 bp, Triticum aestivum
  unsure (1)..(420): unsure at all n locations
  Clone ID: PAT_TA_96643
gcaatccaattccccaccagccccctcngcaccctccggcgaaccaccgcacctctccccggngaagcancagcgtccgatggnccccaaggcggagaagaagccggcggncgggganaagacccctgcggcgganaagaccacggnggggaagaagcccaaggccganaagcggtcgccgaagtccattngagggcggcgccgncaanaanaagaagaangncaatgantgatgtgganacgtacaagatctacatcttcaaggttgctgaancagggtggcaccccggaacatcggcatctccctccangggccatgtcaatcatgaactcccttcatcaaacgaacantcttcgnagaaagctncgcccgggggaagtncccccaangntgggccccgctncaancanagaancccc

SEQ ID NO: 96644 - DNA, 450 bp, Triticum aestivum
  unsure (1)..(450): unsure at all n locations
  Clone ID: PAT_TA_96644
gtcatggcggaggtggtgcacagaggaggaacaaaagagatcgtggagtgcgcaatcgcgtgcagtgtgttgtttcaatgtgggcgatcggggtgggtttcccaatctccgtgacagtttaatgtcggtgggcggatggtcggtcaaccgacttcaatgcgttagatagtcgtcttgtctccccgtgccatcatgttcctccggcatggaacatgcgtagagaccgggccgcgacgcgggcggcgctttcggctgtcgtgccacttcaattccggttccagtgacaggccatgtccgcgctgggccatcatgaatgtggcacgactagcggagggcggttgcgtgttanaaggcaaggggcaaccanaattatttttccggtaaagaccggggtgtcaataacgcgttatgtgggcatcggtcnggacgcccaacaaacttttccgcntt

SEQ ID NO: 96645 - DNA, 156 bp, Triticum aestivum
  unsure (1)..(156): unsure at all n locations
  Clone ID: PAT_TA_96645
cgcagttccgcgcattccatccaccgccgcattccgaggggtccgagctcgccggagagggaagagagatggccaggaagggcggnctagaggaacaangcngtgnccccnntccgtcacggnccgcctccatttcnccgtcggtcgcatcgntcg

SEQ ID NO: 96646 - DNA, 450 bp, Triticum aestivum
  unsure (1)..(450): unsure at all n locations
  Clone ID: PAT_TA_96646
ggcagtaggaaacctacacaaccaagcagataagcagctgtcctactgtcacatacacacacacaagtgctagctagctaatcgatcagccagccatggcggaggagaagcaccaccaccacctgttccaccacaagaaggagggcgaggacttccagcccgccgctgacggcggcgtcgacatgtacgggtactcgaccgagacggtggtgaccgccaccggcaacgagggcgagtacgagcggatcaccaaggaggagaagcaccacaagcacaagggagcacctcggcgagatgggcgccgccgccgccggagccttcgccctctacgagaagcacgagggcgaagaagggacccgggngcacccgcacaaagcacaaagattcgaaggagggaaggttgggcgccngcccgcanccgtccggncgcccgggngggnttccttcttg

SEQ ID NO: 96647 - DNA, 284 bp, Triticum aestivum
  unsure (1)..(284): unsure at all n locations
  Clone ID: PAT_TA_96647
atatcaagcntatcgataccgtcgacctccgagtttttttttttttttttnaaacagnnagacgcctcagccatcacgattcatttcagtangtcganttacgtacaaggtacacgctagtattacgacagtagtacgtanatcttanggnacaaaaaggtaggtaattcgaagganaatattacttgagcanacnatgcatcgancaattcantcgngcacaaaacaatcggtgtntccatntggcgatgtccacgcanncangatactgttggngataatat

SEQ ID NO: 96648 - DNA, 432 bp, Triticum aestivum
  unsure (1)..(432): unsure at all n locations
  Clone ID: PAT_TA_96648
attattatgatccagtanaccattgtcattacacaacacaacatgtgaagaattaatcccgggtctgcctgcanatgcgcattatggggaaaatggaaaacaaagtttatgttttaaaaattgggaaaagacattactccttttcttggtacgangaatccaagctaagcanancctcanaaggtanacaattattcttggattctgtttgangttgctatgctagagcgtgttggccttcttggagaacaacacaggantggatgttggggcaacaccccacgtatggggccgatngtgnatgncgtcacgcagccttgggataggctcctcngtccgttgcgatgtgcgcngataancanggttgggccgccggnatngatgccgggntccntctttgtttgctccttgggcngcnntttgcccngccaa

SEQ ID NO: 96649 - DNA, 226 bp, Triticum aestivum
  unsure (1)..(226): unsure at all n locations
  Clone ID: PAT_TA_96649
ggagaggagcaccanccacanccgcggnttcttccttccttcacctcgccgtcaagcccncgcccccctcttcgtanatactcctcaacncagncgtctcncctcctcgccccccanttgngtaacncaacctccanccctagcagccagntctcccttcccttgccgccggagccatggcgttcgacgccttcatcgacaagaccgccgtcttccgncgtnctca

SEQ ID NO: 96650 - DNA, 228 bp, Triticum aestivum
  unsure (1)..(228): unsure at all n locations
  Clone ID: PAT_TA_96650
gtgagttcatccatccatccgtccaccatggcctccgancgcctcgccgnccncaaggccttcgangagaccaaggccggngtgaatggcctcgnggacgccggcgtcaangccgtcncggncatcttccgccaccctctcggncncactctccccgtgcaccagnggtcnccgcattccccggtcgtcttacctcttcggngcncacgctctgaggtgtgcgtccgc

SEQ ID NO: 96651 - DNA, 351 bp, Triticum aestivum
  unsure (1)..(351): unsure at all n locations
  Clone ID: PAT_TA_96651
ttcctcgccgccgccgctccgtacccgctcgaagccaacccgaccatggnggacgtcgacgttganacggaggtggccgcgggcgcgcagccgaagaagaggacgttccgcaagttcagctatcgcggcgtggatctcgatgccctcctcganatgtccaccgacgaccttgtccagatgttccccgctcgcgcccgcanaaggttcaagaaggggtcncaagaggaagnccatggcgctcgtcaaagaagnctgccgcaaggngnaaaaagggacngctcctgcngggtgagnaagccctgaagccagttgaangacacatctccngttnncaatgantnatttggtccc

SEQ ID NO: 96652 - DNA, 231 bp, Triticum aestivum
  unsure (1)..(231): unsure at all n locations
  Clone ID: PAT_TA_96652
acgccgccgccgcccgagcgccctccgttctcctcgccgaagcgcccgccgctccaccgccgcagccgccatgggtaaggtgcacggntcgctggctcgcgccggnaaggtgcggggccanncgcccaaggtggcgaancatgacaanaangaatcagccgcgcggncgcncccacaatngcatccagtacaancgcctcttcgtcancggcgtccgtcngnttccgggca

SEQ ID NO: 96653 - DNA, 444 bp, Triticum aestivum
  unsure (1)..(444): unsure at all n locations
  Clone ID: PAT_TA_96653
tccagcgcaaccgccgccgacaccacacctcgtgagtcctcgtcgccggagaagcagcaagcaagatggccggaaggaagggtggcgacaggaagaaggccgtgacccggtccgtcaaggccgggctccagttccccgtcggccgcatcgggcgctacctcaagaagggccgttacgcgcagcgcgtcggctccggcgcccccgtctacctcgccgccgtcctcgagtacctcgccgccgaggtcctggagctcgcaggcaacgcggtcaaggacaacaagaagacccgcatcatcccccgccacctgctgctcgccgtccgcaacgaccaggaagctcgggcaggcttgctcgccggcgtcaccatcgcgcaacggcgggcgttgattccccaacattaaactcccgtgnctgnctccccaangaangtcccccgcccgccng

SEQ ID NO: 96654 - DNA, 273 bp, Triticum aestivum
  unsure (1)..(273): unsure at all n locations
  Clone ID: PAT_TA_96654
gttgatcggagccggaggagagcatccacaccgaggaagaaggagaagcggcgagtcgaggcgaggcgaaagatggggaanatgccggtgcgngatgaaggcggtggtgtacgccctgtcgccgttccagcagcaggtgatgccgggcctgtggaaggacatcaccaccaanatccaccacattgtctccgagaactggatctccgccacgctcctcatcaccccccgtcggncgggcancctaccaagtangccattgttggtanaaaggga

SEQ ID NO: 96655 - DNA, 229 bp, Triticum aestivum
  unsure (1)..(229): unsure at all n locations
  Clone ID: PAT_TA_96655
ccgatgcngggcggggtactgatacgcacccacaggtgacgganccaacanccccccggatctcnccaggttccgnagctcctccctccacttgcgatgccgcgcgcgggatcgagccggngcggcgcacgccantcanccgtacacgatctgtggngtcncgttnaggccccaacatcaacgagtataagtgagccatngccacggtnccancnaacnagttactgcc

SEQ ID NO: 96656 - DNA, 324 bp, Triticum aestivum
  unsure (1)..(324): unsure at all n locations
  Clone ID: PAT_TA_96656
gataaccatatgtcaatttcattatggactttggcaatgatacgttgatgttttgactacgacgcgatcctacatggntcagggagacacacgcnaccaacancgtaatcaaagaaaataatggcccagaganagnttctcgggacagcaacacanncttccgcatgcaagcagtggatacgagcatgggnttcggntcatcccatggcatacntctgcgtccacgctgcnggctgtcgtctcgtacttggnccgggtccgtcttgtacatgtgggcantctcagggacgagagggtcntccgggttanggtcngtaatgcaag

SEQ ID NO: 96657 - DNA, 399 bp, Triticum aestivum
  unsure (1)..(399): unsure at all n locations
  Clone ID: PAT_TA_96657
cccagatcccctccaccttcttcctcccatgcaccatgcaccactccccgatccaccaacccaccgccgccccgaggccggccaactaccaccgcgccccctccccccaccggtgctcctcncaaccgccccaccttcattggtgcgcccttccccgcccgagaccggtgatctggacagagtgccccaccacccaattgccggngtggatccttgcgcaccacccacctcgcgtggctgtcgcggcgnatccggttgcggcgtncaccgtcgtcttcatctcccttccattccccagntaccagctccagctggcgttggacggcccgngantccctagtgtgccggaatccaggccgcaccgggccctctcgncgccntccagntagcgtggngtcc

SEQ ID NO: 96658 - DNA, 353 bp, Triticum aestivum
  Clone ID: PAT_TA_96658
gcggcatcctggagtggctggcgcccatggcgcacgccacggtgcggtggcaggcggagcgcagcttcgagcagcggaagacgacgtcgacctcatcgacgacggacatagcccggctcccccctcgccacggcggcggcggcggcggcaacacgttcctgctgcagacgctgcagttcgcggaccgagacaaggtggaggcggccgtggcggagctgctcgtcgggctgaactacgtgtggcggttcgagaaggagatgagctgccgcgcgctcttcgccgtgcaccgcgaattcgtggagcgcggcggccgccccagcgacttcgacggtggcgccgacagctgccgaggg

SEQ ID NO: 96659 - DNA, 232 bp, Triticum aestivum
  unsure (1)..(232): unsure at all n locations
  Clone ID: PAT_TA_96659
ttccacttctcctcccccccacgcgacatcacagatcaccaccctcccccatccccctccccctccccatcccctcgagctccagntcccgatcccatggcgacngccttcgactccccgacctcctccccggccgccgcgcccttccacgannaccccttcctcagcttcgctgactcccccatcnccgnngaggccgangttcacngtcncngggggactgatttcccgc

SEQ ID NO: 96660 - DNA, 434 bp, Triticum aestivum
  unsure (1)..(434): unsure at all n locations
  Clone ID: PAT_TA_96660
gccaagtccacactcccgcacccatcactcccctgcttgcttccctcctccgctctgcttcttgctctccaatctccacccccccacgccccgccagcagatcaccgccccaaatccatccacccgccgcaaagccaccgccgcgcgcgtgctcgccggtcggagcacaaggaggcggaatgggcggcccgctgggcgccatcatcggccgctacccctcggccgccgccgccggcggccccgggggagacgacgccgaccacccgggcggcggcgggggcacggccagcctgggcattgtccggtacnaccggtggtgccgcgacctggccttcctcgtcctcttcgccgccttctgggtccccaatgattggtcaactccaagcttcgccttcaaacaanggcaannccgctcaggctgacaatacaagcnt

SEQ ID NO: 96661 - DNA, 426 bp, Triticum aestivum
  unsure (1)..(426): unsure at all n locations
  Clone ID: PAT_TA_96661
acttcgagcgcctcctcctgtctcgtcctcgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagattccagctggcattccaggtagccgggcgaacaactattaccgtgcagatggccagaacacgggcaacttccttacggaccgtccttcaaccaaggttcatgctgctcctggcggtggctcgtccctgggctacttgtttggcggaaagtgatgttaatgatggtgcctgcttaatgaacgangcgatgaatttgggctgtatctcn

SEQ ID NO: 96662 - DNA, 464 bp, Triticum aestivum
  unsure (1)..(464): unsure at all n locations
  Clone ID: PAT_TA_96662
gcccaacacacccanatcaaatatcaaaatagcagcaggagatccaaatgagaacttgccagtatncatctaacttccacacgnggtacacatccaatgcgaggncagcactgcngtgctactatatatatntatgtccatcncnanggctanatatagttgctagnattttccagntggctggccacnaaaaccaagncctgtggcaactgggccgaacaaacaaggaaaattgtggtccccacgttgggaggggaacaccacaaccncgaatggnccanatccnaagnccaaatttttaaagcctgccntgggaaaccaacggncgntagatttnccaaaatnaaagtcataaacgcctnaantggtaagnttaattcccnccttttcnaggngaaaaatccaccaaanaaggnngggggnaaaaggncaaattnctgaagatntttcantntctggaaaaa

SEQ ID NO: 96663 - DNA, 335 bp, Triticum aestivum
  unsure (1)..(335): unsure at all n locations
  Clone ID: PAT_TA_96663
gacggacgggcgacccgcgagccagctcatcgggttccagagcgtgcacctcaaggcggaggaggccgcgcacgtggagttcgaggtgagcccctgcaagcacttgagcagggccgcggaggacggccgcaaggtgatcgaccaggggtcgcacttcctcaaggtgggcgacgacgaggttcgagttgagcttcatggcctgagccgcccggggttggatccaacacgataaacctgctgctgcttcagcagagaaggatttcgatcatacttactactatatccataagtgtaatcagctaacttatgtgtacggggtaatagctagntagcag

SEQ ID NO: 96664 - DNA, 378 bp, Triticum aestivum
  unsure (1)..(378): unsure at all n locations
  Clone ID: PAT_TA_96664
cgcacccttgcggattacaacatccagaaggagtccaccctccaccttgtcctccgccttcgtggaggcatgcaaatctttgtcaagaccctcactggcaagactatcaccttggaggtggagtcatctgacaccatcgacaacgtgaaggccaagatccaggacaaggagggcatccccccggaccagcagcgcctcatctttgctggtaagcagcttgaggatggccgcaccttggcagactacancattcagnaggagtcaacccttcacttggtgctccgtctccgtggtggncagtaagctctgggccatgggnnctgcttctgtttatctggtccttccggtgtccctccaaangggagtccngggtctggt

SEQ ID NO: 96665 - DNA, 275 bp, Triticum aestivum
  unsure (1)..(275): unsure at all n locations
  Clone ID: PAT_TA_96665
ggcgcacctccagggcgcgcactgccgcggcggcggcggcggcgggggccacggcggaggtggaggtggaggccacggtgggggcgggggcggaggtcgtggaggtggaggctcagggagagggcgctccggcgggagggcccgtccgatcatcnccggcgcggnagcgggcgccctcgctggnggctggagcggnncgcgctcncccggcagggcctcntcaggggtctcacggccgcagcgccgcnggcgagccntgtcgtccgccttggagt

SEQ ID NO: 96666 - DNA, 442 bp, Triticum aestivum
  unsure (1)..(442): unsure at all n locations
  Clone ID: PAT_TA_96666
gtcgagtcgtgtcgtccacatcacaatgtcacccttgtactgccacgggaaaccaaggcctctcctcctcctcctcctcctcgcggtcaccctcacactactcgccgccgcagccacggccgaggatgtctcctccggcacggcccccttctacccctccgcggaggcggccgcggcggcgcactgcgaaggcacgctgtacccggagctgtgcctgtccacgctcgccgacatcccggacctccacaagaagccgctcccggacgtgatctgcgcggccgtcaaccgcaccgagaccgaggtgaccaccatgtccgccaactgctccgcctaccttcacgggaggtccctcaagtcgcgcgaccacctcgccgtcatggactgcatggagctcctcgacaccaccatgggacgaagctggtggccacnacgggccgacctt

SEQ ID NO: 96667 - DNA, 178 bp, Triticum aestivum
  unsure (1)..(178): unsure at all n locations
  Clone ID: PAT_TA_96667
cttaaccttgcaaggttccatgacaccacagagcgctggngcattanctgctacaacactggtgttcctctctttgatctgcancatccagattttggtctcggtcacgggcttgtccagcnttgcgatggataattccccaaataanccagagctcggtgcggctgcntnccgccgg

SEQ ID NO: 96668 - DNA, 442 bp, Triticum aestivum
  unsure (1)..(442): unsure at all n locations
  Clone ID: PAT_TA_96668
gggcggggagcccagtctacgggcggcagcgcagcgggagcagcacggtcttcacctccccgggcggtgtctcccccttccaccaccgctcctcctccacctcctttgctgcctccctccaacgcccacacagctcgcgaaaaacatagacgctgtcgccgccgcccctcgcaccatggncgcccccctgcatcgactccccacacctccccgccctcaagtggctcctgccctccactacctagatccgcgtcgccccatccgcatccccacccacctgctgccgccatccactctcgccgcccccgtccaccacctcgtancacgcngnccgaccaccatccactctcgcgtgcacacnacctccntngttcttcgcgactgctccatgtatgccgcctgattctttcgnagncccgggngtctncccgccaacngtngg

SEQ ID NO: 96669 - DNA, 364 bp, Triticum aestivum
  unsure (1)..(364): unsure at all n locations
  Clone ID: PAT_TA_96669
ctccgtctcactcactcactcgcctcgccatccattcatctgaatccttgtcccgttgcaatcatttcgctcccctgctgattctataaaaacgccggcacgatctaccccgcactcccattcacaaggtgacacccccagttgcagagcttctcacgatgcggtgccatggcaggagatctgcgctcttcgccgtggccgtggtcgcggccatcgtggcggnggcggcggnggcngaggtcgtgcacganggncggaggacgtncatcgttccactgctcgcacgccgtcatgcccagcgagnttcgcggctcnntggccantgggtacnccttcgtcnctcgcangtccggtgtccgggcgg

SEQ ID NO: 96670 - DNA, 430 bp, Triticum aestivum
  unsure (1)..(430): unsure at all n locations
  Clone ID: PAT_TA_96670
cagccatgcggcgggtgctgggccgcgcgccgcctgctgatcgcgccggcggcgcccccctcggcgtcggctgacccgtccatggaggcgcagcaggcgcacctggagagggtgctgagcatcaccaccgccgcgctcttcgtcgccaccgtctcctacatcgccctcagcatgctctacgcctgcctccgcgccgcccgccaggaagagcccgccgggctcgacgccgaaggcccggcgccgccgcgggaggcgaccaagcgcgcgctcgaggggatccccgtgcgggtggtcgtcatgcagcagcagcagcagccgcacgatgccgccggaggccggaagatcgaggaggagaatgacgccgaagccggtgactgcgcggtgtgcctggncggagtacgcgggccgggggacnagttcgcgttgctcc

SEQ ID NO: 96671 - DNA, 450 bp, Triticum aestivum
  unsure (1)..(450): unsure at all n locations
  Clone ID: PAT_TA_96671
atcagatcttggcggactcgaatccaatccaatccaatccaaggcggaggtcgagatcaaagccaccggagatgaagttcttctcggcgttcgacccgtggccggtgttcttccgccgggagtggggccgcacctggcccttcctcgccggcttcgccgtcacggggaccctcatcaccaagatgaccgccggcttcaccganggaggacctcaagaactccaagttcgtccaggcgcacangaancangtagtcgcccgcccgcccggcnccgtccgncgcagggtcacagggggcaagcaggctgnagttaccggggatggtgtcccttngatgccgggcgaagncaaatccccaacccgtcaactanntggcgattggaanctttccgttttttnggttccnggatccaancttncngttngaatttttgncggcccngggtttttg

SEQ ID NO: 96672 - DNA, 362 bp, Triticum aestivum
  unsure (1)..(362): unsure at all n locations
  Clone ID: PAT_TA_96672
ggagaaggagcaggcggcggcggtgcccgaagaggagaagcacggngacctagcccgagctcgcaaccatggttaggggtttgaagaancatctgaagaggctcaatgccccgtctcattggatgcttgataagcttggtggagcttttgcccccaagncatcatccggtcctcacaaggccanggagtgcctgcctctgatcctcancctgangaacanantgaaatatgctctcacctaccgtganntgcactctatccttatgcannctcatattatggattgattggaaaggtcccncactnaaaacgacnttanccctgctggttttnatggtggcattaatttncaattccccaaa

SEQ ID NO: 96673 - DNA, 429 bp, Triticum aestivum
  Clone ID: PAT_TA_96673
gcatcgttcacctattaaagaaataaagagagaatatttgtgcaaggttttgccatttcggttggtggatgatgagagagactgtttatctttgacaaaaagatatcctaggctatcagttattccagatttttctaagattgtcttgaactgggctaaagaaagcctaaatctttcactgcatacaccaagtgagtctggagcatgccatctgtgaagatgatgataaagctgatgaaagtgcactggtctcttctgagaacacatcaagcataaagacccctgaaaccatttggaatgcaaaggtacttctgatgaagtggtatgagcaatggtgcctttgctgacataacgtcgatgagaagtactgacgaacgagtggtgcacttgaacaatatcttaaaatttgctgtattcaagaaggattcg

SEQ ID NO: 96674 - DNA, 435 bp, Triticum aestivum
  unsure (1)..(435): unsure at all n locations
  Clone ID: PAT_TA_96674
acccagctcaccttcntccccccttcccacccgccgccggcgncaccgccgccccgggacgaacgatgctgctggtcagccaggctgccaacggctccctctccgcgcggcggctgccctccaagccgctcgccagccgccgcggcgccaacccctaccctctcttcgccggcccgcgcgtcgcgcgccgccgcctcgtgctctccggcgccgccgacgcgcgggacgcgccccgccgcgcctccgcctcgcctcccgcccacgcgggcgcgggcgagggcccctccggctcccccgccgccgccgaggaccccgtcctcctcgggcgtcagcgacgaccgggttgccctcgaagggcgtcatccaagtcgagaaagcccgggcaaggccgaacgcccagttcaaaggctcgtcncctaaggcnnaagatagggn

SEQ ID NO: 96675 - DNA, 426 bp, Triticum aestivum
  unsure (1)..(426): unsure at all n locations
  Clone ID: PAT_TA_96675
catccgacccccccagccccgatggcccgcacgaagcagacggcgcgcaagtccaccggcggcaaggcgccgaggaagcagctggcgaccaaggcggcgcgcaagtccgccccggccaccggcggcgtgaagaagccccaccgcttccgcccggggaccgtcgccctccgcgagatccgaagtaccanaagagcacggagctgctcatccgcaaactccccttccancgcctcgtccgggagatcgcccaggacttcaagaccgacctccgcttccagtcctccgccgtctccgccctgcaggaggccgccgaggcctacctcgtcgggctcttcgaggacaccaacctctgngccaatccacgccaaagcgcgtcaccaacatgcccaaaggacatccaggctcgcgggcggattcttggggaag

SEQ ID NO: 96676 - DNA, 432 bp, Triticum aestivum
  unsure (1)..(432): unsure at all n locations
  Clone ID: PAT_TA_96676
actactactaccactattattactcagtaattacaattgaaacattcatcgcaaaaagaaattacaattaaaacaagccgtagtaattaaacacgtaagtactactacctccgtttcagtttacaagtcctgcacgtatacctaggttgtcaattttatcatcctaatataaactatataacacaaaaattataccttttgaaagtaaaaactccaaagtttatgttggtatattttttgtaatatatgacttgtattaggttggtcaaattgacgacctaagaggtacgcccacgcccttgtaaactgagagagaggtagtaccacacgacctcacgcgcgctgctgctaagctgggccatgcatatcgttcaagaccataagatcgatcgttttcgattccattgatggggcacgtacgtaggtcnattt

SEQ ID NO: 96677 - DNA, 342 bp, Triticum aestivum
  unsure (1)..(342): unsure at all n locations
  Clone ID: PAT_TA_96677
tcgaggtccgcagccgaagcccgtgagagcagcgaagcgcgagaggaaaggcactgaactagtttgcaanaaagaanagggaaaatgtctaccgctgaggcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaanaatgtgattggtgcccggagggcttcctggagggatcatctcctccattgagcagaanggaggaagagccggtgggaaccgagggnctat

SEQ ID NO: 96678 - DNA, 440 bp, Triticum aestivum
  Clone ID: PAT_TA_96678
atcccctcccccgccggcagccatggcctccaccttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaacgggatcaaccccaaggccaagccctacttcctcttcgaacgggtaacgcccaactctcctccggcctcgcctgcggcctccgcggggcctcgccgcccggcatgggccatcggcatcgtcggggacgcccggcgtcaaggggcaacgcaaaacaagcccaaagcttgttcggtccggaatgatt

SEQ ID NO: 96679 - DNA, 390 bp, Triticum aestivum
  unsure (1)..(390): unsure at all n locations
  Clone ID: PAT_TA_96679
acgacctcaacggccagcantgtcgggccgcggcaagggaggcaaggggctgggcaagggcggcgccaagcgccaccggaaggtgctgcgtgacaacatccagggcatcaccaagccggcgatccggcgtctggcgcggcgcggcggtgtgaaccgcatctccgggctcatctacgaggagaccccgcggcgtgctcaagatcttcctccagaacgtcatccgcgacgccgtcanctacaccngggcacgcccgncgcangaccgtcaccggccatgtgncgtcgtctacncgctcaagngatagggncngcaccctcctacggggttccggcgagcngatctgattcccgcggngntcctccgttgttagngggtttgcccgntgntga

SEQ ID NO: 96680 - DNA, 243 bp, Triticum aestivum
  unsure (1)..(243): unsure at all n locations
  Clone ID: PAT_TA_96680
cagtccacagtcnactgaccaagtagctagcgctcaggattcagggagcccaccaccatggnttcccctaagcttctcntcctgctcgccaccctcctcccgagctacggcctcntcctcgccgacttggccccgatgaccctgaccgtggtgaacaactgcgcgtacccgatctgggtcgggcatccaaggggagcgncggcagcgaggtcctggaggggggcgggttctttnnctcgccgc

SEQ ID NO: 96681 - DNA, 419 bp, Triticum aestivum
  unsure (1)..(419): unsure at all n locations
  Clone ID: PAT_TA_96681
gttcccctccctcctgcgcgcctcctctcctcctgcctcgtcgccgcctcctctcccctcctgcgcccgcctccctgccctgccgccggcgtcgccaccgccgctcgcccggacacccatccccggcctcacgccgcccatctagagagatgggggccgcgcgcgacgaggccggcctagccgtcgcctccttctcccgcgaccgcgccgccctctcctccttcctcacgcaagcngccctctccttcttcctcncngcctccctgncatgntgcccngccggctcctccctcggctcggctttcctctcctcncggaattcgggcttnccttcctcttncccttcgggtctcggtggcaaaccgcctgtttggggntccccacatcttncgtnaccntttctnntccccaatanccca

SEQ ID NO: 96682 - DNA, 437 bp, Triticum aestivum
  unsure (1)..(437): unsure at all n locations
  Clone ID: PAT_TA_96682
gatcaagtanctggcaanagctttgagcgcgttgcaactttgcatcccggtcgatcnatggcgtccanggtcganctggtggtggaggtgaagtcgccgncgganaagctgtgnacggcgatncgcnantcgacnganctgttccccaanatcttccccgancaagtacaanagcatccgaagaccgtggagggcgacggcaagtccgccggcaccgtccgcctcatcaagtacaccgagggggttccgatggtgacgttcgncaacganaacgtgnacgtggcggacgangagaataacgtggtgtcntanaacgnggtggacggcgacctggtcaagcttctacataacttcaaggtgacngtgcaagntaaccgacananggcccccgaccggcggcggtgcgggtnttaaactgggaccaatgggccttccnn

SEQ ID NO: 96683 - DNA, 459 bp, Triticum aestivum
  unsure (1)..(459): unsure at all n locations
  Clone ID: PAT_TA_96683
cctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggaagctccggcgggttcgagacggccggggagaccggcggctgcgactgcaccacctgcaaagtgcgggcaacgcggtgcggctgctcctgctgcaagcttgcaactgaagccggggcccaaggaagggcgggccggcaagaggcnaagcancgaaggattganggaaggacnaagcnaaggaaagcaacnatcaaccaacaggntcaaacaaacnaaccaaanngtnataataaccaaacccggcctg

SEQ ID NO: 96684 - DNA, 419 bp, Triticum aestivum
  unsure (1)..(419): unsure at all n locations
  Clone ID: PAT_TA_96684
aataaaggcaatgctcttgaggaagagtgtgcggtaaacttcttgaattcccccgccccatcaatatggacaagggatttatagagcctgccttcactactaatgtaagtttgtcctcctcgagccttcaaactatgaacaatggtctggtgaagctggccgctcctgcacaatgccatttcctgccatcttaactatgaacaaatgcaactgttatccacttaatcagcctgcgacttgcggtactaccgcaccagacatgcggtactaccgtatgcgcggcaggggcaagaccagccctgatgcgatgaagcaaagagcggtagaaccgccggagcggtactaccgctcccccttgcggtactaccgcaaggnaaggttttgtctaaggctgggaagggacgggcattaaaaagant

SEQ ID NO: 96685 - DNA, 434 bp, Triticum aestivum
  unsure (1)..(434): unsure at all n locations
  Clone ID: PAT_TA_96685
cttcagatccccccttcttcctccctaggaacggggcgctaccgcagagaagcttgtagaagttttgtgatatctgggtggtgagcgtgtgcttgtggattcttgattctttgctccaggagcactcagccatggatagacggatccaagctcctctggtcgacggctcggcatgcttgtgcagagcggagagagccgccgccgtcgcctccaccggcaggcacgtcccgagatccaagaccttgcgtgcaatcgagcgtcagagcttccatccacccactgagcgaagaagagatcgtcgcgagctgaccgccgaagcgaccgggcaacggncactgctccccggccttcccgacgaactcgccatcggcgtgcctcaaccgcgtgcccgcgaggctggatcaactgcaagcctgaaggtttgttgcaaggag

SEQ ID NO: 96686 - DNA, 440 bp, Triticum aestivum
  unsure (1)..(440): unsure at all n locations
  Clone ID: PAT_TA_96686
gaccaaaccaaagctgcggcggcgcgcgcataggaggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaagcaacaagacagtgaggagggtccgtgttcgcggaggtaacgtgaagtggagggctctccgtcttgacactggtaacttctcatggggtagtgagggctgtgacccgcaaagacccgtctcctgggatggtggnttacaattcgtcaaacaatggagcttggtgaaggactcaaaccctttgtcaaagaatgccaattggtgcaaagttgatgctgcccccttcaaagcaagtgggaactngactcaatt

SEQ ID NO: 96687 - DNA, 419 bp, Triticum aestivum
  unsure (1)..(419): unsure at all n locations
  Clone ID: PAT_TA_96687
ttggacagaaaataaatatttaaaatgtaaatggtaggtgacaaatctagccacaaaattgtacaaacaacccattggctagttttattgaatattaaaataacatagttgatttataaaacatacaaaatttatgatctcatcagcacataattattttgaggaaccataagcttgggatttatccacccaaaataggggtgataacgaaactattgtattgctgttgctgctggtgtgcaattaatcttgcagggacagttgatgaancattctccgagatttggccagcacaagttatctattttacagcagaattcccgtnctgggagctggtgcccatctttataacaagggggtctcgttacatggcttactttcntcantcaggttggctcccccttgtcanttaatggant

SEQ ID NO: 96688 - DNA, 425 bp, Triticum aestivum
  unsure (1)..(425): unsure at all n locations
  Clone ID: PAT_TA_96688
ggcgtcttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccaagatgcccggtgacaagaccgttgggggaggtgatgatgctttcaacaccttcttcancgagactggggctgggaaagcaagtcccccgtgctgtcttcgtnagatntcgagcccactgtgattgattaagtgaggactggggcttaacggcaagctcttccaaccccgaagcaactttatnaatgggaaaggaggaatgaagccnaacaaactttcgncg

SEQ ID NO: 96689 - DNA, 453 bp, Triticum aestivum
  unsure (1)..(453): unsure at all n locations
  Clone ID: PAT_TA_96689
gctgatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaaagagggaacacaaacaaagtggaagggtcttgcctacgatatctccggacgaacaagcaaggacatcaacaagagggaaaggnaatcgtgggctccctctttcanggcggccaaggggcgaagggnaaccaacnaaggccgtcctcaaactcctangnagttacgttaagcaangggactcaaagaagntacgacttcgacaaaaacaatggggaagntttctaaan

SEQ ID NO: 96690 - DNA, 451 bp, Triticum aestivum
  unsure (1)..(451): unsure at all n locations
  Clone ID: PAT_TA_96690
gcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaagcacaccaagcccgggatcctctccatggccaacgcgggccccaacaccaacggntcccagttcttcatctgcacccgtcccctgcaattggntcgacggcaagcacgtggtcttcggcnaagtcgtcgagggcatnggacctcgtcaagaacatcgagaaagtggggctcccgcaagngggtacctggtccaaagcaagtccgtcatcngccgnctggnggnccaagctctagattccgttccngcccgnccgggtcgcctgttcntcgtccccccccgtt

SEQ ID NO: 96691 - DNA, 348 bp, Triticum aestivum
  unsure (1)..(348): unsure at all n locations
  Clone ID: PAT_TA_96691
gtacatgcatgtttgatgagaggcaagttcagttcatccatgangtacctactgaagacgatggtgatgcgatttgagtcatggatcgatcgagttgatgatgaatagtggggctacgtgtangggaacaagtccggtgtgtgtgnacncgtgtgtaggtagattttggagntgannagtacctacctttggtattcttattaacnnanaaaaaaggggggggccccggtacccaanntcgcccnaatagggacgtcggcattanccccgcngctcacntgggccgntcnttttacaacgtcaangacctggnggaaaanccccnggtcgttaaccaanccttaaatc

SEQ ID NO: 96692 - DNA, 445 bp, Triticum aestivum
  unsure (1)..(445): unsure at all n locations
  Clone ID: PAT_TA_96692
gccgcctacgccctctgccgccgcagccgcagccatgggcgcgtacaagttcgtgtcggagctatggaggaggaagcagtccgacgtgatgaggttcgtgcagcgcgtgcgttgctgggagtanagacagcagcccgccatcgtccgcatcaccaggnccacccgccccgacagggcacgccgtctcggcttcaaggccaagcaggggtatgtggtctaccgtancngtgtgaagacgtngtggnaggaagcgcccagtgcccannggtattgtttntggcangcccaaancaccagcggtattacccaacttaagttccagaaggaacanngnggtctgttgcnggagngaatagagnctgggcgcagggctttggtnnggcctttcgnggtacgncanactccctaantggggntgaaatnnaggggcctccaaccntacatg

SEQ ID NO: 96693 - DNA, 419 bp, Triticum aestivum
  unsure (1)..(419): unsure at all n locations
  Clone ID: PAT_TA_96693
ccacttcgagcgcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactggcagctgccgatgtaaccaagcagattccagctggcattccaggtagccgggcgaacaactactaccgtgcagatggccagaacacgggcaacttccttacggaccgtccttcaaccaaggttcatgctgctcccggcggtggctcgtccctgggctacttgtttggcgggaagtgatctctgttaatgatgctgcgatgaattggctgtatctcn

SEQ ID NO: 96694 - DNA, 322 bp, Triticum aestivum
  unsure (1)..(322): unsure at all n locations
  Clone ID: PAT_TA_96694
ttccaatccacaatccaccaccgccaagaaagatctcatcttcccctccgaccancagagcgatgcanccatatccgcagcccctccatcccaatggnccgcaccaagcagacggcccgcaagtccaccggcggcaaggcgccgaggaagcagctggccaccaaggcggcgcgcaagtcggcgccggcgaccggtggcgtcaagaagccgcacaggttcaggccgggaaccgtcnccctccgcgaggatccgcagggtacnagaatgagcacggagctgctcatccgcaagctccccttccaagcgcctggtgcnggagatc

SEQ ID NO: 96695 - DNA, 430 bp, Triticum aestivum
  unsure (1)..(430): unsure at all n locations
  Clone ID: PAT_TA_96695
ctcgagtttttttttttttttttttgnacggatgtgtgagaatggntaataaaaatgatgcatttcctattttttatagggatgtgcttggtcgtggaagagggggtggcactatctttcgtccttctgatcagcactactccgtcaaatgcactaaggaatgtctcatggaatttctcaatccaattgttgaggcactttggaaagcacatatctgtgtcttcgtcttcaatccatcattttccatancctttccaagatgggggcagtatgacattgattgatcgcttcgtcttcaatcactcacngtccataaacttcctaagcatgcaacatgattgcttgctcaggnaaatgatctccactcaggatgcatcaatgttgtacgcgatcgggtcgaatgtagttaaccccagaggtttgcncgtct

SEQ ID NO: 96696 - DNA, 211 bp, Triticum aestivum
  unsure (1)..(211): unsure at all n locations
  Clone ID: PAT_TA_96696
gcggccacnagtgagntcgccgtccgccgtcaacagtgggcanctgtcgnctggnncctcgacngtgaagtgcacctgangcagntgccccctcntccgcgccgccgtctcctangatcattcancattcgcattgtantcantcagcctctggtnngcatgttaagtttacgcantctgacggtacgggctgatggagaacccggttgat

SEQ ID NO: 96697 - DNA, 184 bp, Triticum aestivum
  unsure (1)..(184): unsure at all n locations
  Clone ID: PAT_TA_96697
gagggacacaactatgccantttccanacttttgcttgagaaaatgcatgcnaacctgcagtcatgncacagggtgttgatccagtggcagcctttggaaanatcaaatgccaggaaatgccagttganngngatcctgacntgcacgcgcacacacgaactgggntgccattcccctttgata

SEQ ID NO: 96698 - DNA, 358 bp, Triticum aestivum
  unsure (1)..(358): unsure at all n locations
  Clone ID: PAT_TA_96698
ctcctcagtcctcacagcatcctctcagtccttatcttccttccctcgccgccacccaccaaggaaaggaggatgtcttgctgcggcggcaactgcgggtgcggcgccggctgcangtgcggcaacngctgcggcgggtgcaanatgttccccgacgtggnggccaccgccggcgccgccgccatggtcatgcccaccgcctcccacagggngagctccggcgggttcgatacggccggnganaccggnggctgcgattgcaccacctgcaagtgcggnaccgcntncggntgctcttgctgcagntgcaattgagccgnccccccacnanggtcgngcccgnnaacangcgatccat

SEQ ID NO: 96699 - DNA, 422 bp, Triticum aestivum
  unsure (1)..(422): unsure at all n locations
  Clone ID: PAT_TA_96699
gagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcaggacaaggagatggcatggcatggatggacctaatgaaggagcactagtantaagttatgcatggtgtgtgcgtttgtgttctcttttttaattgccgccgagaataagacgagatctatcgtt

SEQ ID NO: 96700 - DNA, 354 bp, Triticum aestivum
  unsure (1)..(354): unsure at all n locations
  Clone ID: PAT_TA_96700
accaacttcgccctcgacaaccatccatgtccgtcgccanngcccaccacctccgcncgtcgccaccggnggccngcgaccgcctcnccnggtgngccgcgcgngcttcctccttccaggcccctgcnccgccgnngngtcgccgcgggggcnaccgccggnggtcgaggcnancgccngccgtgtcgcgtggtcannangatcgccaacagggatccggtgcggnnccanacgatttcntgtcttcgtcggtgacgatagcggcatgatanatcaggatngccgggggtcttcggccangggaganggctaccancatnaattncgncctcngccggttgnggggcgcaatca

SEQ ID NO: 96701 - DNA, 386 bp, Triticum aestivum
  unsure (1)..(386): unsure at all n locations
  Clone ID: PAT_TA_96701
gcaccgagccaccgaatccacctctcgccggagtcccagcaaggagcaagcaagcgacgatggacggcagcaagctgaataaggtggccgggaagaagttcggcgggccgaggaataagtcggtgaccaagtccatcaaggccgggctccagttccccgtcggccgcatcgggcgctacctcaagaagggccgctacncccagcgcgtcggntccggcgcccccgtctacctccgccgccgtcctcgagtacctcgccgctgaggtgctggagctggccgggaacgcngccaacggacannaaggaaggacccgcatngtgccgaggcacctgctgntggtcatcccgtancganccanggacgctcnggcaggggttgctgtccc

SEQ ID NO: 96702 - DNA, 229 bp, Triticum aestivum
  unsure (1)..(229): unsure at all n locations
  Clone ID: PAT_TA_96702
gcacaggctttgcagtaaatcgnacatttttcccttacacncaaggtgcncancttctagttagctcttgngaattgatcttttcanganntgatccaataacaacgcaactttggnatgccaatgggaccgtntcaacnccacgatttanctgganatggantntncttagnaccatcgtgatactctatgcagctgcctttgggaacacggaattttaantccgttc

SEQ ID NO: 96703 - DNA, 276 bp, Triticum aestivum
  unsure (1)..(276): unsure at all n locations
  Clone ID: PAT_TA_96703
tggcggcggntacggcgagatggggcanaagatcgactacgtgtncaaggtggtgctcatcggngactccgccgtcggcatgtcgcagctgctggcccggttcgcgcgcaatgagttcancctcaacnccaaggccaccatcggcgtccagntccatnccaggcnncctccagatcgacattcgcaccntcaatgnncacatctgggacacccgcgggnacangataggtancgnagcggtaaccagtggccacctacagnaggggcagtanggng

SEQ ID NO: 96704 - DNA, 422 bp, Triticum aestivum
  unsure (1)..(422): unsure at all n locations
  Clone ID: PAT_TA_96704
cccaccaccgttcctcccatcccacactcgctcgcagctcgagatcgtcggccatgtccgggcgcggcaagggaggcaagggcctaggcaagggcggcgccaagcgccaccggaaggtcctccgcgataacatccagggcatcaccaagccggcgatccggcggctggcgcggcggggcggcgtgaagcgcatctcggggctcatctacgaggagacccgcggcgtgctcaagatcttcctcgagaacgtcatccgcgatgccgtcacctacaccgagcacgcccgccgcaagaccgtcaccgccatggacgtcgtctactcgctcaagcgccagggccgcaccctctacggcttcggcggctaanggccggccgggccgacgggaagtcaactccttgtccnccgccctggaantttcaag

SEQ ID NO: 96705 - DNA, 409 bp, Triticum aestivum
  unsure (1)..(409): unsure at all n locations
  Clone ID: PAT_TA_96705
ggattgtctgctgaccccgagacgttcgccaagaacagggagctggaggtgatccactcgcggtgggcgatgctcggcgccctcgggtgcgtgttcccggagatcctgtccaagaacggcatcaagttcggcgaggccgtgtggttcaaggccggcgcccagatcttctccgagggcggcctcgactacctgggcaaccccaacctggtgcacgcggcagagcatcctcgccatctgggcggtgcaggtggtgctcatgggcttcatcggagggctacctgtgttggnggcgggcccctcggcgagggcctcganatcaatctacgcggggcggcgcctttcgacccactttggncctcgccggacgaccccgaanacccgccgtccgaagctnaagggtgaanggang

SEQ ID NO: 96706 - DNA, 300 bp, Triticum aestivum
  unsure (1)..(300): unsure at all n locations
  Clone ID: PAT_TA_96706
gngatccccatctccccgtctctcccatggcagagccgccgccgcccccgtcgcagtcgccggngcccacgcagnantanacgcccgcggnaaccgcncgggatgaaatganggcgtgcgtggctgcnctggnggcgncgctgctgccgtgcctccccgcgcgcgagctgcaggncgtcgaccgctccctccagtcctcccannagattgatgtcgagaggtacgccatggatttcatgganngcagccaaganncttcantcttgcttcatcnacatgcagcgtggangnnccaaccat

SEQ ID NO: 96707 - DNA, 447 bp, Triticum aestivum
  unsure (1)..(447): unsure at all n locations
  Clone ID: PAT_TA_96707
aagaagttcgagaccctgtcctacctgccancgctcagnacngaggncctcctcaagcaggtcgactacctgatccgctccaaatgggtgccttgcctcgagttcagcaaggttgggttcatcntccgtgagcacaangcatcccctgggtactacgatggncggtactggacaatgtggaagctgcctatgttcgggtgcaccgacgccacacaggtgatcaacgaggtggaagaggtcaagaaggatgtaccctgacgcgtacgtccgcatcatcggattcgacancatggcgccaaggtgcaagtgcgtcagnttcatcgccttcaaggccatcgggtctgcgaaggaggtccgggtaaagggcctaaanncagcttcanntcanccacgggggncaacaatgttaaaatgntgcnattggcgggnttttggtccaacntcctg

SEQ ID NO: 96708 - DNA, 391 bp, Triticum aestivum
  unsure (1)..(391): unsure at all n locations
  Clone ID: PAT_TA_96708
ttttgaaggcaagcaagtaataacaaaactaagaataagaaataagtttgtttaggggaagaacagctcattgtacaacccttattatgaattgtagctcttcccctgttcctttgattagtagcctacaacaacaatggaatcagaatccaatgtgcagattcaacagagcacccatgcataggacatatcagaatctggntcttgatacatggctcactcacgctggatgaaccggcncacggaagcatcctccacctgccccgccgcgcgcgatatcagggcgactgccgngngcctgnggtcccctgccgtggtggtggatggggtccggcccgggtgggcanctccctcgcctcttncgnngccggagcccccgtcggtgcctcaa

SEQ ID NO: 96709 - DNA, 429 bp, Triticum aestivum
  unsure (1)..(429): unsure at all n locations
  Clone ID: PAT_TA_96709
ggtcggcttctggcgctaccacctcccggcggnggtggcgccgctgctaggctccgggtacgagcagatcatgcgcctggagganaagccgaaccttgcccaggcgctcgatctggaggagatgtcggcgttgcagaggggggccatcctggagcacgcgctggagaaggaagccaagtgcggtgccggcgtggaggggatgtggaaggtgctggctgatctgtgggtgcagctcatggtgtacgtggcgccgtcggggggcgaggagcacgtcatggggcacgccaaggtgctgccgggagggcggcgaagttcgtcaccgtgctcctggggcgctgggccaacgcacaaccnggcatgccgtccgccgccngcncccggttggggttgtcgggcaagcatgggaaacatngtttagggaggggggtt

SEQ ID NO: 96710 - DNA, 427 bp, Triticum aestivum
  unsure (1)..(427): unsure at all n locations
  Clone ID: PAT_TA_96710
ctgaccttggtatagtatctcaatgtctcaagccangacaaggtcgaaagagcaaacaagcantattttgaaaatgttgcacttaaagtcaatgtcaaggccggagggagaaatacagctcttcagcaagctcttacacgtcaaataccgttagtcaccgatcaaccgacgatcttttttggtgctgatgtaacacatccggcggcaggggatgattcctcaccgttcaattgcagccgtggnggcctccatggactgggcctgaaatcacaaagttaaaaagctgtggtttctgcccaaccgcccangcagganattattcaagatntccaattgcacaaggcatanacccctganaagggcaccccctgtacanangtgggaatgaatgcggggagttngcnangtgtcattccttttcancang

SEQ ID NO: 96711 - DNA, 362 bp, Triticum aestivum
  unsure (1)..(362): unsure at all n locations
  Clone ID: PAT_TA_96711
gaggaggcgccatgtattatanttggaggcatgatcaaggacactgctggtggaaaacacnggcgtacaggtacagagttaaggaacacacgacggttttattttattcagcgcgcgcgcgggcgggcgcatgcatcggctantgatggtggtggtggtggtggtggttgcttgtccannttgtcctcctcatcctcgtgctcgcctcgccgggccggcctcctgggcgcctgctcagttgcanctgcancaggagcatccgcatgcccgtngccccacttncangttggtgcnagtctcagccgccgtgtcnntccccggctgtctgtcctccnaatcccccccgtggngcctcccccttt

SEQ ID NO: 96712 - DNA, 380 bp, Triticum aestivum
  unsure (1)..(380): unsure at all n locations
  Clone ID: PAT_TA_96712
cctccgcccgcgcggacgacgacatcggcgcggtgaccttctccggggacgccgtcccgcgcctcgacgacgccgacgtgcagaanctcgtgaccgtggcgcantccctggtcccgcggtccgcgaacggtcagctgcccgccgtcaacgctaccgccacggcnagcaacggcgacacggtgcgcgtgctggcacantgcgcgacggaccgcgccgcgacggagtgcncccggtgcctgcgggactcggcgctgcagatggccangagctggggggccgccnccggcnccntgcaaaggaatcgtggcgctgtcctcggttccaactgctaccttctcttcgagatatcnggcaccgncgctgcccctggggagagcagt

SEQ ID NO: 96713 - DNA, 417 bp, Triticum aestivum
  unsure (1)..(417): unsure at all n locations
  Clone ID: PAT_TA_96713
gattcaggtaggcagccccttactaaggggggcgaccctcttgtgccgatgacctctgtccatccagaggcatcggacaacttgctggaagcgctttgcggcgcttccattgacgaagagcaccgcaccatcatgagtgcggtgatcgagtaggtttggtccgccaaaagcatatggaccaaagcctgcgccagcctcctaacaggctttgaggtaagtaaacaaattatgagaaaatatcacagcatagacagtatcccctgatgctctgtttgggtgttcggaaagaaaggccgaacagaggatgaaataacatccacttgangtctaatcagaatatgtctatgtgaataangcaggcgttgctgctgggccgctgccgccccgtactacggaggntctccgggactggaaggt

SEQ ID NO: 96714 - DNA, 300 bp, Triticum aestivum
  unsure (1)..(300): unsure at all n locations
  Clone ID: PAT_TA_96714
ggaacatcgggaccttctctcaagcgtagctcagctcccagatctcctcgatccttccgtagtatctgtccttctcgttaccagtgtaggattccatcgttaccccagagttctgataaccatcgctcttctgataaccacacagacatgcaccattagtagttttgcaaaaaagtaaaaaaaataatttttatactaatggcgcaccatggcacagtgcgccattactagtttaaactagtaatggcgcactatgcaacggtgcgccattagtaggttttccaaagnaanaggtgccgt

SEQ ID NO: 96715 - DNA, 421 bp, Triticum aestivum
  unsure (1)..(421): unsure at all n locations
  Clone ID: PAT_TA_96715
gacaggtctacctcaccggagagaaaagaagagaagcgaanatgtcggggcncggcaagtgaggcaagggtctgggcaagggcggcgccaagcgccaccggaaggtcctccgggacaacatccatggcatcaccaatccggcgatccgtcntctggcgcgtcgtggcggcgtgaagcgcatctcggggctcatctacnaggagacccngcggcgtnctcaagatcttcctcnagaacgtcatccgcgacgccgtcacctacaccgagcacgcccgccgcaggaccgtcaccnnccatgggangtcgtctacgcactcaagncccagggacgcacccctctacggattcggaaggctangccaccanccaccagattanagtngtctggggttcgttggtcgtttgattgtaattgnagcat

SEQ ID NO: 96716 - DNA, 410 bp, Triticum aestivum
  unsure (1)..(410): unsure at all n locations
  Clone ID: PAT_TA_96716
gcaatcgccctgctgtgggccgactaggcccagtcggcctgcagcgggccgacggtgtattatttttgaaaaaaaattacccagcgtaatatttatgaaaattaataaaaaaagtattatttaaaaaaattagctagtaatagatcacagaaacaagaactatgtcggctgtaaaatattcatttcatgacctattttttcatccatgcaaggcttttgtacttttgtttatacttggaaatattctatttatatttatatattacaaaaaaatcttcttctttttttgaaaaaatggttcaacaagtatttaaaaaaatgttgaataaagtattaaaaatgttgaataagtattaaaaaatgttgaancaagtatttggaaatgttaaaaagtatttgaaaaatgttgn

SEQ ID NO: 96717 - DNA, 294 bp, Triticum aestivum
  unsure (1)..(294): unsure at all n locations
  Clone ID: PAT_TA_96717
ctcactcacaagcctcgctcctctccctccggctcgctctcctcgctcanccgccgccgcaagcatgggcctctcggtgatcncgccgccggcgggcgactcggcgtccccggcccaccgccgcgcgcgccgcgccttcctcgtctcaaactacatgatcctcggcgcggcgtccgnggtgcggnttcctcacgctctcgctccgcctcgtgccctcctgtcgacggnttctcctcaatcctgntccanggcnctcaccgttggngggcgnccttgggtcggggtnccgccaat

SEQ ID NO: 96718 - DNA, 213 bp, Triticum aestivum
  Clone ID: PAT_TA_96718
gaactagtctcgagtttttttttttttttttttaagattttgtcttaaatgatttgtacggaggagcacgagactgtcagcatagagtaaacaagaatcagaattacaaatataacaagatgcgacttgaatcggtgaaatctcgatgtgcgataggggggtgatgaaggatttaatccggcaattgaaaagaaaagacagcagactagttcc

SEQ ID NO: 96719 - DNA, 247 bp, Triticum aestivum
  unsure (1)..(247): unsure at all n locations
  Clone ID: PAT_TA_96719
ccacgccccaccctgcctcaccgctcgccgccgcccaccgccgcccaccccgctggcgcgcctacccctaccccgagtgcccccacacgcgtagccttccactgccggcgacccgtggcctgccactgccgacgacgaggaactgtcggatctcgatgaatccggtggggaatggngcgtangcagcgaatctggaangaaggnggccggggcttggagcatgacggctggccggtacnccatggca

SEQ ID NO: 96720 - DNA, 419 bp, Triticum aestivum
  unsure (1)..(419): unsure at all n locations
  Clone ID: PAT_TA_96720
ggtgggtgcggcttcaccgtggccatctctggtgacgcctcgcactctcgattcgccatggccatagccatctccgttgacgcctcgcgctctcgattcgccacaagctcatcaaggagggccgctggatcgagggccaccggatctgcgctgcgcggcgccaggcatctccttcgcgtaggaggccaaaccagggtggcggcatggtatccctcgccggatctggacgaggtggcggtgctcgggacggatccggacncgtggggtgcttgtggctcactggccatatgtagaggaggtcaagtggcggggggtcttcaaccatggtggcggcggcatgtgctgctgcagngaaaacgcggcaatggngaccggttggctggactttgacaacgangggcttgggcggcatggtnaan

SEQ ID NO: 96721 - DNA, 419 bp, Triticum aestivum
  unsure (1)..(419): unsure at all n locations
  Clone ID: PAT_TA_96721
caggcgcctccacgcggcggcgatcatggccgcggccctccgccccctgctccgctggcacgcagttctgccgccatcttcgatgctgcgcgctctattccccgtgccgtactccaaggccgccgccagacccccagccgtgtgccacgcccccctgccgcctccccttctgagggaggttactccaaggagggctcctccaattccaaagggtgaaccacaccgctgcactgctgttcaaagtaccatgagtgacagtacaaagtcgttgctggataaactgaaggatctcaaggacagtaagaagccactggacgacatggaaaagaatattaaggagcgtagggaaatgataaagaaagctcctgcatgactctaggggtttgctaatgctattttaanggtaaagactgggtngg

SEQ ID NO: 96722 - DNA, 347 bp, Triticum aestivum
  Clone ID: PAT_TA_96722
gttcggtcacggtggtatgtgttcgtctgtggtggtgttcttcggtgtcgcccctgttgttgtgcatgctcaagatctccatggctgccattgtggtgcggcgagcttcgtgctctcggcgttgtctcggttcatctttgttcagtgatgctacaatatgcctccccaacttgctaatcttcttgattttccatggcgaagcgcccagtcaaggttcgtgttagtcactcgttgatgtggatgctcctctgttgcgccatggtgctcagtacgcacgccggtgtggtgcgttaggctgcttgtcaagtcttggtattgtgatccctcaacggctcccccccccccca

SEQ ID NO: 96723 - DNA, 355 bp, Triticum aestivum
  Clone ID: PAT_TA_96723
cagagaacaaggtgtcctttttccatttgatttgagtacacgatatatagggcttataacgccgcccacacacacactcactggccagccactatccactagcacgacgtcgacatctcgaagtcagccgcgcgccatctccaggtcgcagcggaagaagggaagcggctcgccctggccgttcgctcggcggcggcggcggatgcagacgacggcgcaagcgatgatggcgaagaaacaggcaaccgccacggtggccgccagcgccacggccaccgtgtggagcgggccgggcggcggcgcgggaaccgccggcggcggaggaggtgctgggaacgccagaagggggaggccg

SEQ ID NO: 96724 - DNA, 222 bp, Triticum aestivum
  unsure (1)..(222): unsure at all n locations
  Clone ID: PAT_TA_96724
gtttcctgctagggttttggtcctttgttttcggcggcgcaagatgggggagagggtcangggaaccgtgnantggttcaacgtcaccaangggttcggcttcatctccccggatgacngcgggaagaccttttcnaccagnaaatnctccatcaagtccgcncgctaccgcaagncncaanagaaanactcccttaantntcganatcaatcaccggcgga

SEQ ID NO: 96725 - DNA, 428 bp, Triticum aestivum
  unsure (1)..(428): unsure at all n locations
  Clone ID: PAT_TA_96725
cggtttttttttttttttttttttttttttttttttttttttttttttttttttttttttttttncccaangggttgaangcacnanatgaatcactttaanatgcccgaggctcgtacaagccatcgaaaaaagaanattaaccttcanatnccangctactacnacctaaaanggaaanacagctgantangcncaccncaaatgaaccncaattgcccccatgcaatacctatatgaaatttcacngcaanattacactacttatattacattgtaaacancattatanccanctatgcnccagggaaaatcngcttcngcgctaccantcaanatttcaattcacctgaattgatnaattgccncaggttcaaccccaggggtgtcccttataaagnaaccanctaattttanccnccttcacg

SEQ ID NO: 96726 - DNA, 446 bp, Triticum aestivum
  unsure (1)..(446): unsure at all n locations
  Clone ID: PAT_TA_96726
tcgagttttttttttttttttttaaggttttcctcaatgtttaatattttgaaaatgttcatgaatttaaaaaatgttcatcgacttctaaaaattcatattttttaaaaaaatgttcatattttttcaaaagtttttgatgccttttaaaaaaagtacttanngggtttaaaaaagtgttcacattctaananaaaaanatcactttaactaaaaaattcatatgtgtgttttgcaaanaaanatgancaacaatgcatcantcctataaaaccaaancattatcgcaaagaaaatcngtagaaancgcttcccctgaacccaangggangaggcacanntntgaacggggcnantacaaaggtcactccngtactcaaccttgaccatgtgnacacaagggccngcccgttatgaatcaacctattntggntngctaaaccggg

SEQ ID NO: 96727 - DNA, 413 bp, Triticum aestivum
  Clone ID: PAT_TA_96727
ctgccacgtggactgctatgtcgtccgctggcggacggcaaatatgcaaaggtctttgccgtcccccagccgaggacaaatatgcataggtctttgctgtccgccagcggacggcaaagaacacccttaacacactaacgacctatagctcacacgtctgccgtccaggtcctttgtcgtctgctggcggacaacaaagaccatttcatctttgccgtccgccagcagacggcaaatatgcctttgccgtagctcgttcaaccagacctattgccgtctgctggcagacggcaaacgcatttgtcgtccgccatggcagacggcaaagttcctgattcttgtagtgtcatctcaaagcctacacatacccaatcctttgagtgaaagctttggaaatctcatacagttcaagt

SEQ ID NO: 96728 - DNA, 424 bp, Triticum aestivum
  unsure (1)..(424): unsure at all n locations
  Clone ID: PAT_TA_96728
ccgccgcctcccctccgttcgttcttcttcttcgggttgggtagtttacgtctacccaccagccatgggtaaggagaagactcacatcaacatcgtggtcattggccacgtcgactctggtaagtcgacgaccactggccacctgatctacaagcttggaggcattgacaagcgtgtcatcgagaggttcgagaaggaagccgctgaaatgaacaagaggtctttcaagtacgcctgggtgcttgacaagctcaaggccgagcgtgagagaggtatcaccatcgatattgctctctggaagttcgagaccaccaagtactactgcaccgtcattgatgcccctggtcaccgtgacttcatcaagaacatgatcaccggtacctcccaggctgactgtgctgttctcatcattgactccancacc

SEQ ID NO: 96729 - DNA, 415 bp, Triticum aestivum
  unsure (1)..(415): unsure at all n locations
  Clone ID: PAT_TA_96729
cagagatgccttgattaatctgagaaaatagccagatattacacaaacaccatcttagtgtacacacaccaactcctcctcccacctcgccgccggccctcccctcccctcctcccacatcacagctctggtggctaccggatctgccatatcccctaccaacccatccctcacacatcccatctctctcttgacgcagctcctcgtcgcgccacctccggcggntgattcaggctaccttcggcgagtcccgccattgcggcacagcccgacatcccctcacacagcgggagcgctctcatgcggggaagattcaatgctcgcgggcaacaaagcccaaccgcgaccttccctgatggctaagggcttcggcgtcggncccggggccgggtggcaagtcgtcctnttctcggcc

SEQ ID NO: 96730 - DNA, 439 bp, Triticum aestivum
  unsure (1)..(439): unsure at all n locations
  Clone ID: PAT_TA_96730
aaccagctagaccagcaagcaagcgagccatggcagcgacctcctcctcctcctacgccgtcgcggtcgctctcctctgcctgctcgccgccaatggctgctgcggctgccctggacccgcacctgcccccacacctacacctacacgtgcccccgctacccccagccccgtccccgttacacctccacctgcgccagctccccccagccccgtccccgttacacctccacctgtgcccgctactcccagcccaggctccggctccggctccggcaggaacaacagctcctccggggggctgggctagacgcgagggccaacctgggtatgggcgcaccccgaatggngccggggccgggacgncaattggtggtgcggttgtgggattcaaagaacggtgaaacctgccggccgtttcaaccgcccattgacgttcgg

SEQ ID NO: 96731 - DNA, 409 bp, Triticum aestivum
  Clone ID: PAT_TA_96731
gcgagatgtacatgctccgtggctacgcgaagcgcgcctacttcgtgggccctctcttctcgtcgttcctcaccatcccattccccggccggcggcgtggacgaccaacagccaccgtgcatcggctggctggactcgaagccgggccgttcggtggtgtacctgtgcttcggcagcctgacccacgtctccgacgctcagctgcgccagctcgctctcgggctggaggccgccgggaagccgttcctgtgggtggtgagggacgccgggaactggacaccgccggaggggtggtccgagcgtgtgggagaccgagggctcctcgtcacggcgtgggccccgcagacggcgatactggggcacccggcggttggcgcgttcgttgacgcaactgtgggtggaactccgt

SEQ ID NO: 96732 - DNA, 355 bp, Triticum aestivum
  unsure (1)..(355): unsure at all n locations
  Clone ID: PAT_TA_96732
gccttgggtgggaggttcttggatccggactaacaaacgccggccgtgtttgggagggcctcgttcctagcctatctcgtcgagaggatggcgacggcgagcatggttggcatgcccaagagcccccggtcggtggccttcgggacggctgcctcgcccttcggggacaggaggaaggcccggttctgcgtcgcggcgtgcggcagggacgaccagcagccgcccccgtcgatggccgcggtgccggcgtcgctgcgggcgatncaagccaagaggaagatggcggcncaagcgcgtngggtgcccncgggncgaatnactcncgcaagggtncgctggtnggncgccctcctcc

SEQ ID NO: 96733 - DNA, 288 bp, Triticum aestivum
  unsure (1)..(288): unsure at all n locations
  Clone ID: PAT_TA_96733
gcggcggggccctccagttatcgatctatctaccatctcgtcgtcttcgtcatcaagttatcttcagtgtcgtcgtcatcgtgttcctgtgtcagtcagtcttgagtcgtgtgtgtcgttcggtcctgtggtgtttttgatcgcgagctccagtgtcgctctgtccggggttaattagaagctggttacgcgaggaaaaaacaacaagtgttatnctttcaatcngtcngtccgtncntgttcntccgtnaatngaaaaaacccctctgntaagggntgggaattgat

SEQ ID NO: 96734 - DNA, 421 bp, Triticum aestivum
  unsure (1)..(421): unsure at all n locations
  Clone ID: PAT_TA_96734
cctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaacggcgaagttccccggcgaatacgggtgggaaaccgcggggctgtccgccgacccccgagaccttcgccaagaaacgggagctggaggtcatccaatggcggctgggccatgctccgggggcgctcggggtgggttttcccccgaagcttggtcn

SEQ ID NO: 96735 - DNA, 411 bp, Triticum aestivum
  Clone ID: PAT_TA_96735
gaaagacctggtcagtcgtggagcagaacctgttcctgccgtggatgtcgatctcataaagaagaagcgtgcggagaaaggtttggacgacgatggcgaccttgatgttagatggagggttttgagggacaaaagttctgaagatagtaaagtggtgctgtccaaggcggttggtattttccatgaatcatttgatcctatcatccaagctgggaccgggcgagacctgattccagccatggtctatgggaggagcgtaagggatcaagattacacagggatgtactgtgcggtgttaactgtcggcaagacggtggtttctgctggactcttccgtgtcatgggcaacgtaaccccggagctccccttgggcgcgacgagcaaggataaccaaggcttggggtactccaa

SEQ ID NO: 96736 - DNA, 358 bp, Triticum aestivum
  unsure (1)..(358): unsure at all n locations
  Clone ID: PAT_TA_96736
cagaaaagaatctaccgagttacctcgggatcatcgggccagcagcggcggcgccatggactcgtctcgcgtcatcctcatccccggcacgccgccgctgccgtangccgcctacgagcagctgccgtcctcctccgcggacgccaagggccaggaggancagcgggccggtggtggcctgaggtggngcgcgtgcgccgccgtgctggccgtgtcggccgtggtggcgntcgtggtcgccgccgcggtcttccggggccngnggggctggccngtgangcggtgggcgggaatcccgtgcccggtnaaccccnggtcgaactggnantttcccggcnggangcaagggggcactgga

SEQ ID NO: 96737 - DNA, 420 bp, Triticum aestivum
  unsure (1)..(420): unsure at all n locations
  Clone ID: PAT_TA_96737
gtgaaatcccaatctccgatcaccacagcgcagcagcagccagatccccagcccctccatcccaatggcccgcaccaagcagacggcgcgcaagtccaccggcggcaaggcgccgcggaagcagctggccaccaaggcggcgcgcaagtcagccccggccaccggcggcgtcaagaagccccaccgtttccgccccggcaccgtcgcgctccgggagatccgcaagtaccagaagaagcacggagctgctcatccgcaagctccccttccaagcgcctcgtccgggagatcgcgcaggactttaagaccgacctccgcttccagtcctccgccgtctccgccctggcaaggaggncgcccgaggggtaacttcgtccggctcttcgaggaaaacaaccctgtgcgccatcacgccaaggg

SEQ ID NO: 96738 - DNA, 151 bp, Triticum aestivum
  unsure (1)..(151): unsure at all n locations
  Clone ID: PAT_TA_96738
gttggcttctcctccccactcagtcctcggttcccggcccttttcggttcgttagggtttagtagtggtgactcntcactcnccntttctnncgttggtancanttanttnccgtgcctcantgcncnctgngctngcnattccattcatc

SEQ ID NO: 96739 - DNA, 421 bp, Triticum aestivum
  unsure (1)..(421): unsure at all n locations
  Clone ID: PAT_TA_96739
acgtacgcatcgtccgcgactccacgtgtagatacatcacagtctacaagtccacacccggccgttgttttggttttgcagcagcggttttcccagacgccctgactgaaaacacacactactgaatactcatcacagctcaagccgcaggttctcctcgtcgaattctgccatcaagcaatcatcgccatcgtcatcaccttcgaagaaggnctgggtggagggcttccacgcactgcttcgcctcgctgtcatggacaatcaaggaaatgttcaactttgatgcgccttgcgaagatnatctggacgtttaccccngattctcctcaacaagtggaaaggcttctccaagtaaggaagagatganttttcgcaacaatccccgaatgaggcgaggactatcgctcttttgtttggggaa

SEQ ID NO: 96740 - DNA, 218 bp, Triticum aestivum
  unsure (1)..(218): unsure at all n locations
  Clone ID: PAT_TA_96740
agacgccgcccgccgtcgccctcgccctcgacgccgcccgccgtcgcccgccaccccctctcgcccacgtacggcgcccgccgtnccctctcgccntcgtacgccgcccggctncctctcttcgccancgcagagcntcaggnccgccctcaangccgtccggccggnctcgctgccgcntgtgcacgcngcgtngtctctcnacacgagagcgagat

SEQ ID NO: 96741 - DNA, 461 bp, Triticum aestivum
  unsure (1)..(461): unsure at all n locations
  Clone ID: PAT_TA_96741
caatccaatccaatcccccgagagagagaagaggaggaagatgtcgggccgcggcaagggaggcaagggngncgcgaagngccaccggaaggtgctccgcgacancatccanggcatcatcaagcngntnatccggcngntgntgcgcaggggnggcntgaagcgcatctnggggctcatctacgaggacaccctgcggggtgntcaanatcttcctcaagatcntcatccgcnacgncgtcacctacaccgngnacgcccgccgcaaagaccgtcaccnccatggtnntcgtctangccggtcatccgccagggccagcacccctctaccgcttccgncgngcttaggtccgaggggcntnagncgttcaancctcgccattccngacngttncagacccgaacaattagnacgtggggnaattntatcctagtttgccngtcctanggggttcgngnnt

SEQ ID NO: 96742 - DNA, 441 bp, Triticum aestivum
  unsure (1)..(441): unsure at all n locations
  Clone ID: PAT_TA_96742
cggcgcctccacttctctgctccctcgtctcctcgcgcgcagggcccggcgaaagggaagcaagatgtacaccgccaggaagaagatccagaaggacaagggcgtcgagccctccgagttcgaggacaccgttgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctcgtcagggangctggagaagaaanttancggcaagggattttgtcttttgttgcaacaagaaaggattgtgangggcnaccaangnaagggttctggctgttcaagcgncctcgcaacaaggnncccttgacaagctt

SEQ ID NO: 96743 - DNA, 430 bp, Triticum aestivum
  unsure (1)..(430): unsure at all n locations
  Clone ID: PAT_TA_96743
ctcgcctcgaccctgcctgccttcacgtagaagcacaccaagaccgagctatccacctcgcctcgaccctgccttcacctagaagcacaccaagacctagcatggaccacaagactgccgcccggccggaaagcgtacgggcgttcgccctcgcccgcgccaccgtcgtcgtcttcgccatggccacagcggccgactacgtactcgaccgctaccacctctgcagcagccatagtcaggcttccttcatcctgccgtgcgtcagggtgacggccgcggcggccgccgagtggagggccctctggctcgccatggtctgctgcgcggtgctcgaggtgacccgtcgcggcgctggcactgcggcatccacgccgcgccctggncctcgcctanctccangctcgcgctcacatcgtccgccaactacatt

SEQ ID NO: 96744 - DNA, 445 bp, Triticum aestivum
  unsure (1)..(445): unsure at all n locations
  Clone ID: PAT_TA_96744
ccggcatctcgcctcgtcgcacttccctccagccccacacccagccagcacccggagacgagacgtgtacgtgcgcgtagcaccaacccgagcccagcggtgcgccgcagaaacaggcaggcagcggtgcgcggcgggacggaaggccagggtgacgtgcgggcgcgggccgggccagaggcctaagtagcgagcagcgccgatcgacggaccgaccggtcatgccgagcgcgctggggagcggcttcgccgggtcggtgaggctcaagtacgtgaagctggggtaccangtacctggtgaacccacttcctgacgcttctgctggtgccggtcatggcnggccacggtgcctcgagctggcgcgcctccggcccccggagaagctgcttcgcgctcttggggcgcccctctaaccttcgnacctccgtngnacattccnccttg

SEQ ID NO: 96745 - DNA, 463 bp, Triticum aestivum
  unsure (1)..(463): unsure at all n locations
  Clone ID: PAT_TA_96745
atcagctcctcctccccagcccacccaccaacccatcgcccgccgggacaccaccacggcaatggcgtcggngtcgcggatcctcctggtcgccgcgctgctcctggcggcgtcggcaatgacgtcggcgcagaaggcgaaggcgcccgcgaagccggcccccgcggtcgccgacgcgcccgcggccgtcgaggcgccccgcgaagcccgccccggccgcggncgacgcgcccggtgcggntgccgncgacgggaatncccccacgggacttgacggccatgctggagaanttcccgggcaagtagtccaaagttcgttgcaagctncctcaaagggagaacccgcgttgggngnacgcaantttnatcgcccagcctnaccggnccaagntacaacngggcctgaacattctttcgctcccaancggatcgccgccaatcgaacngggctcaaaggccgttg

SEQ ID NO: 96746 - DNA, 456 bp, Triticum aestivum
  unsure (1)..(456): unsure at all n locations
  Clone ID: PAT_TA_96746
gtccttgaaaaagcgcagaatagttggtgcctgtgaaaaaatatcgtcagtacaagtttcaatttctgtaagtttagatatatcacctgaataagtaatgatttgcggcgagtttctttgatgtcaattctgatccaagagctggtagtgcctcgtctcttcaccacatagattgcagctttctataggcggagtccaattgtgcagccggcaaatgctctgtgcattacgctctagtattttacccacttgaattataggtccctagagtccttatgtgatcaccagactagcacattatacagggcactgcgtattcactgcttttttctctttttcangcattgttactccttgcatttttaanttggcacatcanttttccantatccanggagggatacaatcaaacttangtgggttatgcaatacaacccactatccgggaanacttnt

SEQ ID NO: 96747 - DNA, 449 bp, Triticum aestivum
  unsure (1)..(449): unsure at all n locations
  Clone ID: PAT_TA_96747
ngattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaacgtcaccgcacctgcggtggnccctgcanngaagtactgatnggttcaatgccggcatgatangtnccggccctanaataaaaataaaangcncaagggcnaanttgagcangcgttcattcgnngcctatgccgtnntggtgtggtggnccaatg

SEQ ID NO: 96748 - DNA, 446 bp, Triticum aestivum
  unsure (1)..(446): unsure at all n locations
  Clone ID: PAT_TA_96748
cttccccgagctgctcgcccgcaacggcgtcaagttcggcgaggccgtgtggttcaaggccggctcccagatcttcagcgagggcggcctcgactacctcggcaaccccagcctggtccacgcgcagagcatcctcgccatctgggcctgccaggtcgtgctcatgggcgccgtcgaggggtaccgcgtcgccggcggcccgctcggcgagatcgtcgacccgctctaccccggcggcagcttcgaccccctgggccttgccgacgaccctgaggcgttcgcggagctcaaggtgaagggagatcaagaacgggccgcctcgcccatgttctccaatgttcggcttcttcntgcaaggccaatcgtcaccggnnaaggggcccccctncgaagnaacctcgcccgnacaacttttccgaaccccgtccancaaacaancgcctgng

SEQ ID NO: 96749 - DNA, 336 bp, Triticum aestivum
  unsure (1)..(336): unsure at all n locations
  Clone ID: PAT_TA_96749
tgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactgctctgcacattaagctccgtgctactggtgggaaacaagacaaaaactccaaggtcctggtgctcaagctgcgcttagagctcttgcacgttntgggaatgaaag

SEQ ID NO: 96750 - DNA, 458 bp, Triticum aestivum
  unsure (1)..(458): unsure at all n locations
  Clone ID: PAT_TA_96750
cttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctgtactgcctcgagcatggcattcagcctgatggccanatgcccggtgacaagaccgttgggggaggtgatgatgctttcaacaccttcttcagcgangactggggctgggaagcacgtccccccgtgctgtcttcgtagatctcgagcccactgtgattgatgaggtgaggactggcgcttaccgccagcctcttccaccccgnagcagcttnatcaantgngcaanggaggatccagccaaacaaactttcncccgtggtcatttacaccantttggcaaagggagnttgtttt

SEQ ID NO: 96751 - DNA, 452 bp, Triticum aestivum
  unsure (1)..(452): unsure at all n locations
  Clone ID: PAT_TA_96751
gcaagacggcgtccaaggaggccggcggcgaggcgaanacgaggggccggaagaagggcagcaaggcgaanaagggcgtggagacgtacaagatctacatcttcaaggtgctgaagcaggtgcaccccgacatcggcatctcttccaaggccatgtccatcatgaactccttcatcaacgacatcttcgagaagctcgccgccgaggccgccaagctcgcccgctacaacaagaagcccaccatcacctcccgggagatccangacctccgtccgcctcgtctcccccggggaagctcgccaagcacgcccgtctccgagggcaacaaagggccgtcaccanngtttnacctcctccctagattgcatctgcaattgcttggtatctatccttatcctaatctagtaggcgnactgtnggcttgggttnctgtttgcctttagnttggtggg

SEQ ID NO: 96752 - DNA, 384 bp, Triticum aestivum
  unsure (1)..(384): unsure at all n locations
  Clone ID: PAT_TA_96752
anacncctccctccccaacctaccggngcatctccgacgacatggcccgcaccaagcagacggngaggaagtccaccggcggtaaggcnccgangaagcatntggccaccataggccgcccgcaagtccgccccggccaccggnggcgtcaagaagccccaccgcttccgccccggcatcgtcgcgctccgggagatccgcaagtaccagaagancaccgagctgctcatccgcaagctccccttccagcgcctcgtcccgcgaggatcgcccangacttcaagaccgacctcctgtttccagtccttccgncggtctccgcgntgcanggaggcctgcctnggccttaacncgtcgggcttcttcgnaggacaccanccccct

SEQ ID NO: 96753 - DNA, 371 bp, Triticum aestivum
  unsure (1)..(371): unsure at all n locations
  Clone ID: PAT_TA_96753
cnangccaaaggtaatccantccgcacagaaatccccatctcaaaaccctagccctcatccccgatcccggcnagcgagatggccaacccgagggtgttcttcgacatgaccgtcggcgggcgcgccggcggggcgcatcgtgatggagctgtacaaggacgcggtgccgcggacggtggagaacttccgcgcgctctgcaccggcgagaagggcttcngcaangagcngcnagccgctgcactacaagggcagcgccttccancgcgtgatcccccgacttcaatttgncagggcggcnaacttcaacagggggaaacngcacccngcgggcgaagtccatcttncggggnagaaagttcgncctaccga

SEQ ID NO: 96754 - DNA, 468 bp, Triticum aestivum
  unsure (1)..(468): unsure at all n locations
  Clone ID: PAT_TA_96754
ttatagggagggacttatgtcaccacaaacagaaactaaagcaggtgttggatttaaagctggtgttaaagattataaattgacttactacaccccanagtatgaaactaaggatactgatatcttggcagcattccgagtaagtcctcagcctggggttccgcccgaagaagcagggggctgcagtagctgccgaatcttctactggtacatggacaactgtttggacctgatggacttaccagtcttgatcgttacaaaggacgattctntcacatcgagccctgtttnctgggggaaagaacagccaatgggnttctgttttggtagctnaatccaatnannaccctatttttaaaggagggggntcccgtttacntaacaaggtttaaccttccaatttggangggttaaccgttatttngntttcaaaanagccctancntgctcctanccgttttgggaggg

SEQ ID NO: 96755 - DNA, 461 bp, Triticum aestivum
  unsure (1)..(461): unsure at all n locations
  Clone ID: PAT_TA_96755
gcgcaaccgccgccaacaccactcctagagagtcctcgccgccggagaagcatcaagcaagatggccggaaggaaggccggcnacaggaanaangcggtgacccgctccgtgaaggccgggctccagttccccgtcggccgcatcgggcgttacctcaagaagggccgctacgcccangcgtgtcggctccggcgcccccgtctacctcgccgccgtcctcgaggtacctccgctgccgaggtcctggagctcgccggcaacgcggccanagggacaacaagaagacncgcatcatcccgncgccacctgnctgcttgccgttccngcaancgaccaaggagctccggnaagnctgcctccccgggcngtcancattngcccaacgggngggtgtgatccccaacatcnaantcccgntgcttgctttcccaaggnangttccnccggccggnctgccttg

SEQ ID NO: 96756 - DNA, 414 bp, Triticum aestivum
  unsure (1)..(414): unsure at all n locations
  Clone ID: PAT_TA_96756
ccaccttccgtcctccccccgtcgtcgcggctccagctagggtttctcgcccccgccctcccgccccaccgccggccccgtccgccatgtcnaagcaaggaggaaaggccaagccgctcaagcaggccaaggtcgccgagaaggactacgacgagaatgacctggcatacctccagaagaagaaggatgagcaaaaggccctgaaggagctgaaggccaaggcaggtnagaagggtgngctgggaggatctggtctcaagaagagtggggaanaaatgattctgcccacccattctnatactagaaaaatgataatctattctatctacctagcctggtgtcgcgcttncactatctnntggttgtaacanactaccttcaagttggtgttgagcanttggngcatcgttccgc

SEQ ID NO: 96757 - DNA, 398 bp, Triticum aestivum
  unsure (1)..(398): unsure at all n locations
  Clone ID: PAT_TA_96757
agacgatctggacccgccgccgcagaagccagcaactgccgccgtcgctgtcgccgccgcttccatggacagcacggtggacgcaatagtggcggcctacaaggcgctggtggacgccgcggcggcggccgccttccgcgagcccgaccgcgaggcggcgctgcaggaagtgcagcgctgcctgcacgccttcaaagagtcctgcgaccgcgccgaggacctcgtccgggcggccgccgccaccctcgatttcgcgcccgccgccgccacaaccctcgacgcactctgcaacaccgtgcacggcatcgagaaggacgcccaggccgcccccgacggcggagacgaggaggaggtgcangatgggaaagggccgcgcgccctcnccgncggcgggtccc

SEQ ID NO: 96758 - DNA, 407 bp, Triticum aestivum
  unsure (1)..(407): unsure at all n locations
  Clone ID: PAT_TA_96758
gttgacgcccatcgttgtcaatgcaaaggatgaatatcagaatcttgagtggaatactccatgctacaaagatcgccggaaaaattgtttaaggttgacggatgttcatcccaaagagccatgggtattgattgttgaaggttttcatatttggtattctctttacatttggaacattcaaaccaaggagagcatgggaaaaaaggcgagtgttagtggtgtgttggccaaatttatcccccaaaaacaatgggttataactgggaactcaagtggggatatcagaatgtggacggctccaacaatggacccatgcaatggatacatcgctcatcattccggtataacttcattgggccattcacccaaaccgtccattcctactttcgtatagtgatgatgccttn

SEQ ID NO: 96759 - DNA, 423 bp, Triticum aestivum
  unsure (1)..(423): unsure at all n locations
  Clone ID: PAT_TA_96759
tcgccgtggaggtcgctcctgggcggctgcctgggcggcgcggcgggcgaccacgaggcgaagaanaaggtccggccgcgctccggcggcggcggcggcggcgggctgcggcggctgtcattcacggacctgagcggcgcggcggacgaggacctgtccatctccctcgtggggtccaacctgcacgtgttcaccgtggcggagctgcgggcggccacgggcgagttcgcggacgacaacttcctgggcgagggcgggttcgggcccgtgtacaagggcttcgtcgacggcggcgtcaagccggggctcaagccgcaggccatcgccgtgaagctctgggaccccganggcgcgcagggccacaaggaatggctggctgaggtgatcttcctggggcagctgcgggaccccaanctgggtgaa

SEQ ID NO: 96760 - DNA, 370 bp, Triticum aestivum
  Clone ID: PAT_TA_96760
atcacggatgccaagcatggcatccagcaagggtcttcttgtgttcgctctcctgcttgcagctgctgctatcctcgtcgcctccactgatgagcaccctgaggccaagaaggaagagaatgaagccggcgtagagaacttcttccactttggcggaggccaccacgggcacggaggcggcgggggaggctatggcggaggcggaggaggttacggcggcggcggaggcggctacccaggcggcggtggaggctacggcggcggtggcggctaccctggccacggtggggaaggcgggggaggctacggcggcggtggctacccaggcggcggtggaggctacgggggtggtggcggctaccctggccac

SEQ ID NO: 96761 - DNA, 413 bp, Triticum aestivum
  Clone ID: PAT_TA_96761
caaggattgcaggcttgctccaccactagcttccgctgtccgccgttccaagaacgtagcaccagccgcgcagcgcagagcttggcgggggcgggtggccgcggcaagaagaattgatatggccaaggagacggtgcttctcgtccttgctttcgccgccgccgccgccttcctgtgctcgtgccccgccgtcgcctccgctcggaaggtgggcgagacgtgcgcgctgtcgcggaactgcgacgccgggctgcactgcgagacgtgcgtggtggacggcaacgtgcggccgcgctgcacccgcgtgacccccgtcgacccgcagagcaaggaccggggggctgccgttcaaccgctacgccgtggctgacgaaccacaactccttcgcgcggctgggcaaccaatcccaaac

SEQ ID NO: 96762 - DNA, 433 bp, Triticum aestivum
  unsure (1)..(433): unsure at all n locations
  Clone ID: PAT_TA_96762
tccattcccctcgccgccgccgccactccgccgctgccgccgccactccgccgctgccgccgccgagatgggtcgcgtgatccgcgctcagcgtaagggtgcgggctccgtcttcaagtcccacacccaccaccgcaagggccccgcccggttcaggtcgctcgacttcggcgaagcgcaacgggtacctcaagggcgtcgtcaccgatgtcatccacgacccggggcgtggtgcgccgctggccaaggtgaccttccgccacccgttcaaggtacaagcaccanaaggagctcttcgtcngccgcccgagggtatgtacaccgggcagttcggtctaactggcggacggccngaagccacccctcttcgntcggggaaaagtcctccccgctccggcntcggttccttnaagggaagggcgtcattcttgcn

SEQ ID NO: 96763 - DNA, 425 bp, Triticum aestivum
  unsure (1)..(425): unsure at all n locations
  Clone ID: PAT_TA_96763
ccgatcccgcaccgccgcccacgcatctcgagtagtttccangctcgccggagaagcagcaagcaagatggccggaaggaagggcggagacaggaagaaggcggtgacccgctccgtcaaggccgggcttcagttccccgtcggccgcatcgggcgctacctcaagaagggccgctacgcgcagcgcgtcggctccggcgcccccgtctacctcgccgccgtcctcgagtacctcgccgctgaggtgttggagcttgccggcaacgcggccaaggacaacaagaagacccgcatcatcccgcgccacctgctgctcgccgtccgcaacgaccaaggaagctcggcangctgctngcccgggcngtcaccaatcgncccaacggggggngtggattcccaaacatcaactccgtggctgctccccc

SEQ ID NO: 96764 - DNA, 424 bp, Triticum aestivum
  unsure (1)..(424): unsure at all n locations
  Clone ID: PAT_TA_96764
gccgcccgcagcaaccgaagccaagtttcgaagtcgccgccgaggaggagcagtcgaccagacgccatggcccgtacgaagcagaccgcccgcaagtccaccggcggcaaggcgccccgcaagcagctcgccaccaaggcggcgaggaagtcggcgccgaccaccggcggagtgaagaagccccaccgctacaggcccgggaccgtcgccctccgggagatccgcaagtaccaaaagaagcacggaggctgctgatccgcaagctacccttccaacgcctggtgagggaaattgcccaagactttcaagaccgacctccgcttccaagagccacgccgttgctgggcctccaagaaggcggccgaggcgtacctggtggggactcttcgaggacaaccaaccttgtgcgccaatccaagncaat

SEQ ID NO: 96765 - DNA, 350 bp, Triticum aestivum
  unsure (1)..(350): unsure at all n locations
  Clone ID: PAT_TA_96765
ctagtcttgagttttttttttttttttttttaacttaaatacggttcantagaaaaacaaatttagtacaaagagcatatggtcaagtacaatgctgatggatatttcactcacacaaaaggtgacatacatatatatttttttacaaagggagattgcctaacccatactaaaatagctatgtgcatgacttgggggaaaatatncaagaaaaagntaagttttaanaaccgnnatganccaaccaatcantaatcaatccaataaccnttncacaaagggtncacacaaaaaccgtanaccctntanacacttnaatatcgtgacacnggtgttatanngaactctac

SEQ ID NO: 96766 - DNA, 511 bp, Triticum aestivum
  unsure (1)..(511): unsure at all n locations
  Clone ID: PAT_TA_96766
ctcgcacacctctcggagctaggcggagcggcgatgtcggggcgcggcaagggcggcaaggggctgggcaagggcggcgccaagcgccaccggaaggtgctccgcgacaacatccagggcatcaccaagccggcgatccggaggctggccaaggaggggcggcgtngaagcgcatctcccggctcatctacgagggagacacgcggcgtctcaagattttcctccaaaacgtcatcccgcgacgccgtcacctacacaagagcacgcccgccgcaaaccgttcaccgcaatgacgttcgtctaccccttcaagcgccaagggcganccttctacgttttcngagtaattcgttggttnccccnggttgcngtaacgtanttttgactgtttctgtcctgtgtccncccgtanattttctttgganatggantttncnacgctttggngctcctttttccttccttgtttcanagntgtaacnttttcngcaatgaatatctttctgaccaa

SEQ ID NO: 96767 - DNA, 486 bp, Triticum aestivum
  unsure (1)..(486): unsure at all n locations
  Clone ID: PAT_TA_96767
aggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttgggtggagcttttgcccccaagccatcatccggtcctcacaaggccagggaagtgcctgcctctgatcctcatcctggaggaacagactgaaatatgctctcacctaccgtngaaattgcatctatcctttatgcagcgtcatattatggtttgatggaaaaggcccgcactgacaagactacctgctggttcaatggcatcatttccattccccaaactgggtgagaactaacaggttcctgtntgacaccaaggtcgcttccgcttaatcttcaaggacnaagatctaatttnaactctcaagtcagtcgtcaatttggcaaaangcaccatactcaaactatgan

SEQ ID NO: 96768 - DNA, 454 bp, Triticum aestivum
  unsure (1)..(454): unsure at all n locations
  Clone ID: PAT_TA_96768
ggttgttgtagcagatgaagccgtgtgtggcattcctgcaacaaaagtgtagcccactgagaatgccattcctccagacacaagtcgagcaacttagcagctgccagatcgtgcaataccaatgctgccagcagtttggcgcagttccagagcgaaccggtgccatnncatccacatcgtggggaagaggtatcattcaacaacaatnccaacaacaattgcaagancccaacagnaagacaacattaggcatgagnttttccctttaaaacnatnattggngggaaanatannttcccgggaaatgccagcagcaacaaaacttngggganaacaacaacaanattttcagngganttacaccttggaaanantcttgacaaaattntccccattgcagnntatcccccaaaacgggnngttacctaccactgccaaattcanacaanttccc

SEQ ID NO: 96769 - DNA, 292 bp, Triticum aestivum
  unsure (1)..(292): unsure at all n locations
  Clone ID: PAT_TA_96769
gccccccctccgatctcgccgagaaatctcctccgatcgaagcgaagccaaggctctctcgtcctcctccgcaagatgcagatcttcgtgaagacccttaccggcaagaccatcacccttgaggtcgagtcctctgacaccatcgacaacgtcaaggcaaagatccaggacaaggagggcatccccccggaccagcagcgctcaacctttgctggcaagcagttcgaggatggcccaacccttgcggnctnaaacattcannaagngtcaacttcancctgggnncaaggcc

SEQ ID NO: 96770 - DNA, 414 bp, Triticum aestivum
  unsure (1)..(414): unsure at all n locations
  Clone ID: PAT_TA_96770
gcaaagttcactgatttgaaattgcaggttccaagagtttatttggtcgatccaaatgatcatggactcgcagctagagcagttaccacgttagctacaacatggtggttatggcgaagcgcgatggagcagccttgggagaactcagcgtcctccggcggccagcggcgacacgacgccagtccgcggacttcccgcaagtnccntgcccaatacacgcgtnaagtncgcctngcgtcctgcaattacccactttacgccccngccgggggtttcagcaatttangccccntttattganccggaatccngaaaaggcccctanttctttccgttacccagctttaggaacnatccctncgggggttnnccgccnccccggnnttttaanggnatacaanaagcttccttccc

SEQ ID NO: 96771 - DNA, 217 bp, Triticum aestivum
  unsure (1)..(217): unsure at all n locations
  Clone ID: PAT_TA_96771
tcgcggctgaaatctccaccggtctagcctgagacctccggcgagacgccggcggcagcagcagtagagcagtgtagaagcgtccggccgcgtcgtatcaccggcgaactcgctaccgacggcgcgggccttctgcaatctgcctccgacaagctagtgagggtcgtgtgatgagctctgtgcttccgagtcccgaacgctgaactgnttntgaacc

SEQ ID NO: 96772 - DNA, 498 bp, Triticum aestivum
  unsure (1)..(498): unsure at all n locations
  Clone ID: PAT_TA_96772
atcacacacacggacacacctgcaagaggagcgagagcgtgaaccatggcgggcatgaggaagcagcaggtggtggcggcgctggtgctggcgctgatggtgctggcggcggcaccgggcggggcgcgcgcggcgtgccaggcgtcgcaactggcggtgtgcgcgtcggcgatcctcagcggggccaagcccagcggcgagtgctgcggcaacctgcgggcgcagcagccgtgcttctgccaattacgccaaggacccacctaacgggcagtacatcccgcagccccaacgccgcgcgacacctcaactcctgcggctccccttnccgcaacggctaagcccggcaggcccctggcgcatatgntactactgccgccttagatgtcangactatagctaacctaactgatgcttttgcctcaatgaacnactnccggtangtgggtccactatgatatctggatggataaattttgnacgngaaaagaggggggggcc

SEQ ID NO: 96773 - DNA, 375 bp, Triticum aestivum
  unsure (1)..(375): unsure at all n locations
  Clone ID: PAT_TA_96773
ccgccccccaacccaaaccctaccccgccgccgccgtcgccgacgcagcgcgcggaggcgacctcccaccgccgccaagatgcagatcttcgtgaagaccctgacgggcaagaccanaggcctggagggtggagtcctctgacaccatcgacaacgtcaaggccaagatncaggacaaggagggcatcccgccggaccagcaacgcttcaatcttcgccgtaaanacccnagggacggccnaaccttgcgattaaaattcaaanaggnttcaacttcaattggncncccttccnnggggggccaaaaacccagaagaactttaccagnccaagagnaaaccaaaaaaanggnnaatcccctttccaatttaaggg

SEQ ID NO: 96774 - DNA, 511 bp, Triticum aestivum
  unsure (1)..(511): unsure at all n locations
  Clone ID: PAT_TA_96774
gctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattgggtacaacaacaacaatttctagggcagcaacaaccatttccaccacaacaaccatatccacagccgcaaccatttccatcacaacaaccatatctgcagctgcaacatttccgcagcgcaactaccatattccgcaagccacaaccatttcgaccacaacaaccatatccacaaccgcaaccacagtattcgcaaccacaaagacaatttcacagcagcagcaacaacaacaacaacaacaacaatcctttcaacaattttggcaacaacaacggntcccaggcanggtgttgtattgcagcaacacaacattacgcangggaaattacaagtttggcacaaantctttcaactg

SEQ ID NO: 96775 - DNA, 183 bp, Triticum aestivum
  unsure (1)..(183): unsure at all n locations
  Clone ID: PAT_TA_96775
gcctcacactctctgatcacagtaggactagcttcagctagcctgcagcgtctgccactccgggcattttcttgcatcaaccacggcaatggccaccgctgatgtccagaacccgacggcngtnancggaaggaaggcgcccgcggntggagacncgnttcgccgccgangaggttctaaaaa

SEQ ID NO: 96776 - DNA, 186 bp, Triticum aestivum
  unsure (1)..(186): unsure at all n locations
  Clone ID: PAT_TA_96776
cctccccctctctcgatctcaatctccaggtgaggcacgatggcattgccgctgccctccgcggtcttcctcctgctcctcgtggtggcctcgccggtgctctgcgccgcgcagagccccatctcgcagccgccgtcgccgggngcgcaagnngttcccgttcttccgcccgacgcggattccgaa

SEQ ID NO: 96777 - DNA, 358 bp, Triticum aestivum
  unsure (1)..(358): unsure at all n locations
  Clone ID: PAT_TA_96777
cacacaccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccaancccccctgccaagcaaaatgacaacaagcaactttngttcccttcaagcattnctccaactaacttgacggaanctgcccgtgacntttggtttcaacccnttngggtntccaanccggangggaccggggtttantcagnccaantggntggccanggaatntttaaaaggccgacggatatg

SEQ ID NO: 96778 - DNA, 467 bp, Triticum aestivum
  unsure (1)..(467): unsure at all n locations
  Clone ID: PAT_TA_96778
atctcctcagcctccctgccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcacggagtgctcatccgcaagtccccttccagcgcctcgtccgtnaaatttgcccaagacttcaaagaccgacttccgcttccaatcctccgccgtctccgccctgcaaggagccgccnaggctactggtggctcttccagganacaactctgcgcatcaagccagngnttacatatcccaaggatcanccgccgcaaccttganaaaaggctaagtgatctgatcaagctcnctgtatnccgttactgattctcgt

SEQ ID NO: 96779 - DNA, 196 bp, Triticum aestivum
  unsure (1)..(196): unsure at all n locations
  Clone ID: PAT_TA_96779
aaatgaactaaccaaaacaagaccgggaccgtagctctcgagtctcgaccggccgcccgcccggccggagcctctagggtacgtgccgccgtcgaggagtgttgtggtaatcaagcggcttatctagtcgacgatctaagggtgtagaggccggccggcgcagcggcactnccancccaagcggtttttatttgga

SEQ ID NO: 96780 - DNA, 479 bp, Triticum aestivum
  unsure (1)..(479): unsure at all n locations
  Clone ID: PAT_TA_96780
ccaagatcccaaccccatctccagcctgccccctcccccagtccccaaatccgtagtcccgcgcgccgcgatggaggcgagcaagctcaaggcggccaggctcctggagcagatgagcgcccacctcgccaccgacgccggcaaggagatcgccaacaaggtcggcttcgtctaccaagctcaacatctcgcccaagaagatgggcgtggacgaagagatcttccgtccgtggacctcaagaagggcgccgtctccacaaggaagtacgaagggacgccggacgcggcttcaacttcaacgacgacganttcctcgccatcgccaagcggnaagcttaacccgcanatggcgttttaatnaagggcaagcttaaattnaaggggagatcnacgccgcccaaaattnanaccnggatcttccccaagcgttcaattntttaannccgattgccttcttccccatgattcggttanaaaaa

SEQ ID NO: 96781 - DNA, 419 bp, Triticum aestivum
  unsure (1)..(419): unsure at all n locations
  Clone ID: PAT_TA_96781
cccccatcgattctcgtctccctccgaccccagcggcggcgcacgtctggggctccgccggcggccggactaaatgagagcagttgcgggagcttcagggacggcgacacgaggctgacgcgcgcatgagcttcacggcagcaccttgatttcctccccagatnccaaggacataatggcggatatcccgttaggctgttacactataaantccaatgggagcccaaattgcaaatncacaatgtatgactggatanacttntcnccctttgctgtcatanatgnttgttgananaattagccttttancgtttcctttggaaagncatnatgactgactttaanancccttnaaaggnatantgtgcctttttngctgttccggcatttgaactctacccnggcacttttggggaatt

SEQ ID NO: 96782 - DNA, 327 bp, Triticum aestivum
  unsure (1)..(327): unsure at all n locations
  Clone ID: PAT_TA_96782
gcgaaacaacacacctctccccggtgaaaagcagcagcatccatggcccccaaggcggagaagaagccggtggaggagaaggccgagaagaccacggcggggaagaagaccaaggccgagaagaggccgccggcgtccaaggagggcggtgctgacaagaagggcaagaagaangcaagaagagcgtttgggactncaaaatttacatcttcaaagtgctgaancaaagtncaccccgacatcngattcctcccaaggcattttcatcaataatncctttatcaaacaattctttcaaaattcccnccnatttcnccaacttcccaa

SEQ ID NO: 96783 - DNA, 421 bp, Triticum aestivum
  unsure (1)..(421): unsure at all n locations
  Clone ID: PAT_TA_96783
ctagaaactaatgggttccccgggctgcaaggaattccggcacnagggtccaagggctgaagaagacaagagagaagaccctctctaaccaagtttgaggccatgtgcgctaataccaaggtaatagggagaggaagatgcnaaagggcaatgaggagagattggctcatgttaagtccaaggctgagaangacaagaganaagaccctctctaaccagtttgaggccatgatgttttcactcgagccctctcatttcctcgcataagttagatttgtgttgcattatattggtactganatacataatgtgtgcacatgtctcntgttggatgtttcaagacatgcttatgcagtgtttcctttaaacatttgggttcacaanaaccangctaatgaaatttacttctctggatgaaaaa

SEQ ID NO: 96784 - DNA, 205 bp, Triticum aestivum
  Clone ID: PAT_TA_96784
tgatattgtcggttgctccatcagacaaggagaatccttcagcagccaaaaaacgactaacaaggatcttgaattgcccattcataacttctgacattgctttctgcaattgatcttcacggctattattgcttccttcctcgtcaaagctaggattcaaacttgactgaccccacttagtatcattgtcactatcatcatcggg

SEQ ID NO: 96785 - DNA, 282 bp, Triticum aestivum
  Clone ID: PAT_TA_96785
gcaacccgttgggtcgggttacccgatgggtatgggcatgggtctgattgtatgcccatgggtagggtcgtgggtggatggtagacccgataagctattcgggcatgggtttgggagaggtcgacccggtcaaacctgacccgactgccaggttgagccaggcaccttgtatcttttggccattggcttttatttctgttttagtaaggtgttaatgttgactgtaattctagtcagttgatggcctcgctaattcaaagccatcatctcaaaaaaaaaaaa

SEQ ID NO: 96786 - DNA, 489 bp, Triticum aestivum
  unsure (1)..(489): unsure at all n locations
  Clone ID: PAT_TA_96786
attacgatgagtagccttcggtctagttctattttacttacaaattgtggttcatccggcacatacatgcatgcttctcaactatgccagacctcaaaggcaatgttacattgtcatgtatggctccgacgagcgcagcgggagcgccgcgatctcccgggtgcgggcggacgccgaccgccccacggacatctcctgctcgacgttcggcgacggcacgggcgccggcggcgccgccaccgacgacgcgaacgtggacgccacgctgctgctcacgccgctgcccgagccgccgcccgtggtggccgtggtcaccgtcatgaagctgtccgacgacttgggcggcggcggccgctcaagtccatgatccctcaagcatctgcacanctccccatctcggncgctgcacggtgctcctggatgcacaaaactcactgancgcgcgccaactgcgcattcaactctcccggcaaacgccggtcaagatgg

SEQ ID NO: 96787 - DNA, 350 bp, Triticum aestivum
  unsure (1)..(350): unsure at all n locations
  Clone ID: PAT_TA_96787
cttatatgcaggaacacaataattctttccaatagcaaaagcatggcaggaagcgaagcaaccaagatccagcaataatctacgcttattacaagcagaattaattagtagaaacatgcataaagcaggttaacaactaccatatgcagaattacataattctgatttcaatctcggcatggattgggccattgggtccatgatctacaactctggataaaaactcagtgcaaagcagagtggacagccactccanttacaagggtttttggantcaagcnagtncttggctctccccccgnanactngcantttgnatanacanttccgggggggggcccgtaccaatt

SEQ ID NO: 96788 - DNA, 411 bp, Triticum aestivum
  unsure (1)..(411): unsure at all n locations
  Clone ID: PAT_TA_96788
attatctaacacaaatcaaccatgaagaaattcctcgtccttgccctcattgtcatcgcggcgaccaccacggccgccgaaccctttactgcattccgtattgcttcggagccgcaacatccatcatctccagagcagcaaccaactctgcagccacaagaacatccagttccacatcaaaagttgaacccttgcangggatgcctcctanancantgtagcccaantgctaangttctttccccccggcaaaagttggtgaaaaaaacnatnccttggaaattggagaaattttttcangacttaaangtttcccannantcaaaatttagggactccaanttttgnacaccatntttttgcanaggnaanaattgacaagggntttaacaaacctangnangggaaaaa

SEQ ID NO: 96789 - DNA, 262 bp, Triticum aestivum
  unsure (1)..(262): unsure at all n locations
  Clone ID: PAT_TA_96789
cccacccccactcccacccccaatccgaggcgagaagaccaccaccccatcccggcggcggcggatcacgctgtgcgcttgcgcgcgtgcctgcggctngtgaggangagaaaaaggaaggataaaaagaggcgcgtcggttgcagttaggtangagatcgaggtctcgccccgcccccacgcactaaaaggcaacgctgcgctnggtttccaattttgaccgngcgnanactcccttngtgcggtgggntgtgcctttctt

SEQ ID NO: 96790 - DNA, 411 bp, Triticum aestivum
  unsure (1)..(411): unsure at all n locations
  Clone ID: PAT_TA_96790
gtcccctcccgccgccgcctcccctccgttcgttcttcttcttcgagttgggtagtttagctctacccaccagccatgggtaaggagaagactcacatcaacatcgtggtcattggccacgtcgactctggcaagtcgacgaccactgggcacttgatttanaagctttgganggattnacaagcgtgtnatcnnaaaagttcnagaaaggaaacccctanaataacaanagngttttnaagtaccctggggggtttacaacttcaagggcancttaaaaaggtcaccancnatattgtccccngggagantttaaacaccaagtattactgactccatttatgccccnngtaaccttattttttcaaaaanattaccgnactnccaagctaatgtgtgttttnanaacac

SEQ ID NO: 96791 - DNA, 165 bp, Triticum aestivum
  unsure (1)..(165): unsure at all n locations
  Clone ID: PAT_TA_96791
aagtgtcggagctcacaaggtccgccctggccgccgccgagcagaaagccagcgtcgcaggctcggctctcatgggcaaccagtacgtctcagccggggcttcctggctgaccagcgcgtttggcatggtgaccaaagcggcgggcataatgggtncaatggcaa

SEQ ID NO: 96792 - DNA, 280 bp, Triticum aestivum
  Clone ID: PAT_TA_96792
gtgtctggtcttatggaagggaaagctattcttctttgccttatggtgattgtgcagctcggaaattccattcatgctaaggactgctttattggaattgcatttggagccactttatgcacggaattaaaatgtcgtttgtcctgcatgacaaaatggggacccgaagtcaccaaatccgtactgtatcgaagtcatcccaaacttcaagcattgttactgtgttgtttgtgacacctaagagttgcactaagtcatgatgttcaatgatgtaccttaa

SEQ ID NO: 96793 - DNA, 453 bp, Triticum aestivum
  unsure (1)..(453): unsure at all n locations
  Clone ID: PAT_TA_96793
ggacactgctggtggaaaacacgggcgtacaggtacagagttaaggaacacacgacggttttattttattcagcgcgcgcgcgggcgggcgcatgcagcggctagtgatggtggtggtggtggtggtggttgcttgtccaagttgtcctcctcatcctcgtgctcgcctcgccggccggcctcctgggcgccggctcagttgcanctgcagcaggagcagccgcaggccgtgccgcacttgcaggtggtgcagtcgcancngccggtctccccgccggccgtctcnaacccgccggactccccttgtgggaagcggttgggcatncaatngaggcggccccggnggtggcctaancttcggggaaaatcttgcaccngncggaaccnttccnaacttcnacccctgaaattccccccggtantgggnnaacctctncnttcccngccaaancc

SEQ ID NO: 96794 - DNA, 242 bp, Triticum aestivum
  unsure (1)..(242): unsure at all n locations
  Clone ID: PAT_TA_96794
gccatccacatcgtggtagaggctatcattcaacaacaatcccaacaacaatggcaggagccccaacagcaagcacaacataagagcatgaggatgttgcttgagaacctatcattgatgtgcaacatctacgtcccggtacaatgccagcagcaacaacaactgggggcaacaacaacaacaacagttgcaggagcagttgacaccgtgnacatttcccctncaaaaagattttnccccaa

SEQ ID NO: 96795 - DNA, 408 bp, Triticum aestivum
  unsure (1)..(408): unsure at all n locations
  Clone ID: PAT_TA_96795
tcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagacctgtcctactnccaccgctcaacacggaggcctcctttagcaagtcgatancttattcgctncaatnggtgccttccncccatttaacnaggttggtcantttccgtnagaaaaacatccccttggtantannatggccgttatggaaatntngaactgctatttntggtgcacnacccnccattaantaaagg

SEQ ID NO: 96796 - DNA, 446 bp, Triticum aestivum
  unsure (1)..(446): unsure at all n locations
  Clone ID: PAT_TA_96796
ananggggntccgcngggggnaaacctcngggaccccacnancgggcaaggntgatcccggttcggnttggaaaatcggaaananaaattcagttnaaggnaaggttggtcncgnaaattnggtttnnaaaaactcaaagaaattttggggggtcctttaaccttcatctggagatgacggcttcctcaactgcctccccttnaacaaacagtttnatnagaaattcacaangcaaaangactcttgattacctgttcccaaagtcaaaaaggggaaggnccaaaaaccnggcaaaacatcnatttcaactttnaaaagcttttggngganaanttccccaattttgngcggaanctttncccantttttntgnccccaattttgggnaanaaattttttcccaaaaactttttttaaaaaaaaagnttttttttaaaaggggggg

SEQ ID NO: 96797 - DNA, 403 bp, Triticum aestivum
  unsure (1)..(403): unsure at all n locations
  Clone ID: PAT_TA_96797
ggaaaccaaggtgatcaggaaggcgagggatccgaggtggaacgaggagttccagttcgtggtggacgaggcccccatggacgagaagatccacatcgagatcagaagcagacgccgcaggctcctcccgttccgcacccaggagtcgctggggcatgtcaacataaacctggtggatgtggtgaacaacgggcgaatcaacgagaattaccactcatcaactccaaggaacggcaaacttcaactccaaattaaagtggacactgtcctnacctcaactcccatacatacataggtttgctatataccctatgggnaacaatcctttcaccctgaaagngttaattgttggaccttccgnccaaggnaanttttncntttttgccccatttcgaatttttgg

SEQ ID NO: 96798 - DNA, 340 bp, Triticum aestivum
  unsure (1)..(340): unsure at all n locations
  Clone ID: PAT_TA_96798
gagcatcgaagccaacttatagtacgtcaatccagacatccagcagtctctcagtttcgtgtccaagtacagacaggggagctatatggaccaggccggcgcgggggaggccacggcggtggcggcggctgtgtgcgtgacgggcgcgggaggcttcatcgcctcgtggtcgtgggagcgctcctcgccagaggagactacgccggtgcatggancgttcgtgaccccaacgacccaagaattacaccttaaggancttgacggggccggnnaacggttcggtntttaaggcgantncttgatanccanngttggtcncccnttngccggtnttccgggt

SEQ ID NO: 96799 - DNA, 425 bp, Triticum aestivum
  unsure (1)..(425): unsure at all n locations
  Clone ID: PAT_TA_96799
gccgccgccacccctcccctctgccccgtgccggatccgcctgccgccgccgccacgctctcctctgccccgatccccctcacctgcttcctccccacctcgccccgtgagccccgatcccctccttccccgctctccactatgccgcctcctcctctccttcatttttctctccggcggcggcgcccaagaaaggtganaagggnggggggttccgttgcctgaaaaaaaangggggggaangaaacccggnncgcggngggggntgaacccgggggaaaannaaaaanaggcccgttgccctcttcgctccggggccgcccttttngncccaaanggcaaagaaaatttttaanggcccncaaaggccnntttctggggtntncnaggaaaaagggctcnangggtcatgcccctaaaggaag

SEQ ID NO: 96800 - DNA, 487 bp, Triticum aestivum
  unsure (1)..(487): unsure at all n locations
  Clone ID: PAT_TA_96800
ctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactgggcccgcgctcttccgccaagtcctgggagaagaggagcgtcgatgacctcatcctttccgtcggatctggtggaggttggtgctcccagctgctgctgctgctgccccggctgctgggtggtgctgtgcgcggaaagagnaagaaagnnaagagaaaaaggaggaggcaaggaagaaacgatgatgaatgggctcancttgtttgactancattcattcaagtcncctggggaatctgctaagctaaaattactacttaaggctttaagttgattttccgtttgaaagtatccgn

SEQ ID NO: 96801 - DNA, 330 bp, Triticum aestivum
  unsure (1)..(330): unsure at all n locations
  Clone ID: PAT_TA_96801
gtcacaaaatagaaaaaagttactgagtttgtaagaagctcatcgattttgaaaaaaaagttcattgaatatgaaaaaagttcatcgaattggaaaaaagttcattgatttgaaaaaagttcactgaatttgaaaaatgttcatccagtttgctaaaaaagttcatcgattttcaaaacaagttcatcaaaaaatgaaaaatagttcattgatttgaagaaaaaaatcatccgattttgaaaaaagtcatcaatttacaaaaaantcatcttttgaaaagagtcacgaattaaaaaatattcatgaaacaaggaagaggaaaaatagaaa

SEQ ID NO: 96802 - DNA, 460 bp, Triticum aestivum
  unsure (1)..(460): unsure at all n locations
  Clone ID: PAT_TA_96802
gctcccctcacatcccacgccaagccccacgctcgaaccaccaccaccaccagcacccatggcacccaaggcggcggagaagaagccggtggcggtggccgcggagaagacggcggcggggaagaagcccaaggcggagaagcgggcggcggcgaccaaggaggccggcggcgagggagaccnaanngggccggaagaagggcagcaaggccaagaagggcgtggagacgtacaagatctacatcttcaaggtgctcaagcaggtgcacccggacgtcggcatctcctccaaggccatgtccatcatgaactccttcatcaacgacatcttcgagaagctcgccggcgagtccgccaagctggcgcgatacancaagaacccacatcacgtcccgggagattcaaacttccgtccgcctcgtctccccggcgagtcgccaaacacgccgtctcccgangg

SEQ ID NO: 96803 - DNA, 465 bp, Triticum aestivum
  unsure (1)..(465): unsure at all n locations
  Clone ID: PAT_TA_96803
tggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcagcagcaaccccaacagttggggccaatgtgtttcccaaccccaacagcagtcacaacaacaactccgggcaacaactcaacaacaacaattggcacaaggtactttttgcagccacaccaagatactcanttgaagtgatacttcattgcgccccgtacctggccaacatttgcgttttcangtgcgtttgtatagaccaccactaatntgcattccgtgtttngaacggatttgttcctactaataggaaggcccnanatanatattgttcacg

SEQ ID NO: 96804 - DNA, 466 bp, Triticum aestivum
  unsure (1)..(466): unsure at all n locations
  Clone ID: PAT_TA_96804
ggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccaagaacacacagggtctcatctttgttgtgggacagcaacgatagggaccgtgttgttnaagcaagggatgactccacaggatgcttaatgaggatgattacgtnatgctgtgctgcttgtgtttggctaacaanaaatnttccaaaatgccatgaagctgctgagattactgataacttgggcctgcatcccttnngccaangaactggtacatcccaaanacttttgctaaacnagggaaaggactgtttnaaagcctggacgggtgtccaacaaattgccaacaancctaattttcggnc

SEQ ID NO: 96805 - DNA, 452 bp, Triticum aestivum
  unsure (1)..(452): unsure at all n locations
  Clone ID: PAT_TA_96805
cccagttcgagttccgccgccagcaccaaccgaagccaagtttcgaggccgccgccgccgaggagcagtagacgcgccgccatggcccgtaccaagcagaccgcccgcaagtccaccggcggcaaggcgccccgcaagcagctcgccaccaaggtccgcctcatcccctcccttctccccatcatctgttccccttcctccgttccgatctgttcgatgtggttttgtttgctgacggtgattccgcgcgtgtgattgcaggcggcgaggaagtcggcgccgaccacgggcggagtgaagaagccccaccgctacaggccgggaccgtggccctccgggagattcgcaagtaccagaagacacggagctgctgattcgcaagtgccttccaacgcctggtccgcgaagattccgcaagacttaaagacggactccgctccaatcccangccg

SEQ ID NO: 96806 - DNA, 444 bp, Triticum aestivum
  unsure (1)..(444): unsure at all n locations
  Clone ID: PAT_TA_96806
agaccctctcatcaaggccaatgacactatcaagctcgacctggagaccaacaagattgttgacttcatcaagttcgacgttggtaacgtggtcatggtgactggcgggcgcaacactgggcgtgttggtgtgatcaagaacagggagaagcataagggaaccttccgagaccatccacgtttgaggatgcccaagggcancaanttcgcaacccgtctgggnatgtnttcaccaattgggcaaaggnaacaagccangggttagcccnccccnaaggnaaagggattcagtccaacaacaatttaggggcaaanggaacggantccccttncccannttgttgccnaggcgatttntaggggnttagnccctttttgcanaaccagtttttttgccaggggtaaacagttttccccnaaaacttttantttttccccatgttg

SEQ ID NO: 96807 - DNA, 483 bp, Triticum aestivum
  unsure (1)..(483): unsure at all n locations
  Clone ID: PAT_TA_96807
acattatctaacacaaatcaaccatgaagaaattcctcgtccttgccctcattgtcatcgcggngaccaccacggccgccgaaccctttactgcattccgtattgcttcggagccgcaacatccatcatctccagagcagcaaccaactctgcagccacaagaacatccagttccacatcaaaagttgaacccttgcagggatgccctcctacaccagtgtagcccagtagctgatatgtcgttcctccggtcacaagtgngtgcaacatagcagctgcttggtaatgtgggagcagtgttgtcaagcaactaaaagcgatncccaagcatcaagatgtggaggcatccacaacgtccgtgcacgccattatttgcaacaanaaaacattggtacaaggtactcaaccaacctcaacagcaacaacacaagtcaacaagaaatggncaggttctanccaccacaacacaacaacaacaanagn

SEQ ID NO: 96808 - DNA, 475 bp, Triticum aestivum
  unsure (1)..(475): unsure at all n locations
  Clone ID: PAT_TA_96808
ggaactctttctgtgctggcctcactgtcaaataaagtttacaacgatcaaggaattccagcagcattcaaagttccttctggggctgtgcttccatttggatcaatggaggatgcgctcaagaaaagtggatcactggaatcgtttacaagccttctagacaagattgagacagctgaaatcgaaaatggtgaactcgacaccctatcatccgagctacaagcaacagctccgctacttcaccaaccgaagaagcatcaaatccctgaaaataacttccccgaaggacggcggctgattcgtcaagtccagcgccaacgtggaaactggccgggatgttcagtgcaaggtttacganccaccccatgtcanctctcaagaccaacaattcnggccgcgtacgcggtctggnctcatgtacatccggagggcacctcaacgccggtggtggcngcccaaggggancaagaggcgn

SEQ ID NO: 96809 - DNA, 359 bp, Triticum aestivum
  unsure (1)..(359): unsure at all n locations
  Clone ID: PAT_TA_96809
tcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgctccaaaaaggggaacttccgnnggttcaaaatggcgggcgggnaaacggcgttgcaanngaaaactngaatntcgaaccntntnggggtccccgttaattaaatagacgganaaaagaccccgcgaaagaaccaggatntngggggnaaanagatcatattncacacacacc

SEQ ID NO: 96810 - DNA, 475 bp, Triticum aestivum
  unsure (1)..(475): unsure at all n locations
  Clone ID: PAT_TA_96810
gcaaggtgtggtcaatacaaatccaccatgaagacatttctcatccttgccctccttgctatcgtggcgaccaccgccacaactgcagttagagttccagtgccacaattgcagccacaaaatccatctcaagcaacagccacaagagcaagttccattggtacaacaacaacaattctagggcagcaacaacaattctaccgcaacaaccaccatttcgcaacaacaacaacaacaattctaccgcaacaacaatacatattntcaaccatctatccttgcagcaagcttaaccaatcaaaggattccncccaacancaatganccccngttgnaatgcacaaatccttgccnaagngcccaaagtttcaacaaagcaattnncaatggngatgcaacanaatntttccaacaatttccgcaatnccccaagantnccccctttagaaaccgtngtatcacctacccacatccg

SEQ ID NO: 96811 - DNA, 429 bp, Triticum aestivum
  unsure (1)..(429): unsure at all n locations
  Clone ID: PAT_TA_96811
cgcattccgaggggtccgagctcgccggagagggaagagagatggccaggaaggccgggagagaggaagaaggcggtgacccggtccgtcaaggccggcctccagttccccgtcggccgcatcgggcgcttcctcaagaagggccgctacgcgcagcgcgtcngctccggcgcccccgtctacctcgccgccgtcctcnagtacctcgccgccgaangtgctggagctcgccggcaacgccgccaaaggacaacaagaanagccgcattcttccgcgccaactgtcctcgccatcccgcaacgacnaagactccggcaactgtcnccggcgtcacatccgcacgcggcttcttcccaaatnaacccntnttttcccaaaaggctnnanaaaggccnanaaggagccattcccaaatnncccaagaaacc

SEQ ID NO: 96812 - DNA, 465 bp, Triticum aestivum
  unsure (1)..(465): unsure at all n locations
  Clone ID: PAT_TA_96812
tctcctcctcctcctgccaccgatcccgaaccagggaggaacccggcgcgaggagggcaaaggaagagaagaggagatcaccgagcccagcgcgcgcacaggacagcaggcgccgcgatctcgcgcaggagcggagatggggctcacgttcacgaaagctgttcagccggtcttccgccaagaaggagatgaggatcctcatgggtcggctccgatgcggctgggtaagaccaccatcctctacaagctccaactccggagagatttgtcaccaccatccccacaatccggtttaatgtccaaactgtngagtacaagaattanttcaacgttttggatntccggggtcaagacaaatttagcccctgttggagatacttccaaacaccaaggcnatttttgtccntngcacattacaaaactntnntttaggcaaaatacttaacggtctnataggatacctcc

SEQ ID NO: 96813 - DNA, 442 bp, Triticum aestivum
  unsure (1)..(442): unsure at all n locations
  Clone ID: PAT_TA_96813
ctcactcccacatacctcctctgcttctcctcctacctgctagctctcgagtgtttgtttgattggtaggcgctcctaagctagctagcaatggcggcccagggaagaggcagtgcagccgtggtcgtgtgcgtgctcctgagcgcggcggcggtggtggacgcggcggtgttcaacgtcggcgaccgcggcggctgggccttcaataccaactcctgggccaccggcaagcgcttcaaggccggcgactcctagtgtcaaagtacgacgcgacggcgcacactttgtggcggttaaccccgcggggtaaaaggcttcgccaagccggcaaagggccaagnctanaatccggtcccacggttacctcncaannggacaatanttcatatganattcctggacatgcattccnganaaatttcnttacgcgcctaacntttca

SEQ ID NO: 96814 - DNA, 468 bp, Triticum aestivum
  unsure (1)..(468): unsure at all n locations
  Clone ID: PAT_TA_96814
ccactactcatcttgcctcacacacttcactgctagctactagtaattcacttccttgggttctcgtgccaccgagctctctcccgccaagatgtcgacggtgacccctgcctacctcgaccagaggctcgccgccgccaagcgctcctccagagaggccgccatggcgggagccaaggccgcggccgtcgccaccgtcgccgccgcaatccccaccctggcgagcgttgaggatgctgcgtngggcgaagggcgcactcaaccaaaccggggcangcgctcatcatctccaccgtcgccggggatnggctacttcatcgtcgccgaacaanacaatctctcccatnggcaanggaanatcctttcnacaagcgccaaganactcnaagaaactcctttcaactaattaaaacngtataacaattcattagcaatgcgcgataactgtgtncgcaagccgtacntttg

SEQ ID NO: 96815 - DNA, 326 bp, Triticum aestivum
  unsure (1)..(326): unsure at all n locations
  Clone ID: PAT_TA_96815
gagcacggacaagtttaggcatttcatgtatggaggggaaaactactctatgctttctcatggtgcttctgctgctaggaaactgcgcacatgctgagaacagctgcaaagagcaccgtactttggagataggctgcataagaaaatattgtaggaaaaactgcaacagagactacgaaggacaccgtgtcaggaatgcttattgtactgggtttatccccttccgtcttttggtgtctgcgacgtctgttgacggctaagaantattacacatgttaaggagacaatgcaacatcacatgatgggttcattttacacaaatgatc

SEQ ID NO: 96816 - DNA, 489 bp, Triticum aestivum
  unsure (1)..(489): unsure at all n locations
  Clone ID: PAT_TA_96816
cccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtccgtgcattccatcatcatgcagcaagcagcaagcaacaacaacaacaacaaggcatgcatatctttctgccactatctcaacagcaacaagtggncaaggttctctagtccnaaggcaaggnatcatccaaccacaacaacaactcaatnggagngattaatnattgggttgcaaancttcatccagtgcaac

SEQ ID NO: 96817 - DNA, 279 bp, Triticum aestivum
  unsure (1)..(279): unsure at all n locations
  Clone ID: PAT_TA_96817
agagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagctgggggttccgcccgaagaagcagggggctgcattacctgccganncttctactgggtacatgggnnanctgtttgggnctgaatggacttacaatcttaatcgttacaaaggacaatgcttt

SEQ ID NO: 96818 - DNA, 471 bp, Triticum aestivum
  unsure (1)..(471): unsure at all n locations
  Clone ID: PAT_TA_96818
attcctgcagcctcaccaaccattctcccagcaaccacaacaaatatttccccaaccccaacaaacattcccccatcaaccacaacaacaatttccccagcctcagcaaccacaacaacaatttctccagccccgacaaccattcccccaacaaccacaacaaccatatccccaagcaaccacaacaaccgttccctcaagactcaacaaccccaacaaccatttccccagtccaagcaaccacaacaacttttccccaagcccaacaaccgcaacaatcattcccccaacaacaaccatcattgattcaacatctctacaacaacagttgaacccatgcaagattcctcctggcagcaatgcaactgtgtccttggtgtatccctccgggcatcatcttgccaccaagcgattgcaagtgatgccgnaacaatgttgtcaacaactaanacaatcctcnacaatccagtg

SEQ ID NO: 96819 - DNA, 334 bp, Triticum aestivum
  unsure (1)..(334): unsure at all n locations
  Clone ID: PAT_TA_96819
gttcatcaaggaggacctcaagaccaacgacacgcagctgcaggtgctcgccggcatcctcaacgtctgcgcgctcgtgggatccctcaccgccggccgcgtctccgactgggtccggccgccgcctcaccatctcgctcgccgcatgcatcttcctcgcggggtccgtcctcatgggctcgcgcccaactacgcangtcctantccgccgtgctntccggggtcggggtcgggaacccccanaattcgcccttttaccgtcnaaaattncnncgggggatatttccgtggtnaanacgtccccccnatatttngaaanatttgagaatccaaa

SEQ ID NO: 96820 - DNA, 394 bp, Triticum aestivum
  unsure (1)..(394): unsure at all n locations
  Clone ID: PAT_TA_96820
gccagcctcagctcacccgaagcaaagccagctagcacgcagcgcgcgatggcggccgcgaccatggcgctctcctccccggcgatggccggcaccccggtgaaggcctccagggcggcgcccttcggcgaagggccgcatcaccatgcgcaagacggcgggcaacccaaggtggcggcgtccagcanccgtntgtaacgntccgaacgcttctctacttcggccgtcttcggggannccccccagtactcacnggngantttcccggngactaagttggaaaccccggggttttcgnccaacccaaantttccaaaaacggagttggagtatcantgcncttgcatctcngggcgctcgtggtttttccccaatgttcccccanggttaattt

SEQ ID NO: 96821 - DNA, 483 bp, Triticum aestivum
  unsure (1)..(483): unsure at all n locations
  Clone ID: PAT_TA_96821
gcggaaggaggttgagtccccagcagtcagcacttccttctggtaattttggtactagtctcagtcccccttcacatccgaccactgaatatggtgctagcagaaggcatggttcccctccatatcagagatctgaacatgctgctagtggaagccgtggcccctatatgaacccacgaggatnaaggccctgcagactacgaaatggaaaggagaagtttcccctttcaccacgattttcccaatgtccaaggantacactgggtccaccactggaatatggtgctgccaagaagnattgcttccgtttaanacttctccnacccttgggcccctatatnaccacgagatttaggccctggcagactacgaaatggaaagagaatgttcccctttaacaacatttgccaatttcnaggananaccgtcaaccactgaataangggctaacaaaagnattnnccctttanatancncccccgg

SEQ ID NO: 96822 - DNA, 459 bp, Triticum aestivum
  unsure (1)..(459): unsure at all n locations
  Clone ID: PAT_TA_96822
gcaaggcctcctccccctactacgcctccccgccccagacctacggcgccagcggcggcggaggcggctacggggccccgccctcgtcccagccccagtcctacgggggcggttacggggccccgccctcctcccagccccagtcctacggcggcggcggctacgggggccccgcccgccggccagcccatctaacggnnggccggcgggaggctacggttgctccgccccgcgggcantcctaangcgcccgcttcctcgttcgcgcctaaggggccccgcccccgcggancccgtatggggcnctggcgtacnggagccgtttgcccgctctgcgttcggttccgccgggaacggcccaacnttgtngcttcttccaagcccccnacgcaacggaacngaccatnanacaagatngattcgcntcttcggtanaacaaacttanctccgaacttcan

SEQ ID NO: 96823 - DNA, 450 bp, Triticum aestivum
  unsure (1)..(450): unsure at all n locations
  Clone ID: PAT_TA_96823
agcagcacctggacgagctggtgcaggaggtggcgcggctcaaggccgagaacgcgcgcgtgctggcgcgcgccaacgacatcaccgggcagttcgtgcgcgtggaccaggagaacaccgtgctccgggcgcgcgccgccgagctcggcgaccggctgcgctccgtcaaccaggtgctccgcgtcgtccaagganttcagcggcgtcccccattgacccangnangaattgcccgcccgaacaacccttnttcccggcgntggaaattccgtaccctgcaacggccatgccaatggcggcaacggcaagcaaatccccantacgantcatttcnggttataatgggtcatattaggtncctgttnggaccgncttanctttngctggcaaagaaaaaatttacctacttggttctnctttagatatacaagggtattgctcaattttgta

SEQ ID NO: 96824 - DNA, 476 bp, Triticum aestivum
  unsure (1)..(476): unsure at all n locations
  Clone ID: PAT_TA_96824
gacgcccaaatgccccgccgcctcgggacgacctactccggccggatcgcagccgcgacgccgtccccctccggcccctccatcaccgtcaccgtatccggaacccctcccccgacgccgctcgacccccgcggttacccgctcccccgccgccacctcatctgcgccgccgccggcatcctccgttttcccgcctctcccaccccgctggtcgacctcgcagactacctccgcgaccgccgcctcacgctcaccacctccgaggcctctgagatagcaaggctctcccccgaccccgcccttgctctcgcctttttccgcttcgcccccgcttcctcccgggttccgtcacgacgccttctcatacaaccgcatcctgggtctcctcttccgcacaaggcggaccaaagcnagntctgcgtatctctcggagattgancggacgngtngncgggaaattcacgtgattnntggtt

SEQ ID NO: 96825 - DNA, 340 bp, Triticum aestivum
  unsure (1)..(340): unsure at all n locations
  Clone ID: PAT_TA_96825
cccccctccacctcctccccagcgtcgcctcccgttcggaaccccaagctcccccgccgccggcgaaatggccccgaagcgaggcggcaaggccccggtgccggcgaagaagaaggcggcggacaaggtggtgaacccgctgttcgagaagaggccgaagcagttcggcatcggcggggcgctgccgcccaagaaggacctccaccggttcgtcaagtggccaaggtcgtccgcattcaagcgccaagcgcccgcatcctcaangcaagcgctcaangtgccccggggctcaacanttcaaccgnaaccttcgacaaaaacttcgcaacaactngtttaa

SEQ ID NO: 96826 - DNA, 380 bp, Triticum aestivum
  unsure (1)..(380): unsure at all n locations
  Clone ID: PAT_TA_96826
accccgaagtgatctctcttattagatacccatggcgacatactcacatatgtttgtcacccttgtcatcctttctattctcagtgtccacttccaagcccaaggagcaacagaaagtgtcgcaactgacaactcagtacgtgacaggaagacaattgtccaagggacctatttgcctcaaagaaccgtttcaagacggtgcacaccatgcagaagttgtgcacaaaaaacttgttgctacgaatttatttgcaatgatcctacaaatccagtccacttgcgttggtactatgcccnatgtggctgtacaattgaaacttgtatatanttttaattttttggccgacaaaaattaatnggaattaagcatggantttgtg

SEQ ID NO: 96827 - DNA, 461 bp, Triticum aestivum
  unsure (1)..(461): unsure at all n locations
  Clone ID: PAT_TA_96827
accaggagcgccctccctcccccagccgcccgccccctccccacccaggaaaccagccatgaagggggccaaatccaagggcgccgtcaaggccgacaccaagttggcggtgaagagcaagggggcggagaagccggcccaaaaggggaagaagggcaaggccggcaaggaccccaacaagcccaagagggcgccctccgccttcttcgtcttcatgggcgagttccgcgaggagttcaagcagaagaaccccaagaacaatccgtcgccgccgtcggcaaagcggccggtgagagtggaanagcttnaagcgaatcggagaangcccctacgtggccaaagggcaacaagtcaaaggcgaattcaacaaggcatnccgctncaacaagggcganatgctgctnctgctgcccaaanaaagngcngcaaggagtanangangacttangaggatccgcatn

SEQ ID NO: 96828 - DNA, 479 bp, Triticum aestivum
  unsure (1)..(479): unsure at all n locations
  Clone ID: PAT_TA_96828
ctcctcctccacctagggttttgctgcctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattgggtgttgaagttcacccgttggatttcaccactaactgtggaaagatccgtttctactgctggggacactgctggggcaagagaanttggtggcttaaggatgggatactataccatggtcagtgtgcgattatcatgtttgatgtcacttcaaaggctggacctacaagaatgttcctacgtgggacaaggactntgcaagtttgtgaagaaanccccattgtgctgtgtggnaacaaggttgatgtgnaagaacagcaagttaggcaacaag

SEQ ID NO: 96829 - DNA, 475 bp, Triticum aestivum
  unsure (1)..(475): unsure at all n locations
  Clone ID: PAT_TA_96829
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagacctgtcttacctgccaacgctcaacaacggagggcctcctcaaagcaggtgggnctacctgatcngtccaagtgggtgccttgccttganttaaacaagnccnggtcanctttccgtngaganaatggtctccccggtantaacgaanggccctaatgggnatttgggaactgccnngttccggtgcaccnacncaacaagtgtnaacaagtggaggaggtcaanaagggatacctgacnctaantccgcannacng

SEQ ID NO: 96830 - DNA, 406 bp, Triticum aestivum
  unsure (1)..(406): unsure at all n locations
  Clone ID: PAT_TA_96830
actttatatggagaaggttggaactttctcattcctgacctcatctgtgatgctgagaatgggctactctggaaacttcatttagatctggaggctattgctgctagtacttctgatgctccttcgattttggaattccttcagagacgaaagtctgacctgagtatggttaaagacactaaanccttgcaatanttcgaacaaacaancttggnaanggagggcaaaaantttgggttgcaaagggaaatgggtancaatncttgaattcaaaacccccgtncnatnaaaccggtaggcgtgcccncggtgttagngaganctntganccaaaccaaagaccagttttaaaccctnttagnccccccgtggtttttcnaagaccccccngaacanaattgccctt

SEQ ID NO: 96831 - DNA, 478 bp, Triticum aestivum
  unsure (1)..(478): unsure at all n locations
  Clone ID: PAT_TA_96831
agcacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagtccggcgggttcgagacggccggggagaccggcggcttgcgactgcaccacctgcaagtgcggaccgcctgcggctgctcctgctgcagctgcaactggagccggggcccaagganggcggncggcaaaggcgacacgaggattaggaaggacaagcaagcaagcacatcacaacaattcacaacaaccancgttcatcacagccccgcatcgctcgcgggcgccgcgtgaataaattaaacaccttcgttt

SEQ ID NO: 96832 - DNA, 183 bp, Triticum aestivum
  unsure (1)..(183): unsure at all n locations
  Clone ID: PAT_TA_96832
gtcggcgtcgcccccccggttgagagagtcgtgcgtgnccccgcntgttctccgcctacggcccctcctctctctttgtntcccgcaaccaanaactaccccaanatnattcncatcaccaantnaatcccncntcggcccggcgggatctgcncatcntcctccactaaatnccgntcgatc

SEQ ID NO: 96833 - DNA, 442 bp, Triticum aestivum
  unsure (1)..(442): unsure at all n locations
  Clone ID: PAT_TA_96833
tggtctcttgttacctgatatgtacagctaccgtataacatcgtcatcatgcacagacctagctaagcaatgaacttcttatgtggcctggtctctttgaacaggtggtgctaagccatgctccttcatcatgcaattatattttggtgatgctcttgcacctacttgcacacaaagctccacaacagcaggagcatgaccataataatctcgcccactgtccaccagaattggtgggtcatgaggccgttgatgccacacaatcttttgaggaaccaggtcatccactccagccttcttccacttgtgttttccccgccagccctcaaacttaaatactccacacatcctggccttatgccctgatatcccaacatgcacttcanagcaattctcgcacactttggatgggtagaccaataggagttttgtcacacctaac

SEQ ID NO: 96834 - DNA, 257 bp, Triticum aestivum
  unsure (1)..(257): unsure at all n locations
  Clone ID: PAT_TA_96834
gcgcagtgtagtgttgccaggcacactccacctgtgtttcgtgggtggcatcgatcgagggagagcgagacaccatgagctacccgccgccgggcancgcgtancctccgacgggccagcacnaggngtantcgccntcgggcaacngttaccgctaccctccnccgggccaggagnagncgcancancangcctaccctccgncggcgtatngngcgccgtcgcncgtctngttcnactacnatcantttatggac

SEQ ID NO: 96835 - DNA, 426 bp, Triticum aestivum
  unsure (1)..(426): unsure at all n locations
  Clone ID: PAT_TA_96835
ctgttctcctccgcccctcctccgctcccaggttggtcgccgatcagtctccaaatttctctccactattattccttccaaatctcctggctttctattcttggggctcggtggtggtgtttttcccgcagctcagttttgtttcccttttttcttttttaccagaaagaagtgccgcctgtcccctccctccctccctccctctgccctcgccctcgcggcttaatcccaattgggttgggttggaggagnaacccaattggggattaatcnatcangaggaggaggaggaggattcncactcacnanancgaggttgtcngcttcctcatcgttcctgggattggcanngngcatcacgcacaantctggcgcatgagtagaatcatgnagctnnaaacagttttngggaggccnatccgttgc

SEQ ID NO: 96836 - DNA, 269 bp, Triticum aestivum
  unsure (1)..(269): unsure at all n locations
  Clone ID: PAT_TA_96836
ccgacggcgacccagccaaacccccacgatttcatctcctccaaacccaaccgccgccgccgccgccggctcctcgtcgccccgccatgccgccgcggaagcgcccgctggaaccgtcctcgggcatgccagcccaaccgggatgccaagcccgtcatttctccgggctcaaaattcaacttcggcccnggcccccgcncccgcctccgcgccggagattctgcctgcctcatcctcaanaacctcccggggccggancggaaggtcta

SEQ ID NO: 96837 - DNA, 293 bp, Triticum aestivum
  Clone ID: PAT_TA_96837
cgatcgcgtatgccctcagaaggaaaaatggcaaccagccctaggattcttctccaagacccggtaatccccatcttcgagtgcatgcaaccgtcctaagatcgtgttgtttcgtgtgccaagtcagactgtaaactcccaagattgctcatgattgcatactgtatttgcgagctttgctctgtatacacacaagggagaagctcccgatgctacgttgtgttctccctaagccacaggaactttccacctgagtccatgtgcaggtgaatcgaatacagagacttttgctg

SEQ ID NO: 96838 - DNA, 154 bp, Triticum aestivum
  unsure (1)..(154): unsure at all n locations
  Clone ID: PAT_TA_96838
aangatagtacnaagtagtgcagcgnagtgncgtgggganctggtcaagcgcancatcctagctcancnccatcctcacagcancnaacctccaaccaccgcngcgaccatgcntgcngccntggcgctcctcctcgccgccgtnctctgcctc

SEQ ID NO: 96839 - DNA, 251 bp, Triticum aestivum
  Clone ID: PAT_TA_96839
gagaccttcccgatccaaatcctcgtcgattcggcttggatctcgttcctctcgcacggagattactctataaatactccccacgtccgtctctgccgatttttttttgcaaaatccctctcacgtgccctagaacgccgtagtcatctcgccggagttccgctgccaggagcacttgcgccgcccctgaagctctttcatcagttgattctgtcactccaaaacaacaacgaggttgagcttacaagcaa

SEQ ID NO: 96840 - DNA, 383 bp, Triticum aestivum
  unsure (1)..(383): unsure at all n locations
  Clone ID: PAT_TA_96840
gcttctcctccccttccggttcgggttctggttcggttcgggttcggttcnagagagaggccgagtagctagcctagtctagggtttcggtagagaggaagggagatccatggcggngacngnctaccgctgcttcatgggcggtctcgcctgggccaccgacgacaataacctccagcaggccttcagccagtacggcgagatcctcgacgccannatcatcaacgaccgcgagacggngaggtcccgtgggttcggcttcgtcacnttcggcagnnangactctntgcnccangccatcnangagatgaacggcanngatctcgacnggngnaacatcancgtcaacgangcccantcncgcngttncggttgttgggggc

SEQ ID NO: 96841 - DNA, 491 bp, Triticum aestivum
  unsure (1)..(491): unsure at all n locations
  Clone ID: PAT_TA_96841
cccgcacgcacgcgcgagcatctccaactcctccccagcccccgcctccgattccacgcctcctctgcgcgcgccagatccggccggcgcaccgcctcccctggccgccgctggccggcggcaggcgtcacgcggcgggcctgccctcgccgcgcgctcgaccacagagagatcgctatcgccgtccactgcggggcccgagagcgcgaaggtcgggttggctacgggccgctgagcgagggcaatggcgcggcggtggcggccgtcgcaccttgtgttcgtcgcgggggtggcctatctcatcctcatctccctcaagttccgccgcgtcctcgaccttgccaccgccgacctcgccgccgttgactccgccttctcctccccatcctcaacggacaacttcccctctcctcccaggaactctctcctcaaatgcaacctgttcaaggtnaaacccttctggaacgctacaacgggttccctccccgaat

SEQ ID NO: 96842 - DNA, 521 bp, Triticum aestivum
  unsure (1)..(521): unsure at all n locations
  Clone ID: PAT_TA_96842
accacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcagcatgtccaccaactgcaacaatgtcaactagttcaatatataatccttcctacgtgcatcatggacgccctgcgtggagcttaattcnacgttgatggagtgctcatacatg

SEQ ID NO: 96843 - DNA, 548 bp, Triticum aestivum
  unsure (1)..(548): unsure at all n locations
  Clone ID: PAT_TA_96843
gcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccaagctgctgctgctgctgccccggctgctggtggtgctgctgccgctgaagagaagaaagaangagaaaaaggaggaaggcaaggaagagaacgatgatgacatgggcttcaacttgtttgactaagcaattcaattcaactctccctgtgggatctgctatgctaaagattactatctaagtgctttaagttgaatttgcggattganangtaattcngttgaaaactaagtancngtcaatgagtacgnaaacacctgggatggcntttaaaaagaaa

SEQ ID NO: 96844 - DNA, 276 bp, Triticum aestivum
  Clone ID: PAT_TA_96844
tttgaaaggagtactctttgattagtgatttcactcaaattaggaaaggagcaggtgctaaatccacacttcggtgctaattttggaccatagcccgctcaaagtcccaattggcatgtactatcatcgagcccataacccatgaaagcccagagcccatatcctggccgttgatcggtctcacggccagtgtgcagccgccacgtcaccgcgcccaatccccggaacggccgcaaaggtaagggtgagtggcgcgagcacgaggatgcacggaga

SEQ ID NO: 96845 - DNA, 560 bp, Triticum aestivum
  unsure (1)..(560): unsure at all n locations
  Clone ID: PAT_TA_96845
actccatcccagccaaacttttctctcgccctcgaagcagcagccgccgcagcatccatggcacccaaggccgccgagaagaagccggtggagaagacccccgcgggcaagaagcccaaggcggagaagaaggtgccggcgtccaaggagggcggcgacaagaaggggaagaagaagccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctcgcgaggtacaacaagaagcccaccatcacgtcccgcgagatccagacctccgtccgcctcgtcctccccggcgaagctcgccaagcatgccgtctccganggcacaaggcgtcacaagttnactcgtctaggtctcgtgcgttgatcttgtgttcttcttctcctcgtctgaggaatcgtagtactgtgtgtttctgacatgtcatttgtacaatggngctgctgaataat

SEQ ID NO: 96846 - DNA, 565 bp, Triticum aestivum
  unsure (1)..(565): unsure at all n locations
  Clone ID: PAT_TA_96846
aagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaaccatttcgaccacaacaaccatatccacagccgcaaccacagtattcgcaaccacaacaaccaatttcgcagcagcagcagcagcagcagcaacaacaacaacaacaacaacaaatcctacaacaaattttgcaacaacaactgattcatgcanggatgttgtattgcaacaacacaacatagcgcatgggagccacaagtttgcaagaaantacttacaactgggcaacaattgtgttgtaacagctgtggaagttcccgagc

SEQ ID NO: 96847 - DNA, 549 bp, Triticum aestivum
  unsure (1)..(549): unsure at all n locations
  Clone ID: PAT_TA_96847
agcgcctcccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagacttcgccaagaaccgggagctggagtgatccactgccgctgggcatgctcggcgcgctcggtgcgtcttcccgggagctgctcgcccgcaacggctcaattcggcgangcgtgtngttaaaggcngtccaaatttcaancaaggcggctcaatactcggnaaccaagctggtgaagcgaaanatctccattgggccgcaagtgtgnaatggcncntgagggtac

SEQ ID NO: 96848 - DNA, 557 bp, Triticum aestivum
  unsure (1)..(557): unsure at all n locations
  Clone ID: PAT_TA_96848
acaacaaccagtactaccgcaacaaccaccattttcgcaacaacaacaaccaattctaccgcaacaaccaccattttcgcaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcaagcaaccccaacagttgggccaatgtgtttccaacccaacaanagtcgcaacaacaatcgggcacaacctcaacaacaacaattgganaaggtactttttgcagcacaccangtactcaactgnaggggtgactcaatgngcccgtacctacaacgatgtgcgtgtaatgtnc

SEQ ID NO: 96849 - DNA, 566 bp, Triticum aestivum
  unsure (1)..(566): unsure at all n locations
  Clone ID: PAT_TA_96849
atcaccttttccacaacaacaacaacaccaacagctggtgcaacaacaaatccctgttgttcagccatccattttgcagcagctaaacccatgcaagctattcctccagcagcagtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacanggtactttttgcagccacaccagatactcagcttgaggtgatgactccaatgcgctccgtatcctgccaacgatgtgcatgttaatgtgccttgtacagaacacactagtgtgcattcgacttgnacggagttggtgctacggataaggaagtc

SEQ ID NO: 96850 - DNA, 557 bp, Triticum aestivum
  unsure (1)..(557): unsure at all n locations
  Clone ID: PAT_TA_96850
ccccagccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccagaaggagtccaccctccaccttgtcctgcggctgcgtggtggcatgcagatcttcgtcaagaccctcactggcaagaccatcacccttgaggttgagaagctccgacaccattgacaacgtcaaggccaagattcaaggacaaggagggattcctccggaccaagcagcgcctcatctttgctgggaagaactggaggatggtcgcacctcgctgactacaacatccaagaaggatcaacctcaacttgtcctgcgtctgctggtggatgnaatnttcggaagacctcacggnaagacgtacacttg

SEQ ID NO: 96851 - DNA, 549 bp, Triticum aestivum
  unsure (1)..(549): unsure at all n locations
  Clone ID: PAT_TA_96851
tcacaacaaccatatctgcagctgcaaccatttccgcagccgcaactaccatattcgcagccacaaccatttcgaccacaacaaccatatccacaaccgcaaccacagtattcgcaaccacaacaaccaatttcacagcagcagcagcagcagcaacaacaacaacaacaacaacaacaacaacaacaaaagcaaatccttcaacaaattttgcaacaacaactgattccatgcatggatgttgtattgcagcaacacaacatagcgcatggaagatcacaattttgcaacaaantacttaccaagctgttgcaagaattgtgttggtcaacacctatggcaanttcctggagcatcgcaagtgtcaaggcatccaaaatgttgttcaagctattattcctgcatcaacaacanaaacaacaacaacaaccatcggaccaagtgtccttccaacaanctctgcaacaatatccatttaggcaaggtccttccgggcatctcagcaaaacccacangacaaggntctgtcaacctcaacaacggcccagn

SEQ ID NO: 96852 - DNA, 541 bp, Triticum aestivum
  unsure (1)..(541): unsure at all n locations
  Clone ID: PAT_TA_96852
aatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagntcctccggccactgtttcagtcgtccaagtcagggcatcatccaactcaacaaccactcatatnagggntcaagncanttggnattganacctttccnaacaatgtnnaacnttttttccgancttantgncccaacaatcaacgggcaatttgccaacatancgcccggancaatggacaatggaaaatgganatttatgctaataggtaatgntcatcgntgcttanctgatcacaatatttgtnccatgaggataaatggcgtgcacn

SEQ ID NO: 96853 - DNA, 532 bp, Triticum aestivum
  unsure (1)..(532): unsure at all n locations
  Clone ID: PAT_TA_96853
ctccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtggatccccgacttcatgtgccagggcggcgacttcaccaagggcaacggcaccggcggcgatccatctacggcgagaantcgccgacgagaattcgtccacaagcacaccaacccgggatcctctccatgggcaacgcgggcccaacaccaacggtcccattcttcaatctgcacgtccctgcaattggtcgacggcaacactggtcttcggcgaagtcntccaggcatggactcctcaagaacatcgagaagtgggtcccgcancggaactgctcaaacaa

SEQ ID NO: 96854 - DNA, 520 bp, Triticum aestivum
  unsure (1)..(520): unsure at all n locations
  Clone ID: PAT_TA_96854
gtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattccgagaccctgtcttacctgccaccgctcagcacggaggcctcctcaagcaggtcgactacctgattccgtccaagtgggtgcttgcctcgattcagcaaggttgggtcatcttcccgtngagcacaaccatctcctgggtactacgatggccggtattggacatgttggaactgctatgttccgggtgcactgacgcacacagtnattaacgaggtggaggagtcaagaagganacctgaccctattcccnatcatcggttccacaaatctcaagtgcatgctcactcaccttcaaccacggg

SEQ ID NO: 96855 - DNA, 516 bp, Triticum aestivum
  unsure (1)..(516): unsure at all n locations
  Clone ID: PAT_TA_96855
gcgaaaacaccaccgcagctttccccggcgaagcagcagcagcagcagcggcatccatggcccctaaggcggagaagaagccggtggcggagaaggccgagaagaccacgacggcaaagaagaccaaggccgagaagaggccaccggcgtccaaggagggcggcgagaagaagggcaagaagaatccaagaagagcgtggagacgtacaagatctacatcttcaaggtgctgaagcaggtgcacccccgacatcggatctcctccaaaggcaatttccatcaataatnccttcatcaacgaattcttccagaacttcgcccgngattccgccaagcttggcaagtncaacaagaagccaacatttacttnccgggaattttnaactctcgttcgcttctgtcncccggggagtntcncaanacnccttttccccaagggaccaaggatttacatttacccncncttaaanctgcctggncttcccnnaatgtttnnnccccgggtntttatnccat

SEQ ID NO: 96856 - DNA, 541 bp, Triticum aestivum
  unsure (1)..(541): unsure at all n locations
  Clone ID: PAT_TA_96856
catctccaagaagaagccatctgtgaaccaagagctcaaattggcggagaaggcgttgcaggctcttgacgtagttcgtcgccaagagttcaccgcatacgaccccgtgctcaggcatcttaaacgcaatcgagttgacatcttcaacctagccttctttgacatttataaagagactagcttttctccgtgggtccacaacttcacaagataacaccaatgcatgancanttgtgcgatcttgtgtcaatgtaattacattaaggtacgcgaaccggcgtcggtttcccaatccaacatatttgggtaccattaatgcaagggatnaaagccgactatagatgtgtccatcctgtttaaggcgtngaaatggatgatccccattccatcaactccggcngatgatatgttancctttaatggtttcatgcccgagggcttgtcccggaagaaaanttattttgaggccnatttaaantcaagtntnatggagnatgattaaattttacaaagngtggganttttgatgggtccggtccan

SEQ ID NO: 96857 - DNA, 556 bp, Triticum aestivum
  unsure (1)..(556): unsure at all n locations
  Clone ID: PAT_TA_96857
ccaccaaagaccgtatttgatgcattccctcattataagaagtggtggccttcttgggacccaagaaggcagctcaactgcttgcaagcaagtgtggcaactgcaaagttcacagatcaaatccagcgtgctcttgcaagatcaggcaacccaagtgttcaagaaacatgtggtggatgagtgcaaaacttgggatcttgtctgggttgggaaaaataaggttgctcagttgggagcctggatgagatggatctctgctcggttcccaaagggaccacacaagggaatcctcaagacagagaggtacagtttccttgcgactccttccaagttgatacattgcttaccacctaacaattgcngaaggacatgtttncccaanggggtcaatgtgcgtcctttgccaaccggaattngnggaggantggngggtttnccaaaggcttggaattccccataggaaatggggtcggttnanaaaaggnaaactaataggaggttttaanggttgggggattaanccaccaaacaagnaactggttaaattccngnctta

SEQ ID NO: 96858 - DNA, 442 bp, Triticum aestivum
  unsure (1)..(442): unsure at all n locations
  Clone ID: PAT_TA_96858
gccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggctttcaaagtatgcctggggtgcttgacaagctcaaaggctaancgtganaggggtatcaccattgatattgctcctgtgggaaattccgagacaacaagttacccctgcactgtcaatngatgctccctggtcaaccgtaatttcaacaaagacatgataaccgggactcccaagctggattgggcngggctaacaattgcccaca

SEQ ID NO: 96859 - DNA, 522 bp, Triticum aestivum
  unsure (1)..(522): unsure at all n locations
  Clone ID: PAT_TA_96859
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgccccgtccaggtttgaggagaccaaggaggaggcgcccggcagcattttaggcagaggagacgaaggaccccgagcaagcaacttccggccgaaccggaggccgagcgccgccttgtccnagacaaagaccaaggaggcntttgttaggaaancccggcggcggcnaagaagtttaaggaaaaagccgcgcctgctgcccaaggcgacccgcntccccctgttgctaagaacaccgtnggaggacccccgcnccgtggaactcaactnttaagngccaacccgcggaggaagag

SEQ ID NO: 96860 - DNA, 519 bp, Triticum aestivum
  unsure (1)..(519): unsure at all n locations
  Clone ID: PAT_TA_96860
gctgaagctcttaaaggcgtcaagatggagttgatcgatgccgcatttccacttctcaagggagttgttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggtttgggtgttgccaacccagcaaacaccaatgctctcatcctgaagganttgctccatctatccctggagaaganatcattgtttggacccgcctaaacacaacaaggactccgtcagattctgagaactnggtgtccaatttcctgacgtgaagaatgctattatcctggggtancaccctccatcattaccctgaagttnacacccactgtgaaatcccantgggaganaacctgtcntgacttttcaanatgataaggtaaacgggatcatnccccng

SEQ ID NO: 96861 - DNA, 518 bp, Triticum aestivum
  unsure (1)..(518): unsure at all n locations
  Clone ID: PAT_TA_96861
gcgacctcctgtttccgcccaccttctccggctccggcgccggcgaaccaatcgcggatcgagcgattcctccgatcaggagaggcgagccgggaggaagagcacctacgcgggaggagacgagatggggctcacgttcaccaagctgttcagccgcctgttcgccaagaaggagatgcggatcctgatggtgggtctcgacgccgccggaaagaccaccatcctctacaagctcaagctccggggaaattctcaccaccatccccaccatccgggttcaatgttgaaactgttggagtacaagaacatcagcttcactgtccnggatttcggggntcaagacaaattaaggcaatntnggagnattacttccaagacaaaaaagnccaacttgttgtggcaacaacataggacgtgttgtttaacaaggatactccaaagatctgataggatatttacttatccgtctctngtgtttgcaacaacaantnttcaaatgcataatctgctgaatacgg

SEQ ID NO: 96862 - DNA, 511 bp, Triticum aestivum
  unsure (1)..(511): unsure at all n locations
  Clone ID: PAT_TA_96862
cgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttgggcaacaggatcatcaagaagaggttccatgtgcgtgtgggacacttcagcatccaagtgcaacgaggattcctccagaggaactcaacaacnacaactgaagcggagcaagtgcgttgtgaggcatcacacaagagcaaccacaggccaactggttcatgtggagggacacaatcaaangcacccaccctacactctcaacnttcaaggngttn

SEQ ID NO: 96863 - DNA, 472 bp, Triticum aestivum
  unsure (1)..(472): unsure at all n locations
  Clone ID: PAT_TA_96863
caacaacaacaacaacaaccaccatgttcacagcaacaacaaccatttccacagcaacaacaaccaattattatactgcaacaatcaccattttcgcagcaacaacaaccagttctgccgcaacagcaaccagttattatactgcaacaaccaccattttcgcagcaacaacaaccagttctaccacaacaaccaccattttcacaacaacaacaacnacnacatcngcancaacaaccaccattttcgcagcaacaacatccagttctaccacaacanncanccattttcacaacaaccaccatcntcatttccgcagcaagcatgcaaccatcttcacancagccaancttttccacaacancaccagcagtttcnataagcaacgaaatccctgctnggtcaancaanccggtttgccngcaggttntncccanggncagggnggtccctcccaacagnaagngttccc

SEQ ID NO: 96864 - DNA, 292 bp, Triticum aestivum
  unsure (1)..(292): unsure at all n locations
  Clone ID: PAT_TA_96864
tggatacaatacnnaggcatgcaagtccanctgaaanntcntcctcttggcnncacgtcatgtctctcacgtcgtcgtcgctgggttccgcntccggcagctgngtcncatgggctggcgttttcggaccgatcttctgccacantggngcacactatgtgttgcanccacanttgtggcaacttcacccccggtgtcgagcattaccctgaatggaatggacatctcgcctcaatattctcnnccatgangccaatacactcgccagagttgtattgctgccaangagctc

SEQ ID NO: 96865 - DNA, 546 bp, Triticum aestivum
  unsure (1)..(546): unsure at all n locations
  Clone ID: PAT_TA_96865
gcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcaagcagagtccaangngttctatccnaaaatnaaagggtgactancaaaagtaccttgcgggagtttaaggcgggtgctnanaaggaaggagcaacttanaaaactccctgttcaaaacaaatccggccaaggacatcccgcttggtnacntntcctancaaaccacncccctttanggnttgggcnttcactcaacttctc

SEQ ID NO: 96866 - DNA, 495 bp, Triticum aestivum
  unsure (1)..(495): unsure at all n locations
  Clone ID: PAT_TA_96866
gcaacccgtgaggagaatgtgtacatggccaagctcgccgagcaggctgagcgttacgaggaaatggttgagttcatggagaaggtcgcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtccaaggtgttctatctgaaaatgaanggtgactaccacangtaccttgcgggagttcaangcgggtgctganaagaaagaancagctgagaacactccntgtancatacaagtccggccaaggacaatcgcgcttgctgaant

SEQ ID NO: 96867 - DNA, 512 bp, Triticum aestivum
  unsure (1)..(512): unsure at all n locations
  Clone ID: PAT_TA_96867
cgcgcgccaccggcccactctccccctcctcttctaccgcgacctcgctataaaaacggagccaccagctcgcgagtccagccagccaggcaccgcacaatggaagccacctcgtccctcacgcgctccctctccctcgtcccccgcccccgccgctcctcccgcgccgcgaagtccccggcgccggcgccgcgcgtcctcccgctccgccgcgccaggtcggacgccgacctcctcggatccgtccccgccgcggcgccaggctccgccggctccgtcctcctccgctcgccccgcccangcaccctcggggagagagacgacgcgccgatggaagactgcttcgacggctcgggcgcccggcaaggggaancaacagctccgggcgcgggggggggaacggangcgccggcnggaacggcaaagccgccgnattgggggagcataccgcaaggttgctaaggctggaagccggacaacccgctgctgctngcgcaacttacggaaantnc

SEQ ID NO: 96868 - DNA, 540 bp, Triticum aestivum
  unsure (1)..(540): unsure at all n locations
  Clone ID: PAT_TA_96868
ccctctcctccctcgcttcctccgccgccgccgccgccgcgatctcctcctccccgggctgccctccttccaaaccctttcacgatccaaaacctcttcatctttccgtcagactattctcccgtttcgccaaacctcaatcgctctcctgctccgggccgcatgtcccccgcgccgccaccggcgacggatcgggtgctgggaaccgtgggggcgactcgggaggaaacggcggaaaagatggaggtggaaacgatggcgacggcggcggcgaagacgactacgaggaggccgagttcgggccgctgctcggcttcagcgaagtggngcgcctcgcgaacgcccgcggngtcacgctcccgggccgacatgattgaaagcnggcaaaggacgccggnatccgggaatggattttgctccgaatanttgatttgcaaggccgcaacaaggggcantccccgccgaaagattcgggggcttctcaatgntccgcaanaaaaatgtcgccgatncgggaaatttcctcaaangtgggaaang

SEQ ID NO: 96869 - DNA, 466 bp, Triticum aestivum
  unsure (1)..(466): unsure at all n locations
  Clone ID: PAT_TA_96869
cgagaccccaaccccccgcgtcgcctcctccactccacctccccctttcctctcccctcctctcctttcgcatccctccctccgtccccatcgcatcgcaaccggcgcatcgacgagtgagccgcgccagcacggtattccgagcctgcctgcctcggcgcgggcggtggcggggtgagagagggggagggggcggggagatcgatcggtcggtcgggtgcggagagaaggaggagacgcgatggcgcgggagcggagggagataaagcggatagagagcgcggcggcgcggcaggtcaccttctccaagcgccgccggggcctcttcangaaggccgaggagctctccgtcctctgcgacgcccgaagtcgcgctcatcgtcttctcctccaaccggcaannttttccaagtttcgccaanctccagttatgaaatgagattaatcgaanaaagtataagnaacg

SEQ ID NO: 96870 - DNA, 163 bp, Triticum aestivum
  Clone ID: PAT_TA_96870
tttttttttttttcacaggacaactatttgtggtttatttaatagccaacggcaggaactaacagcaaatagtaccattcacgtgtacacccaaccagaaaactttgcgccattcagaaacagcatgctaccgtgaccaagtcaaggtcacggtgcatgccac

SEQ ID NO: 96871 - DNA, 549 bp, Triticum aestivum
  unsure (1)..(549): unsure at all n locations
  Clone ID: PAT_TA_96871
gccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtattaacganggtggaggangtcaangaaaggagtaccctgancgccctaagtccgcaatcaacggnttccgacaacaatgcgtcaaggtgcaantgnggtcaggnttnaancggncttnaangcacccggggttntgaaggagtnccggaaanggnctaa

SEQ ID NO: 96872 - DNA, 513 bp, Triticum aestivum
  unsure (1)..(513): unsure at all n locations
  Clone ID: PAT_TA_96872
gcagcagccagatccccagcccctccatcccaatggcccgcacgaagcagacggcccgcaagtccaccggcggcaaggcgccgaggaagcagctggccaccaaggctgctcgcaagtcggccccggccaccggcggcgtgaagaagccccaccgcttccgccccggcaccgtcgccctccgcgaaatccgcaagtaccagaagagcacggagctgctcattcacaagctccccttccagcgcctcgtccgggagatcgcccaggacttcaagaccgacctccgcttccagtcctccgccgtctccgccctgcaggaggccgccgaggcgtanctcgtcgggctcttcgaggacaccaacctgtgcgccatccaagccaagcgcgtcaccatcatgcccaagggcatccagctngcccgccgcanccgtggggaaaagggctaaggccttgggtcgcccggantacgggtaataactgttcttgncctgggatncccggtgtgtgtcngggggc

SEQ ID NO: 96873 - DNA, 493 bp, Triticum aestivum
  unsure (1)..(493): unsure at all n locations
  Clone ID: PAT_TA_96873
gcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctctccaacttcatgaagggaaaggaggagaagaacattgctgtggttgttggtacaatcacagatgacatgcggatncaagaggtcccaacaatgaangttaccgctctgaggtttaacagagacaagcgaagggcaaaggtttgcaatgcttggtnggggaattgcccaacttttgaccaancttgnantcccgtngntccaaattgggganaaaaaccattcttttttangggggacccaanaatg

SEQ ID NO: 96874 - DNA, 539 bp, Triticum aestivum
  unsure (1)..(539): unsure at all n locations
  Clone ID: PAT_TA_96874
gcgagcgaatccgaatcggcggcattgcacgcagcgaggaacccacccaccgacccatccaatccatctccccccaacccaatcttccggcgaaagagaggccatggcgacggacgtgcagatgggcggcggcgcggcggaggcggagaccttcgcgttccaggcggagatcaaccagctgctctcgctcatcatcaacaccttctactccaacaaggagatcttcctccgcgagctcatctccaactcctcagatgcgcttgacaagatccggttcgagagcctcaccgacaagagcaagctggacgcgcagccggagctcttcatccgcctcgtccccgacaaggccaccaagacgctctccatcatcgacagcggcgtcggcatgacaaagtcagaccttgtgaacaacctgggcaccatcgcgcgctccggcaccaaggagttcatggaggcgcttcaagcgggcgcggacgtgagcatgatcgggcaattcggggtcggntctantccggctaactcgtcgccganaaagtggt

SEQ ID NO: 96875 - DNA, 179 bp, Triticum aestivum
  unsure (1)..(179): unsure at all n locations
  Clone ID: PAT_TA_96875
ctcgngttnttttttnttttttanntctgctttanangagtggtgtacaanggtaacctcttttagtgctnccnanttgagacttgnagatggagtnaaactgaatttggtctggtttcattgatcaatgcaatggagccggggctctcgagcccttttcctctaaannaaaaggaagc

SEQ ID NO: 96876 - DNA, 217 bp, Triticum aestivum
  Clone ID: PAT_TA_96876
gttggagatgcccttaagagctctgacgcttacttctcttgcagcctgttcaattcatggctaacgttggatgttctgcgcctcggatggtcattctgatgagtgataaccagggcagttaaattacatcgcgatggataggttatgcagcaagagacatgagtgttgggcttcaagatgaaagtcaaaactgagccctcatgataaaaaaaaaaaa

SEQ ID NO: 96877 - DNA, 574 bp, Triticum aestivum
  unsure (1)..(574): unsure at all n locations
  Clone ID: PAT_TA_96877
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttcgtcgctgtgttttcctcncgagaaaaanttgggggtcctggtgtcaaatatccgggaaaacccccgtgaanaaaaattttaangattggncntggctgcaanaaaanggttcccttc

SEQ ID NO: 96878 - DNA, 554 bp, Triticum aestivum
  unsure (1)..(554): unsure at all n locations
  Clone ID: PAT_TA_96878
ggcgagaacaccgcgcacctggtgaagcacctcctcatagtggccatggacaagaaagccttcgaccggtgcaacgcggtgcaccccttctgctactggttcagggtggagggcatggacttcgcggcggagcagaagtacatgaagggggactacctggagatgatgtggaagcggaaccggttccagcagaccatcctggagctgggctacaccttcctcttcaccgacgtggacatcctgtggttcagggacccgttcccgcgcatgccgccggcggcgcaggtggtgatgtcgtcggacttcttcgtgggcgacccgggctcgccggggaactaccccaacggcggcctcctctacgtccggtcctgcgccggcagcgtcgggttctacgagcactggcaggcgtcgcgcgcgcggttcccggggatgcacgagcagtacgtgttcgacaagatctcaagganggcgtgcccgggcgcctcggaacaaggtgcanttcctcnanacggggcgcttncggggggtctggcaanacgggaagggnctggggn

SEQ ID NO: 96879 - DNA, 163 bp, Triticum aestivum
  unsure (1)..(163): unsure at all n locations
  Clone ID: PAT_TA_96879
nccgggagaaatcanggaagcaaaccancacactccctccctccctctcttctcnccttcctccctcnatccctcccacctgaccancgncagatntgnccagccaagctctccccncaacncctgnggttggctcagatcacggacctccctcncacatcct

SEQ ID NO: 96880 - DNA, 298 bp, Triticum aestivum
  unsure (1)..(298): unsure at all n locations
  Clone ID: PAT_TA_96880
gtcagcgacggatcctgcactcccttgggcgtgcacctccagcctcgtaccccagcgccgcccctcccactagtacctcccctccctccgttttttccttcttcccctgatgcacggaggccgccctaacccgctccggccacacctcccccgaccccgccgccgggcactacccncgccccctgcacggcctcgcgctgccgntgccccttgcccgtgggcacacctcccgcanaccttccctctcgctcccanatcccgtgnccacctcnananctcccantctgntnaatccggt

SEQ ID NO: 96881 - DNA, 524 bp, Triticum aestivum
  unsure (1)..(524): unsure at all n locations
  Clone ID: PAT_TA_96881
gtcatgatccagctccacctctcgacgctaacacacgtgtggacgagaaagaaacctgagcaaacagagcgcacaacaagcagagcaatgctgcgctcctgcgccggccacggcgccaggacggtcgcctctccgcgcacggccacgccgccacaccgcggcaggcgccagcacctcctccgcccgcgcagcagcgcaaagaagcccccccaggatgcagagtcaagtgggggcagcgccaagaacgccctcgccggcgcgctccccagcaagaccgcgctcctgcgcgccggcgcggttctcttcgccctcggcttcgtcgacgccgggtacagcggcgactggtcccgcatcggcgccatctccaaggacacagaggagtgctcaagctcggggcctacgccgtcgtgcctctctgcctggtcctcgcactccgggtgcccggagacgacggcagttgaatcttangaaagaagngaatagcttgnatacatttcgtatcgtantagntggctaatcaatta

SEQ ID NO: 96882 - DNA, 522 bp, Triticum aestivum
  unsure (1)..(522): unsure at all n locations
  Clone ID: PAT_TA_96882
cccaacaacaacaaccggcgattcagtcatttctacaacaacagatgaacccctgcaagaatttcctcttgcagcaatgcaaccatgtgtcattggtgtcatctctcgtgtcaataattttgccacgaagtgattgccaggtgatgcagcaacaatgttgccaacaactagcacaaattcctcaacagctccagtgcgcagccatccacagtgtcgcgcattccatcatcatgcaacaagaacaacaacaaggcgtgccgatnctgcggcactatttaagctccgcccaaggncctgggtatcatccaacctcaacaaccaagtcaattngngggggttanggcattgggattgggaanccttccaaccaagtggaacgtgtttgtggcaactggactngncccaacattcaacattccatatgccaacaatagacccnggatttggnggcaaaggnaaatgcaagattatccttgcttaacngntgcaccancccttgttcgatgacaaaaaagnggggng

SEQ ID NO: 96883 - DNA, 528 bp, Triticum aestivum
  unsure (1)..(528): unsure at all n locations
  Clone ID: PAT_TA_96883
cgccgcaacacacacacacacagagaagccaagatgtccggccgcggcaagggagggaagggcctcggcaagggcggcgccaagcgccaccggaaggtgctccgcgacaacatccagggcatcaccaagccggccatccggcgtctggctcgcaggggcggcgtgaagcgcatctcggggctcatctacgaggagacccggggcgtgctcaagatcttcctggagaacgtcatccgcgacgccgtcacctacaccgagcacgcccgccgcaagaccgtcaccaccatggacgtcgtctacgcgctcaaagcgacagggccgcacctctacggatccggcggctgaccttcgcccgctgctccaatctcatgttctccgtgctatggttccgtttnctgaattcaanatggctncgttgtttngccatccgtcctgtgtattngtggatggcgatggttctgaatgcatcantcctcaaatgctgcgttgttctaccgnctctgtnntcattccaaatggaagngatta

SEQ ID NO: 96884 - DNA, 407 bp, Triticum aestivum
  unsure (1)..(407): unsure at all n locations
  Clone ID: PAT_TA_96884
ggcacgaggcgagcgtgtgccttttgaaagatcccttcttttccctttcagctcctcctcgccccaatccttcttttgtcacgaagatgtggctcgccccaaactagcaccaccaccaccaccaccagtagagcaagagacggagcgcggcgaaagctcgggcaaagcggcagcgtcggcagattcccggggcgtcgccgctattttaccaccccggccgattcaccgacggaagatcaaacccccaccccaccccagcccagctgtcggcggccccctaacccccggggcgcctttatccaccggggatttctcgtcgtttctcgggccanaggcggcgccgcagctggacttcttccgccgcggtggcctcatatagctccgggcctcgatccgctggttttcgg

SEQ ID NO: 96885 - DNA, 522 bp, Triticum aestivum
  unsure (1)..(522): unsure at all n locations
  Clone ID: PAT_TA_96885
gtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctgggtagggagaagtttgctgcggttccatctgggtggtggtggtgtggccgtttcaactgctgcccctgctgctgggaggtgctgctgcccctgcagctgagtcaaagaaagaagagaagnccgtgggagaaagaagagagtgatgatgacatnggttcaatccngttccgactaattgtggggnaactngtgtccgaanatctacccttgggcaaagaaactaaanccaaggangttttacctttatttacnnattttgnaaaacngggaaacnatgttttgaaagttatcac

SEQ ID NO: 96886 - DNA, 521 bp, Triticum aestivum
  unsure (1)..(521): unsure at all n locations
  Clone ID: PAT_TA_96886
gcaacactggttaacaccaatccaccatgaagaccttcctcatctttgctctcctcgccattgtggcgacaagtgccattgcacaaatggagaatagccacatccctggtttggagagaccatcgcagcaacaaccattaccaccacaacaaacattatcgcaccaccaacaacaacaacccatccaacaacaaccacaaccattttcacaacagcaaccatgttcacagcaacaacaacaaccattatcgcagcaacaacaaccaccattttcacaacaacaaccaccattttcgcagcaacaacaacaaccattatcgcagcaacaacaaccaccattttcacaacaacaaccaccattttcgcagcaacaacaaccaccattttcacaacaacaaccaccattttcgcagcaacaacaaccagttctaccgcaacaacatcaatttcacagnaacaactacaacattttcacagcaacatcacgtttcccaacaacaacaantaggactacaacaacn

SEQ ID NO: 96887 - DNA, 524 bp, Triticum aestivum
  unsure (1)..(524): unsure at all n locations
  Clone ID: PAT_TA_96887
aatcaaccagcaacgaaattattttgtcaacattacatctaggctaagatgaggttcactctagcactactcgtgacattcgccttcctcatactagtatcagatggaaaaacacaacattgcacagaaacaactatcggacagtctggtgggtgttcagccagttcttgtcagaatggttgcaatcaaaagtacaagaatgtgtgtcatccaaatgatgagtgcatatggaaggccaattgtgttggaacgacctgcaagtgcactgtgtgcacatttagctccttccccatgcaagcctccaaaaaggggaacaatgacgctnactagtaaccaattaattttatttttacgtcaaaaatagcagaataattatatataaatatagtcgcaagacatcanccgaaagtgatgtntaagaaaaatatnataaaagggagcttgagtaaaaaaanggggggcccgnaccaattcgccnataggagcntatacnncgncaacgggcgccgtttnaaagtccggng

SEQ ID NO: 96888 - DNA, 525 bp, Triticum aestivum
  unsure (1)..(525): unsure at all n locations
  Clone ID: PAT_TA_96888
cccagctcctcgccctccaaccccgctccaccacctcccacatgatgccatccccgcagatatacccgcagcaattcagctgtcctctcacgccaacctgacacaccctcccatccttcccgttagttagttgccgctcgccaccgcaccgcaccgcaagggcactcgcccgccctgcccgccctcctcaccttgcttccgcagaaagatccatttggttggactggcggtggttcccctgcagactgcctgcagcggtaaagccgcgcccttttgtgtgtgcgcttgccttgccgccgcggcatccgtcccgccccgctccgtggataactagtgatagatctgggaggcgcagatctgactgaccggccggtgttcgtcctccttcccgtcggtgagtgtttgttggccaagaatttgttggggccatggggaagaagggcaagtggctgggcgccgtcaagaangtgttcagcctgagtccaaggagaanaaggaggagaaactganggaagaagttggnng

SEQ ID NO: 96889 - DNA, 459 bp, Triticum aestivum
  unsure (1)..(459): unsure at all n locations
  Clone ID: PAT_TA_96889
gccaccttggcccagttcgaatgtgacaaagagagggaaaccagacaagccaagaacccggccggccatgccgaggtcttcttcctccgcgccccgcatcctcggcagggccatggncatcctcaccctgccgctcaccccgctctccaaggccagggcggcgacgaccctgctcctcttcaagaggcgccgcgcgcgccgcctgcgccactacaactacgcctacgtgggcgagtancagttctccccgtccggctccccgctgctccngccccgcccgcccggcgtctccgcnnggcgcgccangtggcngagccgggtcangacggtcctcgccgcgctgctctgctgnggcnnatgcatgnttcagcgcgcttcnattgggnacggtnggatcgacgtcgccgtgctcnaagggctgnctgtcncctgcccccaagcnctggatncngaccaggc

SEQ ID NO: 96890 - DNA, 547 bp, Triticum aestivum
  Clone ID: PAT_TA_96890
gtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgagcccactgtgattgatgaggtgaggactggcgcttaccgccagctcttccaccctgagcagcttatcagtggcaaggaggatgcagccaacaacttcgcccgtggtcattacaccattggcaaggagattgttgatctctgccttgatcgtatcaagaagctttcagacaactgcactggtctgcaaggattcccttgtcctcaaagcttttggaggtgggactgggtcctggccttgggtccc

SEQ ID NO: 96891 - DNA, 209 bp, Triticum aestivum
  unsure (1)..(209): unsure at all n locations
  Clone ID: PAT_TA_96891
gggatcgaataaanctcggggccctgcggttgtgttgccantcggtanagtgcaccgcngtgccncggatggggcctctcaaatctcccttcttgtccccctctgggcccangccannttccnctgcaancaaanggccaccgccgcccggccatcgtcatcaccgtctgccgccgccncctcnactgtcncctccgnccncgcttcct

SEQ ID NO: 96892 - DNA, 556 bp, Triticum aestivum
  unsure (1)..(556): unsure at all n locations
  Clone ID: PAT_TA_96892
caagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggnttcaaagccctacgtgctctacgtttggaggatctacgaattccccctacttattcaaaaactttccaaaggcccgcctcaatggtatccaaagttganagagataaattnaacaagtanggccgncnttaatgggatgttccaattcaccaantt

SEQ ID NO: 96893 - DNA, 537 bp, Triticum aestivum
  unsure (1)..(537): unsure at all n locations
  Clone ID: PAT_TA_96893
ccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacaactccacctggtgctcaagacccgtggtggcatgcagatcttccgtcaagaccctnaccgggaagaccatcacctngagttgagcctcctacaacatcgacaacgtccanggcaagttcaagacaaggagggattcccccggacaagagcgtctcattttgctggcaagcactcgaggatggcgnacgctcgctgactacaacatccagaaggatccacatccacctggggctcaagnccgtggtggnatgcaattttcgtccaagaccttaccggcaagacanca

SEQ ID NO: 96894 - DNA, 348 bp, Triticum aestivum
  unsure (1)..(348): unsure at all n locations
  Clone ID: PAT_TA_96894
cctctcctctcctctcctctcccacacaagcatgcaaggaaggttctcaggccgccgccgccgccacgatgagctcctcctcgaagctcttccagtccgcctgcaaggccgccaggtccttcctcgcctcctcctccgnccccgccgncgnctcctccgtnctcgcaaaagggaggnaaaccncgntcncaacctctgcaaacttcgganggaattcancctcccangcggaaaagccancaaattcaaanaaaaagngnantcttcccaagggnngnaaagggtttcgcaattccgccgnaatnntaaatgtccaagattnaagnggggggncccccccngattgga

SEQ ID NO: 96895 - DNA, 531 bp, Triticum aestivum
  unsure (1)..(531): unsure at all n locations
  Clone ID: PAT_TA_96895
aaggaaggtcagctgtcatggtgctgccacatggttgctgcagaagactgttgaaatgcatattattcttgggatagctcctcagaatgaaggatctcgcggagcgatggaactactagggtacgacgaggataatggtgtattgtttttatatgcggccgcctatgtctacatggttgaactgatgtcaatgcaatccaatgaacttcatctaagcaatctaccaataagtgtcatcctttcacatgtttctatgcaccaaccatcctgggtggacgcaatgggacctgaaatgctgcaagatacgtangatgattgtcctggnaccctggttcaangtgctaaaggtgctgggatgggtcaacaagtgaagtnactatgggggtgctgctgctgttctcanaaatctatcgcgttgcacaatgttggccgnaatgtatataanatgttatccgggaagaacttaatggacaactnttccataangtacaaagagcttttaactaatactnaccanggaaaaaaaaaaaa

SEQ ID NO: 96896 - DNA, 176 bp, Triticum aestivum
  Clone ID: PAT_TA_96896
ttgtagttgttgtagtagtcgtagtagtcgtagaagagcgaggaggcatgcatggtatatgcttaattgaccttatattggtgattaggaattataactgtggtgcctgcttggtgtggtctcttccatgtaaaaaggagaagaatgtgtaattttttttggctaaaaaaaaaaaa

SEQ ID NO: 96897 - DNA, 537 bp, Triticum aestivum
  unsure (1)..(537): unsure at all n locations
  Clone ID: PAT_TA_96897
gctccgacgaacggaaccaacaaatcccccagccgatctcgtctccggtcgactccagctccccctcctccggtcctcccccaccgccccaagatgcagatctttgtgaagacattgacaggcaagaccatcacccttgaggtggagtcgtctgacaccattgacaacgtcaaggcaaaaatccaggacaaggagggcatccccccggaccagcagcgcctcatcttcgctggcaagcagctngaggacggcaggacccttgctgactacaacatccagaaggagtccaccctccaccttgtcctccgccttcggggaggcatgcaaattttttgtcaagacctcactggcaagacaattacacttgaggtggagtctccggacacatcgacatgtccaaggcgaanattcaaggacaaggagggcatcccccccggacaacaacgccncancttttctggcaagnaacttgaggacggaggaccttnctgactacaacaccagaaggancaactcaactttctcgcttcgggagga

SEQ ID NO: 96898 - DNA, 356 bp, Triticum aestivum
  Clone ID: PAT_TA_96898
gaggagctgaagggtaggcagataacttggattcggtcgctgcgctgggcgccttcaacaacgagcggatacacgtgtccattttgctatctattgccgtcctaaacggacgaaatccgaacaaagcggacgtccgtttgggatcgtgcgctggagctgtcctcggagccgtggtgtggcaaagagctattccggacacggaggggcgaggcactcctgtttgtgaagtgaagatgaagatcatgcctccctttctgggtgcagcgcaagatccttcccatgaaaggaaaaggtccgtctgggaaagactgttggtacaagagaagcaagaaaatagaaatttcacgcgaagaaaa

SEQ ID NO: 96899 - DNA, 541 bp, Triticum aestivum
  unsure (1)..(541): unsure at all n locations
  Clone ID: PAT_TA_96899
acactcccccgcccgccgccgccgccgcacagccgcaggtagagaaggcaaggaggaagggaagatgccggcggggcacgggctgcggtcgcggacgcgcgacctgttcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcactgcagcatccaggtgcaacgaggattctccaagaggaactcaacaacgacaagctgaaggcggaggcaangtgctggtgaggcatcacacaaagaggaancagcangcccaanctgggtcatggtgggagggacacatcgagacggtnaccccatcccgtacactctcacatccaaggtggttacaaaacct

SEQ ID NO: 96900 - DNA, 585 bp, Triticum aestivum
  unsure (1)..(585): unsure at all n locations
  Clone ID: PAT_TA_96900
gaaacacaagaaaattgttgcggcaaaaccatgaggtcgccgcaagctctctcgcttcttgttgttgtcctcctccttgcctcgtccagtgcttccgtcatagaagacacatgcaggcgcttcgatggtgctgacatctacgatatctgcatcaagttcttcaaggccaacaaggatagcgccaccacggacaagcgtggccttgctgtcatcgccattgggattgccaagtgcgacagctgtggacacccgcaagcgcgtcgccaccctgaaggccgaggaaaaggatcaaattatccaagcatgtcctcgcctactgtgacaatatgtactccagtgttgtgggcctatttgncaangcttgccaggggcatctccgttgggcaagttggggcgacgcaatgacgagctcaagtcccgcactgggacattcccaaatattgcgatgacaattcctccaangnaaggcntgaatcccaatccgatgccganaacagcaattcnagtgcatgtgcaacaatcngggtgttacgaagatctgacattnatnacgatncgcaggcatgatgtggaactcatangatc

SEQ ID NO: 96901 - DNA, 257 bp, Triticum aestivum
  unsure (1)..(257): unsure at all n locations
  Clone ID: PAT_TA_96901
tcagtctcccgttgccagtggactcaaaatcatgtgttgaaatgataggcaaccaattggtgaccaccatgagggacaaatgcttgcttgctttcaatccaccaacaaaacctggttcaaatcccgttgcggagaaagagtgctgccaagcggtangcaaaggtcttganccggtccaggggaaaacatttgcctttgtanctacatgaagttaaatccctgnccccggtgggccncctgcctngggtggggcnaac

SEQ ID NO: 96902 - DNA, 542 bp, Triticum aestivum
  unsure (1)..(542): unsure at all n locations
  Clone ID: PAT_TA_96902
cctagcctctcccttgagctcgagagtccctcttcaccgcgcatcaccaccacggttagcgacggccaccggctaaattccggtgagccgagctctccctccacctctagccctcaccaccagtttccccgtgctccggcgatcctccccaacccctctcctagtcgccggagtaggtgtggccacagcgccccaagcttggccgccgcccaatccctctacatccacgagccgccaccgctgcagtcttccccgttgcgcgctcgtcaactggacgagtggggcacgtcgccctgatctcgtcggtgctctccgctaggccggaggctgcctgagccggccaggctcatcgccggccgagccctgccttgcctctcctctgcttctgtcgaagggagcagcgggaggaagaaggaggcgaaccaagcgggccctcctccccaacgtccccaaccgtcagcggaaaaatcgcgcgctgaagttggataagtggaanccaattttcagaaaagntttcaaatttgnaaacgtattcaataana

SEQ ID NO: 96903 - DNA, 524 bp, Triticum aestivum
  unsure (1)..(524): unsure at all n locations
  Clone ID: PAT_TA_96903
gtaacccgagcgggggcattaaggtgatgtggatgctgttgtagtgctgcgggcctggtcttgggtgtgctattgttggcccgccggccagcaacagtcgctcgcataccaagctagggatcgagcgtaggggaagcacctcccacaccaagcaaccagcaaaggttggctggatccatggactccccacaaaaaaagcttggatccatggacggcgagctgctgcctgtgagtgcgagtgcgaccgtggccaagaagaccttggccgctcgtctgttccaggatcatgtcctgctgctcagcgcttgggcgctcttcacggccttcgtcctcgtcgtctcctgcgcattgggctacgcaatcgcctacgcactcgaccacttccacgtcccctgcagccaaggcctccttctttctgcggtgccacaaagccgacggacgcggaggncgccgangtgaccgccctantgatcggaatcttgctgcgctacactccaagcgggcgccggcggngctggggcctc

SEQ ID NO: 96904 - DNA, 538 bp, Triticum aestivum
  unsure (1)..(538): unsure at all n locations
  Clone ID: PAT_TA_96904
agaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgccgtcctcgagtacctcgcagccgaggtgctggagctggccgggaacgccgccaaggacaacaagaagagccgcatcgtgcccaggcacctgctgctggccatccgcaacgaccaggagctcgggaggctgctgtccggcgtcaccatcgcccacggcggcgtcatccccaacatcaacccggtgctgctccccaagaaggccgccgagaaggctgagaaggccggcaccgccgccaagtcgcccaagaaggcaacaagtccccaagaaagccacaaggggttanattgttataatggcngtgttctgaatggtccaagtttgggttaaatgtataccngcttaatcngtaccctgcgcccctgatttaancccaaaaa

SEQ ID NO: 96905 - DNA, 553 bp, Triticum aestivum
  unsure (1)..(553): unsure at all n locations
  Clone ID: PAT_TA_96905
cccgcctgcccgcgccgccgccgcctccttccgcaggagctccctccccgcgggcgcgatggtgtacatcaagaaccagaagacaagggcgtactccaagcgtttccaagtcaagttcaagagaaggcgccaggggaagaccgactacagggccaggctgaggctcacgaaccaggacaagaacaaatacaatacccccaagtaccgttttgttgtgcgatttaccaacaaggatgtcactgcacaaattgtctatgctaccattgctggtgatatcgtgatggccgctgcctactcccatgagttgcctcgctacggtcttgaagttggcctcaccaactatgctgcancctactgcactgggtctgcttttggctcgtcgtgtgctcaagaacccgtgatcttgatgaaggantttgaaggcaatgttnaaggccncnaggtgaaggacttctccggttgagccttctgatnaaanggaaggcttttccggngcggcnccttggnntgttggggccttnttaagggccaaccaattggggaacccgcgttg

SEQ ID NO: 96906 - DNA, 302 bp, Triticum aestivum
  Clone ID: PAT_TA_96906
gttgcatctttcatatggtgtctagcttgcattacttctattttcttgaaaatccttctgcttagtttacacatcgtagctgtgaatatgtcacgccgtcctatttttcttacatattccatcctcacacgattgtcttacatcaaagtattgcttgtctgtatcatgcatcaatgagttctgaagagcgattttattcttttgtgttgtgggtatgccttgacatggcaaagtcaaaaaagagcaaggaaaagaatatagtagggaatggtgttactcgtcgggtgaaagggaaaaggatc

SEQ ID NO: 96907 - DNA, 529 bp, Triticum aestivum
  unsure (1)..(529): unsure at all n locations
  Clone ID: PAT_TA_96907
cccaccttcttccagcacacccaacgcacccgcaaatcccccactctcccgaaccagcgatgccccccaaggcggagaagaagccggcggcgaagaagcccgcggaggaggagcccgcggcggagaaggcggccgagaaggccccggcggcgaagaagcctaaggcggagaagcggctgccggcgggcaagacggcgtccaaggaggccggcggcgaggcgaagacgaggggccggaagaagggcagcaaggcgaagaagagcgtggagacgtacaagatctacatcttcaaggtgctgaagcaggtgcaccccgacatcggcatctcctccaaggccatgtccatcatgaactccttcatcaacgacatcttcgaagaagctcgccgccgangccgccaagctcgcccgctacaacaaagaagcccaacatcacctcccgggagattcagacctccgtcggctcgtcctccccggggaactcgccaaagcaagccgtctccgaagggaacaaaggcgtcacaaattca

SEQ ID NO: 96908 - DNA, 540 bp, Triticum aestivum
  unsure (1)..(540): unsure at all n locations
  Clone ID: PAT_TA_96908
agatgaaattaataagttgacanaccacattnnatctcngggcgaaatgaatcaagcaaagttngaggctgttcttgcaagacaaggcatcaanaatcanaatgacttcacgaaagcaaaaaaaatgcacttcaaagatgaaaggnaatcaattttgggnaagggaggaaaaataaccgtgacaagctgaaatcgatagggctaaaagggaaagatctttgtgaaaggcacaagaaagaagttttgggnccatggcaaacaacctgggggggatatcaagggaggagggcctggaaatttcctggtttatcccggnatcaatcaaggggacccaatngggaanttggggaggggagttttttgggtcccaantggtttaagaaactngggttgactggcgaaagaagaaagttttttttaacaagcctggttgaagggtcacctggctggggaaatnaaccttggttccaatgtnnggtggggnttnganaaattgacccattatnatccnaccacaagggataaattcaaagggtaatt

SEQ ID NO: 96909 - DNA, 591 bp, Triticum aestivum
  unsure (1)..(591): unsure at all n locations
  Clone ID: PAT_TA_96909
gnaagccaagccatccatggcgcccaggacgtccgacaagacggcgacgccgcccgctgccggggccgccgcgaccgggctcgcgctcggcgtcngcgccggcaacggcggggggngtcgggcccgcactacccgcggcgtgaaggaagcggccgtggggccggtacccggcgtgagatncgccgacccgggncaaagaaaanccggggtgtggctcggcacgttncgacaacgggcccgnanggangggccgccccggggcctancgacnncccgcccgccgcgccgaagttanccgccgggcaaacaaagggccanangancaaactttccccttcggccccgccctccggcngcccgcccgccgnccggcgggaggggcccctcnaccgttcgaccgggaagcccgggaaccaagccaacnagcaagcaacccgttggangttccctttcnggngggggaacnttgcnaaggnggccccaatgcaagggcnaaatggccgcttccccttccggttcccttcgaaaccntcgaacnttgtttcaaacggngncgggncaacnagnanccgcccgtgttgcctggcattt

SEQ ID NO: 96910 - DNA, 356 bp, Triticum aestivum
  unsure (1)..(356): unsure at all n locations
  Clone ID: PAT_TA_96910
cctcctcgagncaaccgagccggatcggcctagggttaaggtttccgccgccatggacgccggccgncgccgcagcaataagcgggaancggggcgggagcaagaaggaangaacaaggcgngggaaccgacggggctccgaagttctcnganctggcgggcgggggaaacnggttgcttcttgggcntcnaancgccgcctccgcngacaanctccnaagggcccgnaatnaaaacancccggacgaccccggncccggnttcgcncgaantccggagtttcngctctccaaagcccgaagaaaggaccgggggttccgnccttcctccncccggggngngcccgggngcttctt

SEQ ID NO: 96911 - DNA, 523 bp, Triticum aestivum
  unsure (1)..(523): unsure at all n locations
  Clone ID: PAT_TA_96911
ataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgtggccccctccaagggcaccccgtcgttcgaggccgccgccgagaacggagggtgcaagtgcggccccaactgcacctgcaacccgtgcacctgcaagtgatcatgaggcccaatcaaatcaagattaaaggagaatgggatgggattggacctngatgaaaggagcgagtaataanttattncatgaatncgcaagcgtgtgtttccgttttaaaattgccacccaaaaataagacgagattctatccgttatccgttancgaagctangttaatgggattaatccgttgcccccttggtggcnttgtaaccgtgtggctgtgtaaaggggtcttgtgctggtgattgngcccttttccctacc

SEQ ID NO: 96912 - DNA, 413 bp, Triticum aestivum
  unsure (1)..(413): unsure at all n locations
  Clone ID: PAT_TA_96912
caaccattcccactgcaaccgcaacaaccatttccccagcaantcangcacaaantnantcctcangcaaccccaacanccattccctctanaaccacaacantcattccntcggtaatcacannaanccgttcctccaacanccanaanaaccatctccccaaccccaacaagtagtacaaataattccccaagcaaccccaacanccattccctcctgcgtggtaaaaccaancctnagcaaccttatcnacancaagcaaccaatcangagtnatggtactangcaatcnggggngccantgggnacntgaangaanctatantactannccccggngggntcaatccgtttgntttaactcaattngcagtgtttcaatgntaagcgatngataaacataaaaggtgga

SEQ ID NO: 96913 - DNA, 570 bp, Triticum aestivum
  unsure (1)..(570): unsure at all n locations
  Clone ID: PAT_TA_96913
agcacncctaccacncgcagcgcgcanagcgagatcgagatggcgacggagctgncngcggngcagcngngggcgtacgacggcancgacgcgtccaagccgatctacgtcgccatccgcngatagcggtcttctnntcncggccgggcgcngnttcnacggggcccggcggcgactacgcgctcttcgccgggccgcgaggccgcccgcgcgctcgccaagnatgtccaagggacgccgcccgacgtctccgggcngacctctccgngtctctccgaacaaagggacgctcggcgtgctcgccgnactgggggagtccaaanttccaaggtnaaaagnaccccgnntcaatcgcccgggggcctcaacnaccntgaacctgancgcagaatttccnganaactggngnacccactccntccgntccntcnaactaagtatcngtatnccatcccgaaggctcccanccgtgttgtaatccttgtatccctgtctgctccctggcgtaatgaaccgctcaaaaataaataaataatctgnaggggcntggtttggcataggcctaacaan

SEQ ID NO: 96914 - DNA, 256 bp, Triticum aestivum
  unsure (1)..(256): unsure at all n locations
  Clone ID: PAT_TA_96914
gnttgttacatggacatgtcgttagtcnttcnttttgttgtcaattttcattgcaaaattgacttcaattattcaagtanatgtgtttgtgttatattgtttgtaaaagtgaaatttaacatgtaactcttgtaaactttttcaagagcccgtggcaacgcacgggcactctaatagtgtttgttaatgcaagagtaatataaatttctaaaaaaaaaaaaaaaaaaaaaaaaaaaaaaaaaaaaacaagggggga

SEQ ID NO: 96915 - DNA, 492 bp, Triticum aestivum
  unsure (1)..(492): unsure at all n locations
  Clone ID: PAT_TA_96915
gctcctcctccccgtccgtccccacacacacacgcacgcgtttgacattttccgcccaccaccgccggagggagctccagccatggccgccaagtgctacccgacggtcagcgacgagtacctggccgccgtcgccaaggccaagcgcaagctccgcggcttcatcgccgagaanaactgcgcgccccttatgctccgcctcgcgtggcactcggccgggaccttcgacgtggncaccaanaccggcgggcccttcggnaccatgaagtgccccgcggngctcgcgcacggngccaangccggnctcganatcgccgtcaggctgctcgagcccatcaaggngcagttccccatcctctcctacgccgacttctancanctcgctggagtcgtcgccntcnaggtcaccggcgggcccgaggttcccttccacccggggagaacaggacaaggccgagcctcctccaaaaaggcgtcttcctgatgtaacca

SEQ ID NO: 96916 - DNA, 419 bp, Triticum aestivum
  unsure (1)..(419): unsure at all n locations
  Clone ID: PAT_TA_96916
cctaaaacctcaaaaccccagtggcgacggagcgaggagggagggagcgatggcgccgaancggaagccagcggagccgccgagggacgccgaggggatattccgcggcgtctccgccttcttcgtcccccacggcgtgcagccccgccgcctcgaggtgtggaagcanaagctggtgcagatggggggccgcctggacaaaaaggannccggcgccaagggcgccangatcaaccacgtgctcnccgccgacgccaangcgctgctccgggagctcggcgcccgactggnttcaccgcttcacggggagcgtggtgtccttcgnttggctggaggagtgnctcaaatcccngcgagaggctgccccagcanangttcaccatcaactacganagaggaatttaaacccaanangggac

SEQ ID NO: 96917 - DNA, 527 bp, Triticum aestivum
  unsure (1)..(527): unsure at all n locations
  Clone ID: PAT_TA_96917
gctgcagggtaatggtgagcctcttttgttgtaatcaaacgggcagaacctaacataagcccaaaataatatnactgaaccctggcagcattgttgttgaaaagagagcatctaataagaacatctctggaaaactaaaaaggtttaccaagcaccaacgccctggatgttgcttgtcattgggtcattggagagtgaaggaactatctgacctaataatctataaaatttcctcgggataaaaggataaaacccanaaatgcactctaggcaataccaagagcaatcagagagtgcctgaagggaacatagcctagtccagctgctttcaactgaggttagagattagtagggaatggcgacagaaagaggagaatgtaattaatatancagtaggtgatgactgatgagctgtgggccaatgagtgagagtgctcaagacatcatgctggaatccttgataatttcgtatagtgagatcacaatctcaatagccagcaagaattatgacaccccactccagaaaa

SEQ ID NO: 96918 - DNA, 508 bp, Triticum aestivum
  unsure (1)..(508): unsure at all n locations
  Clone ID: PAT_TA_96918
gttacgaattcccccaaatccatccccaacccggtcccgtcggatncatcgccgccgccgccatgtcgtcgtcgcagccgcaagcagcgctactactgccaccaagtgcgaccgcgccgtcgccatcgccgcccccgcctcccgcgacgacgaggtcttctgcccgctctgcgccggggggttcgtcgaggagctcctcgacgacgaggacccccctcaccacatgccgccgcagtcccccttcttccccctcgccaagcttcctcgacctccgcaaccccagcgacctcgccggggtcctcggnccgccatccccctccgcgccccgcgccgcctcctccgccgccaacccaaacaaccaagttcgacgtcaaccgacttcctccacgggcacctcggggggctcctctcgggcgggggccaacatccaaatngtctcgagggctcctccttcccgccggcttcgcctccttcaaggggggcccgtcccgggggggtcaagctcggt

SEQ ID NO: 96919 - DNA, 513 bp, Triticum aestivum
  unsure (1)..(513): unsure at all n locations
  Clone ID: PAT_TA_96919
acaagctgaaggncgagcgtgagaggggtatcaacattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcacccttggagtgaagcagatgatctgctgctgcaataagatggacgccaccactcccanagtactcaaaggcccgttatgaggaaattgtcaaggagagtctcttcgtacctgaagaaggtcggctacaaccctgacaaggttcccttcgttcccaatctctgggtttgagggtgacaacaatnattgnngaggtccaccaaccttggactggtacaaagggccctaccccttctgagggctcttgaccagaatnaaatnagcccaannnt

SEQ ID NO: 96920 - DNA, 525 bp, Triticum aestivum
  unsure (1)..(525): unsure at all n locations
  Clone ID: PAT_TA_96920
gcccaaggtggcggcgtccancagcccgtggtacggctccgaccgcgtgctctacctcggcccgctctccggcgacccgccgagctacctcaccggcgagttccccggtgactacggctgggacaccgcgggcctgtcggccgaccccgagaccttcgccaagaaccgggagctggaggtgatccactgccgttgggccatgctcggcgcgctcggctgcgtcttcccggagctgctcgccccgcaacggcgtcaanttcggcgaggcccgtgtgggttcaagngccggctcccagnatcttcaanngaagggccggcctcgnactacctcgggnnaagcccancctgggtgnatgcgncagaggcatccttgccatctgggcctgccaangtgngttgctgatnnggccgccgttgganggggtaccgcntggccgggcgggcccgctgggcgangatcgttgtccccgctcctatccccgggagggaancnttccgnaccccctggggncctcccccgaagga

SEQ ID NO: 96921 - DNA, 552 bp, Triticum aestivum
  unsure (1)..(552): unsure at all n locations
  Clone ID: PAT_TA_96921
atcagatcanccacagagtcacacaagcactagcttcaggntanccancctcanccactccgggcattttcttgcatccacaacggtaatggncaccgctgatgtcnanaacccgacggccgcgctgacggaggaggngcccgcctgtggagacgccggtggccgccgaggaggccccgaagacngaggaggtccccgcnccggtggaggccgaggtcgaggcgtctgcccccgtcnaggttgatgcnaccaacgaggaggcgccgggncgccgctgagacngaaggangccaaggaagaccgagccaagcaagcttcgggtcgaagcccngaggccnaaggcngcccaaaagaagccanatggcgccaagcccgtgtntccangacaacaataccaaaggaggccgttgggcanaaggtccgaagccggcgggtggtcgtaangaangtnaaaganggaggccgcntccctgcctgcccgaagccaataaagcacccggcccgttcgcccnaaggaaatcaaccggcttgnaancgggtngggagggcccn

SEQ ID NO: 96922 - DNA, 588 bp, Triticum aestivum
  unsure (1)..(588): unsure at all n locations
  Clone ID: PAT_TA_96922
aaaacccttcncttcccccctaagaaccttccgggcgcatccaccaacatcctcctcncaatggncccctccctcctcgccgnagccgcctcgcccttcntcctccacgccgccgccggaaagcgccagccccgaggccgggtgtccgctgccgccgccaccggggcgccggcgccagcntcctcccgtgcgcgtgcgcgccgccaatcaagtgcgacccttccaanggtgggaaaccngcagtccggaccggggtgctcngtcncgtctccaagactatccccanaagaaatctgctgngggggaagtccttgctaccaaaaaatctngctggttaanaattcnancagatattttgtatgngggcggagatttttaatcgcgncgggngttttgaatggttanctgaaactttgaaagcctgggaanagaaagggtcctncttctccnggacaataaaacgcctttatgatgngtgggnccttggggaacnaanaaagtagnaancancttgcctttcttgtncggaagaagtcnggatctnctntgggntgttcgntcncccttgagnngttaanctttaaaatt

SEQ ID NO: 96923 - DNA, 256 bp, Triticum aestivum
  unsure (1)..(256): unsure at all n locations
  Clone ID: PAT_TA_96923
agaatgnctcacnaccacngcgcactccccgacgaggangccccgtcgccgcggnnctccgncagcaggntgctatacacttcctcnnctncgccgcatcccgccacggacacggtcacggataccggtgcctccgagtcggcgtccgtcggcgtcnacctcgtngagggtggnngtgggcaccaccgtgaaggcaaggggcgtgttccacntggacccggcggtgctgncangacnagccaggtgctantgtttg

SEQ ID NO: 96924 - DNA, 528 bp, Triticum aestivum
  unsure (1)..(528): unsure at all n locations
  Clone ID: PAT_TA_96924
gcgccgccgtcgccgccgcancgcgcggaggngaactcncaccgccgccaagatgcanatnttcgtgaagaccctgacgggcaagaccatcacgctggaggtggagtcctcggacaccatcgacaacgtcaaggncaagatccaggacaaggagggcatcccgccggaccagcagcgcctcatcttcgccggtaagcagctcgaggacggccgcaccctcgccgactacaacatccaagaaggagtccancctccacctggtgctccgcctccgcgggggcgccaagaaagcgcaagaagaagacctacaccaagcccaagaagcanaagcacaangcacaaagaaggtgaagctcgccgtcctccagttctacaaggtcnaccacgccancggcaanggtgaccaaggctcaaggnaggagttgcccaaacgccgactgngggggccgggaactttatggcaaacantttcaacggcaataattgngggaagttggggctcaactaagtctanaaacaaaaaaggtt

SEQ ID NO: 96925 - DNA, 504 bp, Triticum aestivum
  unsure (1)..(504): unsure at all n locations
  Clone ID: PAT_TA_96925
aggaccggttccagcgctgacggcacgggtcctagcacctcctcctcctactccaccgccgacgccgacgacaatggcaccgccggcggcgccaaggtctggctcctcgtgctcctcttctccctgctcctgctgctcttcctcccctccgcggtgcgccgaggcggcggcggattccagcgcggagggattacgctcaagagcggctgggacgttgtcaacctctgcctcgtgctcttcgccatcctctgcggcctgctcggccgcggtgggggcgacggcgatggggagccccccggccccgcggcgccggcgcccaagagccatctgcgggtgtcccctgcggcggcggcgacgccggagccgagcacggaggacgtctgggcgagcttcaacaaactcctacaccaatccacaacncccanacggggattcggcggatgaaaaagaacanctcctaaccggaggcttncgggntgggacagcgaacgngtctggggcctc

SEQ ID NO: 96926 - DNA, 506 bp, Triticum aestivum
  unsure (1)..(506): unsure at all n locations
  Clone ID: PAT_TA_96926
gttccaggaggccctcattgttgccgaagcatacagcataaatcagccaatggaatgggccccagtcttttggaaccagatgctgaaacctgacctcatcgagctatttgtggctgaatttgtactggttctgcccctgcacccaccaatgctcgtggagcttgcgagattttaccgggcagaggttgcagccaggggcgaccagtcgcacttctcagtctggctttcgcctggaggcttgcctgcggagtggggaaagcatctcggcagatcattcaggagcctgctgcgccgaacgagggatatgaggctgaggctgcagttggcaactctggcgactgggttcagcgatgtccttgagggctgcaatgcaagttctggacaaggtnccccgagaacgccgggccgctaatactgaggaagggccatggggggtgcaatacctcctcccatgtaaatcaanctccntctttgtctccaaaaggtgggtaaaatcttaacangag

SEQ ID NO: 96927 - DNA, 505 bp, Triticum aestivum
  Clone ID: PAT_TA_96927
cccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccaagagcaccaagggtggcaagcccttcgtcgacatcctcaaggcgggcaatgtcctccccggaatcaaggtggacaagggtaccatcgagcttgctggaaccaacggtgagaccaccacccagggctttgatgaccttggcaagcgctgcgccaagtactatgaggctggtgcccgcttcgccaagtggggtgcagtccttaa

SEQ ID NO: 96928 - DNA, 355 bp, Triticum aestivum
  unsure (1)..(355): unsure at all n locations
  Clone ID: PAT_TA_96928
ctcaccaaatttggcggnggtgtttggggacgctggttcgcgttcgtcttcccgtcgcggatgtggcggccgacctgtgcgcgccatggcaacctgcgaggccggcctctggcggaggcggtctggcgcancggcggccacccgctttgtctcgaggctttctcttaggctaagtcacctcattcataatgcttttttgttggattcatcatgcgtctctcctctctgattgatcgtatctcatcctcttcttgttggcttgttggttcttgcaatttggaagtatataagttgctaggatttgatgcaaactgccggggtggtactattaattcgaattggattggaatcacac

SEQ ID NO: 96929 - DNA, 483 bp, Triticum aestivum
  unsure (1)..(483): unsure at all n locations
  Clone ID: PAT_TA_96929
aggccaagttcgtctactgncggggngccgaagccaaccctctccgtcgggaacgtcntccccgctcccggctccgttcccttgagggggaggcgtcatctgccaacgtcgangcaccaacgtcggngaccgtggtgtcttcgccaaggggcctnccggtgantnacgccatcgtcatcanncacaaacccccgtacaacggcaccctcanagggattaangctcccctctggtggccaananagattgtcccaagcaagntgccgntgccatgaattggggtcaagggtntgctgggtggttgngcaangactgaagaaagccaaatggcttcaaagcggctgggttanccgccctacncaacaaatgtaccgttgttgaaaggaggaaactccctgngccctaaacggtgcgttgggtgttgggccaatggaaaccctggtngggnggcaatccccacngggannggagggnaaccaacca

SEQ ID NO: 96930 - DNA, 335 bp, Triticum aestivum
  unsure (1)..(335): unsure at all n locations
  Clone ID: PAT_TA_96930
gaacagttcaaccaccgatnacctgaagatnacatactaatcgtcaatcnttgctgggnaattggnancgatgggtcctgccgggaacaagggngcccgcccggtcacnccngcggtgctggtgctggtgcnggngctggngccncggggcgccancgcggcgctgacgtgctccancgtgtncaangagctgatgcccgtgcctcnggnacntgcaatcggggcggggcggggtccgcgggttctnctgctcnggggattaaaaacnctcctntnccaaggggcgngtcnntcacncccagannagccttcggcccgccnttngccctgccctc

SEQ ID NO: 96931 - DNA, 513 bp, Triticum aestivum
  unsure (1)..(513): unsure at all n locations
  Clone ID: PAT_TA_96931
gtggctgccaccaataacttcgcccatgacaccgtgattggtcaaggttcttctggtaaggtgtacagaggcaggcttcacgatgggcgagaggtggccatcaagcgcatcaataacgatgactactccataaaggcattcaagcacggagctccacaccctatcacggntccaacacaaacacatcgtccacctccttggatcgtgtgtgactgtgagcaaggaaaagcgcctagcaagaacccagcaaaagagaaaaaaaggcctgctaacaaggcggncaaaggagccagaagagccgcagaggttggtcgtctacgagtacatgaagaatgggacactcttcgaccaactgcacgctgatnaaggctcctccacgttgtcnccggtgacggtgtcctggaagatgcgcattgatgtgctcctcngggtgtcatgcgccatccaagcaactgcactgtcatnccaaaccgccgattattcatccggganaacaaagccgagttacaacct

SEQ ID NO: 96932 - DNA, 502 bp, Triticum aestivum
  unsure (1)..(502): unsure at all n locations
  Clone ID: PAT_TA_96932
tgccagcctcaactcaaccgaagcaaagctaacgagtancacgcaatggcgggcgcgaccatggngctctcctccccggcgatggcgggcaacccggtgaanggctccanggcggcgcccttcggcgagggccgcatcaccatgcgcaagacggngggcaagccaaggtggnggngtccaacaacccgtggtacggntccgaacgcgtgctctaactcgggccgctctccggngaacccccgagctaactcaccggngaatttcccggcgactanggntgggacaacgcgggcctctccgccgaacccgagaacttcgccaanaaaccgggagctggaggtgatncaatgcccgctgggccaagctcggcgcgctcggggtgcgttttcccggaagctgctcgcccgcaacggggtcaaattcggcgaaggncgtntggtttaaagggcgggntccaaattttcaancganggngggctcgaataactcngnaanccaaccn

SEQ ID NO: 96933 - DNA, 523 bp, Triticum aestivum
  unsure (1)..(523): unsure at all n locations
  Clone ID: PAT_TA_96933
agccacaacaaccatctccccaaccccaacaagtagtacaaataattccccagcaaccccaacaaccattccctctgctaacaaccaatttcgcagcancaagcacancaacaacancaacaacaacaacaacaaatccttcaacaaattctgcaacaacaacaactgattccatgcagggatgtcatcgtcttgcaacaacacaacatagcgcatgaaagctcacaagtattgcaagcaaagtagttaccaagtgttgcaacaattatgttgtcagcaagctgcggcagatccccgagcagtcgcggtgccaagccatcaacaatgtcgttcatgctattattctgcatcaacaacaacaacaacaaggacaacatcaacagtcgangccangtctcctaccagcaggctcagcaaacaatatccatcaggncaggggctncttccagccatctcaagcaaaaatccacaaggcccaagggctttgtccnaacctcaacatctgccccnaactcgagggnaa

SEQ ID NO: 96934 - DNA, 516 bp, Triticum aestivum
  unsure (1)..(516): unsure at all n locations
  Clone ID: PAT_TA_96934
ccacagtattcgcaaacacaacaaccaatttcgcagcaagcagcaagcagcaagcaagcaacaacaacaacaacagatccttcaacaaattttgcaacaacaactgattccatgcagggatgttgtattgcaacaacacaagcatagcgcatggaagctcacaagttttgcaacaaagtacttaccagctggtgcaacaattgtgttgtcagcagctgtggcagatccccgagcagtcgcggtgccaagccatccacaatgttgttcatgctattattctgcatcaacaacaacaacaacaacaacaacaacaacaacaacaacaacaacaaccgttgagccaggtctgcttccaacagtctcaacaacaatatccatcanggcagggntccttccaagccatctcagcaaaacccacagggccaggggctctgtccaagcctcaacaactggcccaagtttgaggaaataagggaacctancgctangagacgctacctgcaatgtgcaatgttc

SEQ ID NO: 96935 - DNA, 228 bp, Triticum aestivum
  Clone ID: PAT_TA_96935
atctccttcacggcttcacccctaccacctacctagctcgtgtgtgccatctggatctgaatctagctccctcctccatccctatatataagcccacccgttgccgagaggaaatcattagccagagtcagagttcagcaacactccttcaccacacttcgttcgcttccaactatctccacaccacagagagagagagagagagagagagagagagagagagagaga

SEQ ID NO: 96936 - DNA, 209 bp, Triticum aestivum
  unsure (1)..(209): unsure at all n locations
  Clone ID: PAT_TA_96936
ccccccccccccctctctctctctctctctctctaaacggangaccacttcgctcancactcccacgcncgcancggtaagtgtgccagttcacccacaaagcccgacgtgcgtcgcctctcgcgccgacagtngtcgcgcggcgccagacgcggggacccccacctcgagcaaggnagtgnttnttattattcngtnggcntcntcag

SEQ ID NO: 96937 - DNA, 521 bp, Triticum aestivum
  unsure (1)..(521): unsure at all n locations
  Clone ID: PAT_TA_96937
tttccacccactacgttctccgccacgactccccaagctctcaaattcctcaaaccatggccgccgcggcctcacggcacctctgctccgccacggcgctgctgtctccctccgccgccgccgcgcccatccgccagagggtcggttacggctacggctcctcctccgcccgccggtgggcccaccggccggacgccgcgtcccggatccggcgcctgacgactcgctcgaggacagcgagggtgagctgcgcctactccaccggcgctgaagcaatcactgcatgttcctggaaccaaaatgtcatatgcagtgatgtacctgtgcttgtggagttttgggcctcatggtgtggaccttgtaaaatggtccatcgaattgtcgacgaaattgcgggcgagtacgctggaagggataaaatgctataagcttgacactgatgattaaccacaaactgcaaactcctacaatatcgagagggttccgactgttttactaatcaanggatggagaagaaaatc

SEQ ID NO: 96938 - DNA, 523 bp, Triticum aestivum
  unsure (1)..(523): unsure at all n locations
  Clone ID: PAT_TA_96938
caaactcccatctccgtctcgcgtcgcggggggagttccactccctcnccatgggcaagattaagatnggnatcaacggtttcngaaggatngggaggntcntccccanggtaaccctccaaagcgacgatgtctagctcgtcgccgtcaangaacccttcatcaccancgagtacatgacctacatgttcaagtacgaaaacgttcangggcactggnagcacantgacatcaagctcaaagggcgacaaaactctgctctttggngaaaaaccanttaacgtcttcngggtcaggaaacctganggaaattccntngggtgagggtggtggcccattaaattgttngagtccaaccggtggtctttactgaacaaaaggacaaagggccgcngctcacnttaaaagggtgggtgncaaaaaaaggnggtcaatctctggccccaaagcaaaanatgcccccaaagtttggtngggtgggngtccaaccaaggacaaattaaacctcaaaaccnttaanaan

SEQ ID NO: 96939 - DNA, 482 bp, Triticum aestivum
  unsure (1)..(482): unsure at all n locations
  Clone ID: PAT_TA_96939
nacaatcgctcgcagctcgagatcggcagccatgtcccggngcgtggcaagggacgnaaggggctccgcaagggcggcnccatancgctacatgaaggttctgcgccgaaaanatccagggcatcaccaagccggcgattcngnggctggcgccggaggggcgggcgttaaagcgnatctcaagggctcatctacgaatgaanacccgcgggngtgctcnagnatcttcctcgagaaacgtcatcccgccgatgcccgtcacctacaaccgtagcaccgcccgcccgcanagaacgtcancgccaatgggacgtcntcntacngccgcctcaaaggcgccanggggacggcacccctnctaaccgggtttcgngtgggnataagggnccttgccaanattnccacaanangcttngaattggaaacccccggactntgntctantttcgcctggttttcccngnagntaagctcccaatttg

SEQ ID NO: 96940 - DNA, 211 bp, Triticum aestivum
  unsure (1)..(211): unsure at all n locations
  Clone ID: PAT_TA_96940
aacaatggtttcttcttttnattggaaanggttgggggcttttagcntcaaccgaatnnaaagaaacgcctccgttgngananttttgnccaccgggggtggncccccacanaanttggggtanaaaccantttggntttcctccnccngccggnaaaaagaattcctccaatgggaggnaagtaatttcnaatatttttttgccaggttg

SEQ ID NO: 96941 - DNA, 529 bp, Triticum aestivum
  unsure (1)..(529): unsure at all n locations
  Clone ID: PAT_TA_96941
gcccgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggcgagcacgtcnacgtcaaggtgaacggcgccgtccacaagggcatgccgcacaagttctaccacggccgcaccggccgcgtctgcaacgtcaccaagcgcgccatcggcgtcgagatcaacaagcaggtcggcaacaggatcatcaagaagaggatccatgtccgtgtggagcacgtgcanccatccaggtgcaacgagggagttcctccagaggaaactcaacaacgacaancctgaaangcggaggccaangcgcgcggcgaggtcatcaacaacnaanangcaaccaacaagggccaaagcccngggttcatggntgaggggcaccnncatccaagacggtcacccccan

SEQ ID NO: 96942 - DNA, 302 bp, Triticum aestivum
  unsure (1)..(302): unsure at all n locations
  Clone ID: PAT_TA_96942
ccaagtcntgctcaaaggggcccctnnangggtaacgcgtccccngtggnccnctcngggagattttctacccactctaccccgggggggaancttccaaccccttttggctaaccnacgaaccnggggngtttgctgagctcaaagngaaagggaatcaaaaacnggcgccctgcaaagttctccangtttggntaatttgtgnangncaaccctcactggtaaaggnncgcngggagaaaactccnctgaacaactcncccgaccctgttaaaaaaaaaaaagcgtgggggctttcccca

SEQ ID NO: 96943 - DNA, 472 bp, Triticum aestivum
  unsure (1)..(472): unsure at all n locations
  Clone ID: PAT_TA_96943
ttgctgaaaccanactcccactggntccgctctgccgtccggganaaacaacggcctaaatggcggcagctgcccccccgacggtgcacctaatgcaaanggcaccncggaggaggggnnaccccctnaaaggganggcgttccccnctgggacntggtgccnctnatngtgaccatggtggagcacgtccacaaacaaagggactgggtggtcaccaaatccatattngnatctcaacgacaccgncatcaanaagcttctacacgttctacnccatgttcaccgtctgggggngtctgcttttttccgtccatnaaaggattcnattctacnacaagcgaagtattacaaggggggaaagggggttgattgggaaccgttcaaatgggtaataacaaccggggaaanaaggacatccaaggcnaacggggaaaggggggatttnctnaagggaaagancttcnttttgga

SEQ ID NO: 96944 - DNA, 484 bp, Triticum aestivum
  unsure (1)..(484): unsure at all n locations
  Clone ID: PAT_TA_96944
aacaaggacaaaggggaatcntctgcttctcanctctgatngttcccctcanctctctgggtctctcgggacaanacttcctccaatacgcaccaaccggnaaaggggcgccctccggggggcggggaacaacgaccggngacttacttnaaaggagcacggncaacantatggggaccaaacggnacantccttantctgttcttcctacggnggacanggatgaagacaatgtttaccgccggttnanatacactccaaaatcctttagggaggattccgtggaagtcnattgccttaacaatgttcctcctcttcctgggaanctctcctccccctccctttcaaaatttaaaaccaacggggtcacatgggagggtgataactctcaaggggtaagggccaaatggtcctggggtaacccttgccttttcntccctggattttatgaaaacccgagnttgcaatactaattcaatngggg

SEQ ID NO: 96945 - DNA, 173 bp, Triticum aestivum
  unsure (1)..(173): unsure at all n locations
  Clone ID: PAT_TA_96945
caatgggatctggantgggtcctcttgtgctgnttcantggctggaatgctgccnccnccccggcgaatggtggtggnggcgaattgtctgangntgaaatantaatcccaaaanctgccccaggggggnggagattntcaaaggagcaagtgaggaggntgtttnaagagca

SEQ ID NO: 96946 - DNA, 236 bp, Triticum aestivum
  unsure (1)..(236): unsure at all n locations
  Clone ID: PAT_TA_96946
ggctgcaagnatccgnacgagggtgtctccaccccgtccgcantctttgggcancggggnttgggtccnaaacaaaaaaaaatccccnaaaanagagctgttgttctgcgcnagtaacaaatggngaggntaaagccnaaacagttgctaattcaaagcaagacgaagaagggnccatcacnaatcaattattctagcatcatcacctgggnaactgatcgtcngcntgggtgtgc

SEQ ID NO: 96947 - DNA, 593 bp, Triticum aestivum
  unsure (1)..(593): unsure at all n locations
  Clone ID: PAT_TA_96947
ggaacaagggtggtgtcatcaaaggggggtggggggaaaaangnccccacccggggccaaggntaacaanggntgccatcaaaaaaaaataaagngcgctatcttgcanaanggttttgttcacggggcaatgcttttgttgcttcaaaactcntatccccgagcgaagcaaagatctgtctgtccgtttaantacngtatttctantccnggcgtcgggntaaactcctgtgccccctgaagactgatttgttggtgaaaatgcaaaaaaaaaaaaaaaaaaactccaanggggggggcccggtaaccaaattcncccctaaaantggagtcgtantacgcgccgctcactgggccgtcgtttttanaaacgtcnctgaaccnggggaaaaaccccngggggttaccccaaanttaatnccccctttgcangaaaaaacccccctttccnccanantgggggttaannaaccnaaaaaagggccnccanccgatttnncccttccccaaaaaattttggnaaacctgaatngggaatggggaccccccctgttnccgngcnattaaaccnccgnnggggnttggngggttnc

SEQ ID NO: 96948 - DNA, 346 bp, Triticum aestivum
  unsure (1)..(346): unsure at all n locations
  Clone ID: PAT_TA_96948
aaagattttagcaaatttctgagttnctccaccaaagctgtgagcanctgcctgnaaatccaaaangngcacgggaagctgntcaangggcttctccaaagggctggngaanaaaaangggatcgagaanctcaanggcgaggncnanaaatttggccncncctttgnaangcctgggttctcgctcnaagagcatgaaatataangngtaggatgatgatacanatggggtgggtgtctccccnaaancaaaccaaaaaggccncncctcctctaaaaccttattgggcgcccccgcgaaagnccccctntgcttnttacnaaaattnttctgggccncccctgg

SEQ ID NO: 96949 - DNA, 462 bp, Triticum aestivum
  unsure (1)..(462): unsure at all n locations
  Clone ID: PAT_TA_96949
ccgacactcatntgattacccactaactnnctagcancttnaggnacttccanctagcgatngatgggtcgtctcaanaacaagggtgtggtgtccgccntggtcctggcgggggtggngctaatgatggncggcanggaggngaccggactgtcntgcgggcangtggactccaagctccgcgccgtgcgtgtcctacgtgacggggaaagngccctcnattancaaagagtgctgctccngtgtgcaaggggtgaacgggctgggccccaacaacccggaccgcaaaataacgtgcaagtgcctnaaaaacctcnccaacaacatcaaattcatcaacaatnggnaaaaggcctcccggngtgnccggnaaagtgcgggggttaagcgttgccctttcccatcaagnatgtcaaccaantgggaanaaatgntnaactagnttaaaattttaaccccttc

SEQ ID NO: 96950 - DNA, 674 bp, Triticum aestivum
  unsure (1)..(674): unsure at all n locations
  Clone ID: PAT_TA_96950
cccccggggctggcaggaattccggnccagggagaacgctgtggcanaactggataaagtttaaaaacaagaaagggttantccccttccagatgaacctanaataaacaattttgagggaaaccgtccgtccaaagcaaaaaagaaaaaaagatatccaagttgcaagctactnaaaatcagggangggnggtgaaaaattttcaaccatccggaccaactttggctcaaaaattttccctaagccaagacnaaaagctgctttgggcggggtaacactccacaagctccaagggcttttcctatcctnatcccaaacaatgtnacctccgggtagncctcctccccttaatgggttatggggtggtaataagtgggagtcaanttggctttccaagtggacnagtttaagaagctcngtcctgggccnggacaaggtcctgaagcccacaagcaatccnagntttctggttgcangctnccttccagctttctccttcaaacaacacaattggcaagggagnttggacaagttacnagcgaacgntactccccaatctggctgggggctcaatccgaacaaccgtttaaggtttcgttggcncanncccaacaatcctaanaccctgganccttttanggcttccgggccangggccaattccnagcnattg

SEQ ID NO: 96951 - DNA, 438 bp, Triticum aestivum
  unsure (1)..(438): unsure at all n locations
  Clone ID: PAT_TA_96951
agaacacatccaaacatanaggggggggcaaagaaaatacaatcgcaacatttngttcctaaactgtttgncacncccctaaagaaatggtcatcacaaacangcctcctaanctggggtgnntaaagtctaactcnntcaagaatactcatcanggtnacanaaaacgnaacgggggtctccaaacaacatcgggtggaccaagcttganccanncggattgggggacgctccctggaaagaacaagacaaatggtcgcaaattaaccttttgaggtncatcantcangcaagtaatcctttttancattaatggctcaanctcctttgggctccgggggctaaagaaccaaaatnctccctcggggaaaagcaaataccgccccaaagggnntaaacctggnaaagcnactttccctcangattctaaagaagcgt

SEQ ID NO: 96952 - DNA, 481 bp, Triticum aestivum
  unsure (1)..(481): unsure at all n locations
  Clone ID: PAT_TA_96952
gccaaaaaagaagccgngccggggaanggagncccccnccaaatttnggttcctccgccgcgaaacaaaatggggggtntgntgatgcgcaagntcccccgggaactaacgcgggcgcgcgcccctnggcgccgccgccgttngggggggccgcgttcttntanagcctcgtngaaacccancgtctcgcanatggaggngaaaggggagggacgcccgctgcaaantttgctcttaaacctgagaaatggggtagaaatnaaagctccnngnagaaaaggaaacanttttgtcntgattcaaaagctaatnaaaanttttcgttttggncccanctaccaaactggggcctgggatggttgcctcangttctccgtaaaaaangggncccccaaaaggtcnaaggaantgggggggaaaaaanaaaaaaaanntttttctccccggttaaaaanctatttctngagnccanaantctaaa

SEQ ID NO: 96953 - DNA, 518 bp, Triticum aestivum
  unsure (1)..(518): unsure at all n locations
  Clone ID: PAT_TA_96953
aagaaaaatggggagccccaanaaataaanatgttgatttctaaccanaagtgntgggctaatggtgtttccgaatccctcatnaaaaacaatacttntgacggtnacaaaaatctggncattncatatgancaagaaaaaacactggnaggctcaagtngatattacgccaaatacttggnaacccgatttaacaagggggggntcaaactaaattggggactgnacaattttngtncggggccaacctcaanactggagattggggatnaagtccaaccaangatgatnttatgttcaataaatacccccaaagaaccaagtttgagtnccaaaaaactccccctcaagacctaagaaanaggnaccangctaanctgggggattcttcangcctccttccgccttcaaaatgcntccctcgggtccgggggtcaaaacaaaaggattttcaagtananggctcccctttcgaggaattccnaannatcaattaggcctccaancnancctcaatc

SEQ ID NO: 96954 - DNA, 536 bp, Triticum aestivum
  unsure (1)..(536): unsure at all n locations
  Clone ID: PAT_TA_96954
gaacaccgggacgaagcanatngggggggcgtcactccaatcaccggttaggataaatggggacggtttcngnttctctggnctgggagctcntcaggaaaaacaantgcttnctgatnaancagttcngnaacancaatgccaaggtccaattcancaangngcccaacaacctctacaatgtncactcctacaagtnctctggcctggcaaacaaaaanantgtgactgtgcanccaactgctgataangagatgaacgtggtcctctccacaacnaagtcaaagaagcaaaacaagcctgctggcttcacccacaaaactgtcatgcgcaaggngtttcgcaagatgggcaangntatcaagaaacangtcagtggcaactactacaagggctgacntngacaaacctggtccttgcaagantggagcgctgtttaccgcaanctccaangttnccaaagtccggtgtccaaaaanaaaaaaaaggganttancactgggggggggcaaatgagcntttttttntgggtttgt

SEQ ID NO: 96955 - DNA, 594 bp, Triticum aestivum
  unsure (1)..(594): unsure at all n locations
  Clone ID: PAT_TA_96955
aggagcggggnaaactcccaattncgattaatcancaaacaatgtnctgctggggggagggnaantgcngggtggcggggtttcggntngcaantgcgggnaaacgntggcgggaggggtggaaaattttccctnganatgggcccaagggaatgaaaaancgccctcccaanancctcancaatggggcgtgggcccctccaaaggnaaccccttnttccanggccccgccnaanaaacnggaggggtngnaaanttgcgggcccaacttgnaactggaaacccgtngcaactgnaagtnattcaatgagggcctcaatncaaatcaaattaaaggagaattgcaatgggattggcctgattgaaanggagcgaataattaattattgcaatgaatccncaagccgtgtggntttcntttttaaaattgncaacccaaaaanaaaaacaagatttatcgtntcctatccaagcctanttttatggggntttaaaaaaaaaaaaaaaaaaaaatccnanggggggggnccggtacccnaattccccccaaaaatgaattctnntaacccccccncnaaanggccgtccntttta

SEQ ID NO: 96956 - DNA, 368 bp, Triticum aestivum
  unsure (1)..(368): unsure at all n locations
  Clone ID: PAT_TA_96956
ggggggngggggaaatggggccgcgcacnaacaatggtgaacaaanaanaaacggcccctccgctcngtcatggggcaaaaaaaactggttattncgnggccggtccctganagtcnccttnccttnganctcccaaccccgagtccaaagagctttggggcttnccanccaaaggctctgttcgccaagcgtnggaactcaacctgtcccaacggggngcccccgnccgggtancgccccgaancattacngggaaaggntccggncccgcccacgacatngcaaaancaaacttcccaaaccgcngggcgaaggcggggccgtccaanaaaggcccnaaaaaggggaaaaaaaggcaaaaaaagca

SEQ ID NO: 96957 - DNA, 179 bp, Triticum aestivum
  unsure (1)..(179): unsure at all n locations
  Clone ID: PAT_TA_96957
caatcaccgtgngccntaaaaccaaaaacnacntctccttccactgancaatgcctaaacctgggntcctccttcccttttggtggtaataaccggccccngggaanaactcnaaaccaagaantgncgcangacantaacaaccgctgctttgcngctgctgnaagtgtacaaccctc

SEQ ID NO: 96958 - DNA, 191 bp, Triticum aestivum
  unsure (1)..(191): unsure at all n locations
  Clone ID: PAT_TA_96958
tccagggtttncccccgcggccccggcgtcatnanaaagtacggggaaatngggggnttcnctncccnacgaggggtcaacaanggtagtccccgggtaaaaancccaaatgatntcccaaaaacncnttcaaaanggggggagcgttggnaaaaggnggtnaaaatctgggnntcccccccagggtttac

SEQ ID NO: 96959 - DNA, 703 bp, Triticum aestivum
  unsure (1)..(703): unsure at all n locations
  Clone ID: PAT_TA_96959
agacnanantaaaantgggctcccgcggggggggcnctccnaaaanagggttccccgggcgncaggaattcggannaaggggatttcttngggggaatccaacggcaactncttcncaacnaggaaaccgcgncggctttccttnnccccggaagttcgttagccccgggcaaccttncttggaggttcggccgcctcctngccccctcctcctcgaagcaacaaacggntcncgattnccaaatcgcggccggcccgggaagattttgattcangggggttncccgggtctccccatccaaagggtcaggggtcaataactccnctccnggncaaccaatggcangggnaattggacangggntcnaacaatcaaatttctcaaactttgaaggcaatccttcaaagnccnaagttatgnttcggaaacaagggnnatgctggaaccttgaancnaaaaatttngaaatggggctggttaaatnatcccaaaagaagaacaagcttatgccntctttnatgtttggacaacnatcccgaatgtngggnaataantttttcaattggcnngagaaatgaaatcctattgggaaggggagcntttaccaaattttatgccnaaaaaatgcngnnttccctggtgggccccccncctggaaaaaaaataaagaantganggagtcaagtatgngtatggcctccn

SEQ ID NO: 96960 - DNA, 473 bp, Triticum aestivum
  unsure (1)..(473): unsure at all n locations
  Clone ID: PAT_TA_96960
agaatctggatagctttagatnacaaccaaaacaggnaaaacattctcaagttnaacctaaggnctccaaccgtttaaaaaaaatggtgttcaantatgtctgcaaacatgacatggacgcaacatctaagaaaatccaacgagtaacatgcagcaagctcttcannctaagctgtggnacccttgcccttcttcttctggagcttcctcatgtaaaactccanctccttgccctccangatgtaaccatcaanctctgncanactgtccaaggngagacgaaaatgcanggcaacaagncttccaccantgaactgntcctcaatgtgcngagtccantgtaacgtccctgntggggcttctcaaagcttcctctggnacaatgntgctcctctttgcttccncccgngggaaaaangancaaactcaaactccttggccctnaaacaaggttcttcttgggaangtgggtg

SEQ ID NO: 96961 - DNA, 488 bp, Triticum aestivum
  unsure (1)..(488): unsure at all n locations
  Clone ID: PAT_TA_96961
gaaagtccctcccctttnccctcccccttnccctccaaagncgggggggggttcanccgccgccgcctgaatnccttccccctcctcccggcaatanggganctgcgccnccgtntccntttcccttcttnctcgcaaacaagtcaacaagtctcctccctccctccctttgngattttnggagtaaggnganaggncgaaccatggggaaaaaaaanggggntggntaaaccnccacctatggaagaggntggggcaaagctcnatacgtcttctcctgnccantctggnaaacatnggagnaacgttgagtgtcgggttgantttgaaaaatctggantggtgagggtaaatgncnaaatctgccaagaaaagncttcancancnatggcaaatgnnctgnactggaacntattggttgtttacaancngaatnggtntgattnantgcgaagcgcggtcaacactggtttnaagantaatgntgg

SEQ ID NO: 96962 - DNA, 363 bp, Triticum aestivum
  unsure (1)..(363): unsure at all n locations
  Clone ID: PAT_TA_96962
gggtcttcctgggcatcaacaanggncacgtcgtcaccaancgcgagctgtcgccacncccgtccnancgcaaggggaaaagtaccaaaagggtgcattttgtcangaacttntttatggaggntgctggattcnctcccnatganaaacntatcactgagcttcttnanggtgggaaagacaancgtgcactcnaaggnccccaaaaaaaancttggttctcacnngagagcnaagaanaanagagagggggatgtccantgtccttaanaaaannaagtcccctggtgggggggngggtgctggtgacaaaaaaaaaanaaaaacgtggcccaattgnggaaatttntcccnnaaaacccc

SEQ ID NO: 96963 - DNA, 570 bp, Triticum aestivum
  unsure (1)..(570): unsure at all n locations
  Clone ID: PAT_TA_96963
ccgacaaaggnccaaagatgggcaaagccctgtgccttaattttgctcaanggggaactcccccntggcttccctggtanggatctgaaangggccctggcanggggggttaaancaaagacntanccctaactggcgcaatncaaggggtgaccaatgcacaanagcactgcgaaacaanganggggntacccntttngcgggagtgtgacaccgnccaaccaaataatcctgaaacttanttactggcgccctggcttccttccaatgcctggantcctgcctcaaattgccntcaaggatggtgnaagcaaacnatgcaataaagatnttaaagggngaagnccgtctgttacaacccaaatatttccaaaaatttgggaatgttngaataaantnanccaatcaattaanttnttaaaaaaaaaaaaaaaaaaaaaaactccaaggggggggggccnggtacccaaattcncccctanaaangagtcnttaatnacccnccctccacngggccggtcgttttaaaaacgtcctgaactggggaaaaaccctgggngtttcccaant

SEQ ID NO: 96964 - DNA, 161 bp, Triticum aestivum
  unsure (1)..(161): unsure at all n locations
  Clone ID: PAT_TA_96964
acaacttnggtgttaaaaccaaaataaaattttcccacaanttgttaagttaattnaaaaatcaaatctctcaaaaaatngaacnnggaccaatntaaatcaaattttgtggagagggttacatccgcacacaaggnagatttgtttacccaatgggggcc

SEQ ID NO: 96965 - DNA, 677 bp, Triticum aestivum
  unsure (1)..(677): unsure at all n locations
  Clone ID: PAT_TA_96965
cccccgggctgcaggaatccggnacaagggaaagangggcctccccaagnggtcccttcacaaagggggccanangcattngccgatntccccaatttaagggttgcccaccggtattcaaagccnacctgcaactttaccccaaagggattttacaagnaccaagtttaatgtgggaccggggcaaatgggagggcaattaacnaanggggcaaacctactaataaacggggagaagttatggggggtggggaaaacaacttttgttaccttgacaaaggggaaatttggcccaacaatnaaataactggttactggaanccccaactaacaacctngggaaacaaaggatgggattgttgggacaaatngataagtttttcaaaccgaatnggggttccgnttgtcccggattgggggccccttccaagggaagggntctcccaaagaaattttcaanagtcctgcctaatacaaaattctccnaaaggtgtcntggnttgcccngaagtanccctggaatggcgccataacaagggctaatgaacctaacctaccaanaattctggggaaaaggnccaattggcncccggggcaattaaantttacctgtngaagccaatcctttcccaanantcccccaaagnaacaaaggggaattccctggtgggtnccnc

SEQ ID NO: 96966 - DNA, 500 bp, Triticum aestivum
  unsure (1)..(500): unsure at all n locations
  Clone ID: PAT_TA_96966
ctccctcccggcgatggcatcggcgacgacggcggcggcggagtgggaggccgcggcgcggaagacgctggtggcgcggaaagcccggcttcgggctccccaccgcctgcccaacctgcctccccgtcctcctctacctccgcatgtcccaggtccccttcgacatccacgtcgactaccgcttccccgacgccgatcacataccatatgttgaatttggcgagtgtgtcgcattcaacaatgagaatggaggtgtaattgagtatctcagggaggagaaaattgttgacttgacctcaaaacacccaaagcgtttcttactcctgatgtactatccacaaagggccatgatttcgacctggcttgctgatgctctgcaatacgaactttggggtggcaaatgatgggggctcatggggagcattgcacgaagaacaatntaactttttctgatctcccctgggcctaattgggaaaggtactccanctgggangaaaac

SEQ ID NO: 96967 - DNA, 472 bp, Triticum aestivum
  unsure (1)..(472): unsure at all n locations
  Clone ID: PAT_TA_96967
cggcgcggnagaactactggcaggtacccgacgcccggcancancaagccatggttggcgggtanctgcngccgcnagtggggatngccccngcaactaccgtttgcccaggcancgacggccgcggnggggcatgcagcaanaccaagcaccagcaccatcaggcggtgatggcgcaacaacagcancagcagcaggcggccgcggccgtntcttaagcgcgcgcgcccaaaactacggcgaatgggcctggaggacaagaagatngnctgggatattatccgcggggaaaaatgcaggttaccacctcacntagaagacaatgaagcaatttggagcatctttacnacccgcctactttaccgcaattgggatgcccnttctgttgggcaagccnaaatgaaancaaattnangggcaagttggtttggttgccaattggggtnggaagcctgccaatgggtttgggtgg

SEQ ID NO: 96968 - DNA, 314 bp, Triticum aestivum
  unsure (1)..(314): unsure at all n locations
  Clone ID: PAT_TA_96968
gaacgaagcacaacacatctgtctgtcttccttcattcacacgcgcgtgcgcgcaagagggggagagaggggattcctggttcggtggcgctcggcgatgtgatggcgcagccgcggcagcagnaacgacaaggtcncctcgtcgcggcgctcctggtgctcctctccctctgctgccttgctcgcctcggcgccgcggnttctgcagcgagtgctgaccctcaccggaaggatggagcggcgactgcgctgggacaaggccgcgccacaggaggaggaggcagtgcccggtgttcacggttnaccaccgnggc

SEQ ID NO: 96969 - DNA, 233 bp, Triticum aestivum
  unsure (1)..(233): unsure at all n locations
  Clone ID: PAT_TA_96969
gatctctcgcctcccgggccctcctcgagacggnatagctgattggncgcgctccgctccgcgatgctcttcgccgccgccgccgncgacctcggcctccggaaccctgatcgccgccgacaagggacgtnaaccgcaaccgcaacgttgccacgcgcaccaatagccgcctcgccgccgcgcggtctgctcccccggtggcggagaccgccgaatncgggaggtctttgaag

SEQ ID NO: 96970 - DNA, 254 bp, Triticum aestivum
  unsure (1)..(254): unsure at all n locations
  Clone ID: PAT_TA_96970
aaagggtgggcttnaagccaacggggattnttatagagatgttacttnaaagtctggggggtcacactgaccccctnntcnagaagcagaacaagatnaccctgggcacacatagtagcaacantngtanacacctcttaagcttcggggtnacccanttcngngagcctgnggggtgnctccntgtagtccncaaaaaaagncctctcatccgnangcaaatttctccacaanagggnggggaaaaaaggnca

SEQ ID NO: 96971 - DNA, 508 bp, Triticum aestivum
  unsure (1)..(508): unsure at all n locations
  Clone ID: PAT_TA_96971
ngcancaanccccattttcacaacaacgaccacnattttctcaagcagcagcancaaccaagttctaccgcaacaancaccattttcgcagcagcancaccaccaaccaattctaccgcaacaancacctttttcgcancaccaacaaccgggttcttccgcaacaacanataccatatgttcagccatctatcttgcagcagctaaacccatgcanggtattcctccagcagcaatgcagccctgtggcaatgccacaaagtncttgctaaggtcgcacatgttgtggcagagcagttgtcatgtgatgcagcaacagtgttgncagcanctgccgcgaatccccganncaatcacnctatgatgcaatccgtgccatcatctaactcgatcgtccctacangnaacaatcaacatggtccagggttttcaatccaaacctcagcagcaaaccaacccccaacaagtcggtccaaagggtgttctccccanccccaacnagcaacac

SEQ ID NO: 96972 - DNA, 500 bp, Triticum aestivum
  unsure (1)..(500): unsure at all n locations
  Clone ID: PAT_TA_96972
gctgtggtcaatacaaatccaccatgaagacctttctcatccttgccctccttgctatcgtggcgaccaccgccacaactgcagttagagttccagtgccacaattgcagccacaacatccatctcaagcaacagccacaagagcaagttccattggtacaacaacaacaatttctagggcaagcaacanccatttccaccacaacaaccatatccacagccgcaaccatttccatcacaacaaccatatctgcaactacaaccatttccgcagccgcaactaccatattngcagccacaaccatttcgaccacaacaaccatatccacaagccgcaaccacagtattcgcaaccacaacaaccaatttcacaagcagcagcaagcaagcagcaacaaacaacaacaancaagcancancaacaaatccttcaacaaattttgcaacaaacaanctgattccatgcatgggatgttgtttttgcaagcaaacacaacatn

SEQ ID NO: 96973 - DNA, 540 bp, Triticum aestivum
  unsure (1)..(540): unsure at all n locations
  Clone ID: PAT_TA_96973
gntttatcngctntttctcttcntnttcntttggcnttcancgcncgtgggnggacgntctagaactaagtgggntccccggggctgcatgtttttcctcaacttcncccctcgccttnctcctggccctcccctcctgatngggagtctcaagccgcggncaagncangggngaaangacctacccccgttngtcaagcgccgaagtaccanngaggccggtccgaagaaggccaaggnaanaagctccgcgcccntcatcgccggagaaagaactgctcccccgctcatgctccgcctccgcgttgggcactccgctgggaccttcgacgtgtcgtccaaagacaaggcggcccgttngggggaccgattgaaanaaacgccgggcgggnagcaaaggtggcaacgncngccaaacggcggggccttgggacaatcgccngttgncgggantgctccganncccaatcaaanggaggggagnattccccnaaccaatcctccnaaangcttgantcttcctanccaaaatttgccggg

SEQ ID NO: 96974 - DNA, 585 bp, Triticum aestivum
  unsure (1)..(585): unsure at all n locations
  Clone ID: PAT_TA_96974
ctgaacctgatggcgaggaagatgaacggcacngcctcccgagggggagctcaaaggaggcgttccgccgtgttcgacaaaggaccaagaacggggttcatctccgcggcgggagctgcngccacgtgaatgaccaaacctccggggagaaagctgacggacgaggagggtggaccgagatgattccgggaaggcggacgttggacggcgacggccacatcaactaccnaggagttcgtcaaggtcattgatggccaagttaggtggcggcngggaacaanggggtcttcccctcccaccnaaaataaggcttaaaanttcaaaggtggatttggaantgccnanaacanactccgccgttggttgtaatttttgtggctaatgntttttttaaaggatacctgtntgcctggtttggggtantttggnccngggttaatctatcnttgttncccggtggttnnnccttggggggaagcaagcnatccgnggaatttaactaccctggcttttctttttggntttaacaacaaacccgccncncnccctcctcccaaggggggggggccccggttaccccaantc

SEQ ID NO: 96975 - DNA, 509 bp, Triticum aestivum
  unsure (1)..(509): unsure at all n locations
  Clone ID: PAT_TA_96975
tgaaanacccccgctccctctcccacctccgaagcagcagcagccatggcccccaaggcagacaagaatccggncgccgagagcaaggtcgagaaggcggcggagaanaccccggcaggcaagaagcccaaggccganaagcgggtgccggcgggcacaacggcggccaangagggcgccggcggcgaggggcaagactcggggccggaagaagggcagtaaggccaagaagggcgtggagacntacaagatctacatcttcaaggtgctgaagcaaggtgcacccgggacggtgggcatctcctccaaggccatgtccatcatgaactccttcatcaacgacatcttcgaagaaagctcgccggggagtcngccaaagcctggngagggtacaacaaagaagcccaccatcacctcccggggaagattcaagacctccgttccgcctcgtcctccccgggagaagctcgccaaancacgcngttctncggagggncaccaaaagggcg

SEQ ID NO: 96976 - DNA, 518 bp, Triticum aestivum
  unsure (1)..(518): unsure at all n locations
  Clone ID: PAT_TA_96976
gccaagatgagcaccatgttcgtgctccaagggcaacaccctggacccgcgcatggggcgcctccttcangatcccgccgcctcgctctccatcttcgacaccatcgccgtcatcgtgtgggcgctcgcctacgaccggctcatcgtcnccgccgcacgccggatcacgggccacccgcgcgggttcacgcaagctgcagcgcatgggcatcggcctggtgatatccatcttctccatggtggccgccggggtgctggaggttgtcaggctccacgtcgccgcccaacacacggcatgctggactccaaggagtacctgcccaatgtccaatcttctgggcaaggtgccgcaagtaacttcatcgtggggcgcggcggganggtgttcaacgtttcggtggggcaagatcgaagtttctttctaacgaaccaagtccccgggacgcccaatgaagggaaccaatgggggtcggncgctgtcgcctcaacggttcaaacggngggtgggggcaanttan

SEQ ID NO: 96977 - DNA, 408 bp, Triticum aestivum
  unsure (1)..(408): unsure at all n locations
  Clone ID: PAT_TA_96977
cacactctctgatcagagtagcactaagcttcagctagccagcctctgccactccggtcattttcttgcatccacgacggcaatggccaccgctgatgtccaagaacccatcggccgcgctgacggaggaggcgcccgcggtggataagccggtcgccgccgaggaggtcgcgaagacggaggaagcccccgcgccggtggaggccgaagtcgaggcgcctgcccccgtcgaggttgaggagaccaaggaggaggcgccggcaagcagttgangcagaggagacgaaaggagcccggagccaagcaagcttgcgggcccgaaaccgggagggccgacgngcccgcccgtggtccgaagaacaagagaccaaagganggcccgtgggntgatggcaacaacccggcngc

SEQ ID NO: 96978 - DNA, 578 bp, Triticum aestivum
  unsure (1)..(578): unsure at all n locations
  Clone ID: PAT_TA_96978
cctcagtcctcacagcatcctctcaagtccttaagcttccttccctcgccgccacccaccaaggaaaggaggatgtcttgctgcgggcggcaactgcgggtgcggcgccggctgcaagtgcggcaaacggctgcggcggggtgcaangatgttccccgacgtggaggccaccgccgggcgccgccgccatggtcatgcccaccgcctcccacaaaggggggaagctccgggcgggggttcgagacgngcccggggggangaaccgggcgggnttgcgacttgcaccaccctgcaagtgcgggcaccgccgtgccgggcttgctccctgcttgcaagcttgcaaactgaagcccggcgccccaaggaaggggccgggcccgggcnaagaagggccgaagcaacgnagggattgaagggaagggacaaagcaaaggcaaangcnaccaattcaccaaccaagttcaaccaaccaacccaagcgttatcatccaaccaagcccggcccgcaatggccgccttccccggggcgcgncgncgccttgaatnaaaaattaaaaaccaacccgtttccgtngttn

SEQ ID NO: 96979 - DNA, 597 bp, Triticum aestivum
  unsure (1)..(597): unsure at all n locations
  Clone ID: PAT_TA_96979
gcgttacgaggcaactagcattttgtcattaaagttcgtgaaagaatgtttccgttgggaaaaaccaacgccgatctaaaactaaagtcttcctttcaaaaggtggagcgaagcaagagctgaaaaagatggagttaccctgggagatgaagatttctttctaacgggatatgaaagggataagaaaatatgttaatttgctgctattctatttatttgtggcattaaagttccgaaagnaaagatcttaaatctaataatggaaagaaaatggataagtaagncttgttggttttataagggctttctcatattcaagtccggggaaagaagtttaagggtaaaaggactttcaaaaggaaaaactcctccgaacggggggaagaaatcngaagtctatttcaagggaaaggaaatttgctggcaaattccttccaaatccctaaacgnaaagtaaattctggggaggggaatcccaaatggaaacaaacaaaccgatttaacttaagggattcaagcctttggcgaaaanttttgccaagcaanccggtanagtaagaaaatccaattaaaccaaacngggcaacgcctggtgng

SEQ ID NO: 96980 - DNA, 494 bp, Triticum aestivum
  unsure (1)..(494): unsure at all n locations
  Clone ID: PAT_TA_96980
tcgagtttttttttttttttttttagcattattttttacatgtcttatttctgtttacaagtctgggctatttacagaatgtaccgtatacagctgggaaccattgagacgcanacttgggactgatatacatatagcacacgaaatgagggggcgtgaggtggtcaaactttacacatttggntatttcagaacataaataaaaaaagaaaaaggttaattttacgggcactcacgttgagctgcgantcgcttcatcattcatcatcccttgaaaacttctggccanccagatagtcgtttctcgcggggacaccttcgccttcccgaatggcctcagaaccaccgcaagctcctccaagcctgttgttttccancagatcagcagaaagctccaaggagccccttcaagnagcctcgggatngtttgcccnaaagggacttgacatcaaagcatttcctttgcctgaggttgccagtaatttccttttgnn

SEQ ID NO: 96981 - DNA, 536 bp, Triticum aestivum
  unsure (1)..(536): unsure at all n locations
  Clone ID: PAT_TA_96981
cccctttcttcnccccgancgccgccgccgccgncgcctcctcctccncggttccctctccttccttcgagagcttcagccatgggtaaggagnaagactcacatcaacatcctggccattggccacgtcgactctggcaagtcgacgaccactggccacctgatctataacgcttggaggcattgncacgcgtgtgatcnacaggntcgagaaggaatccgnctgaaatgaacaanaggtctttcaagtacncctgnggtgcttgacaagctcaanggccganncgtgacgagggggttatcaccatcgatantgcccctnctgggaantttcgangaacaaccaaggtactaactgcacccgtcattgantngcccctgnngccacccgtcactttcatnaaagaacatgtatnaaccgggtancctccccaangtctgacctgtngntggttcttcaatcaatccgactccaaccaactggttgggttttttgagaggctnggnnaatctcncnaaagggatggnccnaagat

SEQ ID NO: 96982 - DNA, 577 bp, Triticum aestivum
  unsure (1)..(577): unsure at all n locations
  Clone ID: PAT_TA_96982
tctagcctctcaccatctccagctgagttcaacacgattactactgcaaactcnataaggatggntcgcgggtgcanctattccgctcgtgctgggtcgccatgngtgnccactnggggggggncggtancnancgacgcgtgccatctcctgcggtcagngttgacctccgccttgaanccccttgcatctcctatgccccgcgggcaaatgggcngccaaacccggactgctgccttgcttgcaagccgggtgtcaaggaagtctgggccggggggcaagccccgggancacccgcctgnacaaagcaaaagcgggcgttgcaangtgcatcaaaagaagccgcttgccgggttggggctcaaaccncttnggcaaaaggcccgcccgngcnatcccctccaaaagttgccggcngtcaagcgtccccataatgncaaatcaaagcgctaaaccgtccgaactgctctaaagatttccgcttgattcaaaccnacttgcccccaaccaattggcttggcccgttccaatantcggccatccaatcaancggcttngaagttattncttgaangtn

SEQ ID NO: 96983 - DNA, 560 bp, Triticum aestivum
  unsure (1)..(560): unsure at all n locations
  Clone ID: PAT_TA_96983
gccagcctcagctcacccgaagcaaagctagcgagtagcacgcaatggcgggcgcgaccatggcgctctcctccccggcgatggcgggcaccccggtgaaggcctccaagggcggcgcccttcggcgagggccgcatcaccatgcgcaagacggcggggcaagcccaaaggtgggcgggcgtccaagcaagcccgtggtacgggctccgaccgccgtgctctacctcggccccgctctccgggcggaccccccggaagctacctcacccgggcgaagttccccggcggactacggctgggggacaccgcgggggcctctccgccggacccccganaccttcgccaaaggaaacccggggaagcttggaagggtgatccaacttgccggctggggccaatggctcgggcggcgctcgggcntgcggtcttcccgggaagcctgctcgccccgcaaacgggcgtncaangttcgggcgaagggcccgttgtgggttcaaaagggccgggctccccaaaatttttcaaancgaaggggcggggccttcgaactaaccntcggg

SEQ ID NO: 96984 - DNA, 451 bp, Triticum aestivum
  unsure (1)..(451): unsure at all n locations
  Clone ID: PAT_TA_96984
angnnactttcnccttgcaccctctgcncattgatcaaccggangancgaaaaccatggtccgcccgccgtgntgcaccatttcctcctcctcgccgcgctcctcctgctnatngggggggggcctcctcancggngcagacgtcgtcncgtgcnggnaaactggaaaangtncgcatgggtagctctactaccgaagtctctgtnctccggnntcatttcaanttcatgggtgggacaagcctccgccaaatagttcttcangggacggngctcctccnacntccngcgagnaccctcaacccctgtnttcccctacgtgtaaacngccaatgntncnaaccgtcgccacgggnngcccaatcaacatgttcancaatgggcccccnattgaaattncccttcctcaaaccaaccgtttnaaggggggngggnccaatccaaccnccttg

SEQ ID NO: 96985 - DNA, 502 bp, Triticum aestivum
  unsure (1)..(502): unsure at all n locations
  Clone ID: PAT_TA_96985
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggnaagagcggcaagccgctgcactacaagggcaagcgccttccaccgcgtgatccccgacttcatgtgccaagggnggcgacttcacccgggggcaaacggcaccggcgggcgaagtccatctacggcgaagaaagttcgccgacgagaagtttcgtcccacaangnaacaccaaagcccgggattcctctccatggccaacgcggggcccaacaccaaacggctcccaagttcttcatctgcaccgttccctgcaattggggtccgaagggnaaagcaacgtgggg

SEQ ID NO: 96986 - DNA, 503 bp, Triticum aestivum
  unsure (1)..(503): unsure at all n locations
  Clone ID: PAT_TA_96986
gccatctctacaacaacggttgaacccatgcaagaatatcctcttgtaacaatgcaaacctgcatcattggtgtcatccctttggtcgataatctggccacaaaacgattgccaagtgatgcagcaacaatgctgccaagaactagcacaaattcctcagcagctccagtgtgcagccatccatagcgtcgtgcaatccatcatcatgcagcaacaagaacaagaacaagaagaacaacaacaacaacaacaaggcatgcgtatcttttttccactatctcgacaacaacaggtgggtcaaggtactctcgtccaaggccagggcatcatccaacctcaacaaccaagctcaattggaggcgatcaggtcattgggtgttgcaaactccttccaancatctgcaacgtgttatgtccccancttgagtgctcccaacntcaaggggcaccaatttgccagcaatagtccgcnggggattgggtggggcaaatggaaaaaaagc

SEQ ID NO: 96987 - DNA, 577 bp, Triticum aestivum
  unsure (1)..(577): unsure at all n locations
  Clone ID: PAT_TA_96987
aacaancattatctaacacaaatcanccatgaanaaattcctcgtccttgccctcattgtcatcgcggcgaccaccacggtcgccgacaccctttactgcattccgtattgcttcggacgccgtcaacatccatcatctccaagagcagcannccaactctgcagccacaaagaacatccaagttccacatcaaaangttgaacccttgcaaggggattgccctcctacaccaagttgtnngccccaagtagctgatattgtccgttcctcccggtcacaangtgngtgcaaacataancaagtcttgctttggtaaatggtgggnaagcaagtggtttgtcaagcaanctnaaaaggcgtattccccaaaagcnagtccaaanaattgtgtaggggccatcccnacananggtcgnttgcnacggccnantttattttttgcnattcaagcaanaaanaccaatttgggtacanagggttaccttcaaaccccaaacctcaagncaagnaancaacaaacnaagggtcaaacaaagnancantgggtccaggggttncttnanccaaggccacanc

SEQ ID NO: 96988 - DNA, 511 bp, Triticum aestivum
  unsure (1)..(511): unsure at all n locations
  Clone ID: PAT_TA_96988
cgtcttcgtactcgcctctctccgcgcatcctagccttcgccctcctccttccccatttcgccagcggcgcagnccataaccacccccacccgccgccatgagggagtgcatctccgatccacatcggccaggccggcatccaggtcgggaacccctgctgggaagctctactgcctcgagcatggcattcagcctgatgggccanatgcccggtgacaanaccgttgggggaggtgatgatgctttcaacaccttcttcagccgagactgggtgctgggaaagcatgtcccccgtgctgtctttgttanaatctcgagcccactgnggattgatgaggtganggactggtgcttaaccgccagctcttccaccctggagcaagcttaanaagtggcaaanggaggatnnaatcaaacnaacttcngcccgtgggtccattacaccaattgngcaaaggnggngttggtgantctgttgcccttggacccggttatncaaagaaagctttc

SEQ ID NO: 96989 - DNA, 528 bp, Triticum aestivum
  unsure (1)..(528): unsure at all n locations
  Clone ID: PAT_TA_96989
gcaagctatatacctacatagtacagccatggcccccaccgtgatggnctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcggggttcatcttccgtgaagcacaaatgcgtctcccggggtactacgacgggcgctaactggacaatgttggnnggntgcctatgtttcggggtgcaccgacgcccacaacagggtgatcnaaccnanggtgggnagggagggtccaagnaaggggagtaacccctngaacncngttaggtcccggcaattcatcngggaattccgncnaacnatttg

SEQ ID NO: 96990 - DNA, 580 bp, Triticum aestivum
  unsure (1)..(580): unsure at all n locations
  Clone ID: PAT_TA_96990
aaactggtggtaacagtattcgacaccatagctgagtcgtttcggcagatgcgtgctccacttgtttccaccaaattcatctatctttaaggtgggatgacatgcttgggcatctgtaactgtaaccaaggccttggaaaattgttgatatatgggtgctgcaggactaccaaaagtgaagggtttgggggacttaaangtaccgggattgaattgcgggctcggacgaaactcacaaaaaactcaaggggggggggaagcttgaaaggcccttggatgggttgatgggcaaattgggaagtctgaccgcctgcttccggggtgaattggggtggaccgttgcctccttggctggggtccaagtttccaagtcaactgggaagtttttgggtcaactgggcttggttttaacgtttggacaactggantgggccngaaacctgggtttgnctaagcttcccaaaagaaccttatatgccctggtaaaacatcnggnttcaaaaacaaaaactcccttgnttcccacaatgannttttggttcaaccnacaactaagaaagggtcantggcttggtggggc

SEQ ID NO: 96991 - DNA, 461 bp, Triticum aestivum
  unsure (1)..(461): unsure at all n locations
  Clone ID: PAT_TA_96991
ngcaanaaccaccattttcgcaacaacaacaaccaattctaccgnaacaaccaccattttcgcaanaataacaacaaccagttctaccgcaacaacaaataccatttgttcatccatctatcttgcagcagctaaacccatgcaaggtattcctccagcaagcaatgcanccctgtggcaatgccacaaagtcttgctangtcgcaaatgttgcagcangagcagttgccatntgatgtaacaacactgttgccagcagttgcccgcaaatcccccannaatcccgctatnnggcaatcccgtgctatcatcctactccatcatncctggcaagaactaacnanccaggtttcagggggttcccatcccaactctcanncaaggaggcaanccccccaaacantttngggcccaaaatgtngttttccccaannccccaanacaaggcaagttcgcaatta

SEQ ID NO: 96992 - DNA, 236 bp, Triticum aestivum
  unsure (1)..(236): unsure at all n locations
  Clone ID: PAT_TA_96992
aattccgcaccaagcaaatcctctcctggttcctttcttcccctccntccacccaaaacttccnctcttccaatccntcctccaatccatnncnactctctccctnccncccacctcctccacccttaaggggggnggaagacccccncacaaacnaaaaaccatcttcccacnactcttcctcnnatccgagcgacatccactccnggtgggttttcctcccnaagtctgattta

SEQ ID NO: 96993 - DNA, 509 bp, Triticum aestivum
  unsure (1)..(509): unsure at all n locations
  Clone ID: PAT_TA_96993
ttttttttttttaataaaatctggntagctttagatcacaaccaaaacaggcaaaacattctcagttcaacctaggactcgaacagtttacaagaaaatgggagttcantatgtctgcaaacatgacatggncgcaacatctaagaaaatccaacaagtaacatgcagcagctcttcagcctaagctgtggnacccttgcccttcttcttctggagcttcctcatgtagaactccagctccttgccctccaggatgtacccatcagctctgccacactgtccagggcgaggacgaantgcangncagcagccttccaccgctgaantgctcctcaaggtgagaagtccaagtntacgtccctgctggngcttctcaagcttcctctggacattgttgctcttcctttgcttccctctgtggcaggcagcanggatccncaagnactccttgttccctcaagaaagnantgccntccttggnaagcatgcnacctctccgggtttggccn

SEQ ID NO: 96994 - DNA, 483 bp, Triticum aestivum
  unsure (1)..(483): unsure at all n locations
  Clone ID: PAT_TA_96994
gcccgccncctnctcaaccctcccggcgcccccnggcccnttcngggcnagaagatncctccnggctcacctccaatncttctgcaacccattcccnggggggggncnccttcgcccgccttccaanctactccatatctactgggaaagaaccnancacaangctgattttcaacngggggaaaattgtgcacctcccaaggancnttgtcccgcttcccanaaaatccattttcaangtcccaaaangaaatgtcatcccttttgtgtttcaantaattttancctttaattgngnccaatcctatccgcaatttttgcaaagtttcaaacaaaagcaacatcaangggcaactggncnngaagttttanaaaaccccattcaannggaaanaattanaaatcantcctanctttgtnaatggnntttttgtnngtaattcccccaaccttcaaacaanattnttatccaanaacttttaa

SEQ ID NO: 96995 - DNA, 456 bp, Triticum aestivum
  unsure (1)..(456): unsure at all n locations
  Clone ID: PAT_TA_96995
ngtacttcccggaccctttgacgctcttccgtcaaccaagtggcgcctcatggggtgggtggaagggccngcggtggatggactacctcaacccggggtccgtcgacatcgaagccgcggttcccnnggggggggaaggaaccccaaccccggacgtggggtaccccgggggggcctgttggttcgacttggggggcaaactgggggcccgcgngctcgccgggagccccgtcaatggtgctcccgcaaccaaaggggaagattaaaaaaaccggcccgccctcnccaatgctcgccttcgttcgggcttctngggttccaaggcccgttctacaccggggccaaggggccccctccgaanaanccttctccgncggcaacctccgccnggaacccccgggncaactgncaacaatcnntctccgggaatttcaactttcccaactgaattcgntg

SEQ ID NO: 96996 - DNA, 487 bp, Triticum aestivum
  unsure (1)..(487): unsure at all n locations
  Clone ID: PAT_TA_96996
gctataaaaaatgttaacggcaaagttattgcaaagagaacagtcgctgttgattgggctgttccgaagaatgtagnggctgttgctgcaaagtctgatgctaaggacgatgagttggaagatatatctgacaagggcagtgacaaggaatcctctgaagataatcttgttggaggagatgacagcgatgataactgtgaacttgatcaggagacttcaaatcgtcttcctgtggatgatttcaaaagtgaagcggacatttctagaaaagttcttgaaaatttgatcaagtcatcanagaagtctgagcggtctggtgttgagaagttctgatattgatacaagattctgaaacangaaaatgacacaccaagaagaagagttctgatattgatacagattctgaaacagaaaatgacacaccaaaaaaagaagcaaccccaagtcacctgcagctgtcaagtttggcanaaatcctagaagatgt

SEQ ID NO: 96997 - DNA, 457 bp, Triticum aestivum
  unsure (1)..(457): unsure at all n locations
  Clone ID: PAT_TA_96997
gttgatgttagcgagctcgtcgtggggcactcctcctacctgggactcatgcagcaagatcctggagcagctgggagctgaatacttactacccggtgttctccccctccacgcccaggtccagcacgcccagatcgaaataaccgcgatgaacttgtgctactcaggaacggtgttatctgtgatgaatgtagtcaccaaaggctgtagctaataaaggaaacttttgttgtaagggaatggaaaaacgatcgggggtacttgtagtctgttttatccaaaantctcaagcatttccataggaacttttttttagataagcttaccaggcttggacgcctgggttccatagaactgtttgacctaagcgaaaatacacatggcgagtaacacggtgagtttcangaaagatatgtcatttttatggacgggattaaaactggtttggcctcaacgc

SEQ ID NO: 96998 - DNA, 565 bp, Triticum aestivum
  unsure (1)..(565): unsure at all n locations
  Clone ID: PAT_TA_96998
gttaacaccaatccaccatgaaagaccttcnncgtctttgccctcctcgccgttgcggcgacaaagtncaattncgggggggggggngactacatgcatccctggtttgggagagaccatggnaagcaancaaaccattaccaccacaacaanacatttccacaaacanngnactattttcacaacacccaacaaactatttcctcaaacaaaccatcattttcngcangcaaacaaaccaccattttggnaagcacacaaccaccattttctcancaaacaaaccaaattctanccacaagcaacccaccattttccgcaancaaacaaaccaacctaagttctacccgccanacnaaccaaccaattttccacaagcnaaaccaaacaanccaagttttaccctcccacaaacaaatcacctttttccaacaaccaaacaaacaaaccaccaaacaagcttgngtggcaaacaaacaanatcccctggtttgtttcaacccatccaattttgccaancaagcctaaaanccaatgcnaagctnattccctccaaccaaacnat

SEQ ID NO: 96999 - DNA, 562 bp, Triticum aestivum
  unsure (1)..(562): unsure at all n locations
  Clone ID: PAT_TA_96999
gncgcattttggccgggcgggcgtcganaaatccatgctccccgccggactangttgatctggcccagaccaagtnttccccaagccatccgaatnacaanatcgagaggagctgcaangccctaccatgaggcacgangaggggaagatgtctccccggccggctgccgccgccgccgcaaccggtcngccggtctccgccgccggnctctctgccagacgcccgacagacctgctccggggaaattctcctccgcctgcccccggcgggcttcctccccttcnccccgaagcctcccttcggtctgncaaagtggtttgggcgncangcatccntctccgaaccccccaaatttcccaaancgcccgcctttccgcgncctcaancaacggggaaaggnccccctctcccttgggcttctntcctccgaacaanttcctnttccncctgccccggttttggtttccaaatggctngggnttcnaccnggattggcatcctccnggnggctcgnnttcttccaatgccttctatactaagnagnantccgncatcattctt

SEQ ID NO: 97000 - DNA, 508 bp, Triticum aestivum
  unsure (1)..(508): unsure at all n locations
  Clone ID: PAT_TA_97000
gccacgcgggttcttccttggnataaatttaccaaagagttctttaccatctgtgatagccaagatgacttgggaaagttcanactaagcctcaaggaaagactgcggtgaacggataagtggatttgattgttccaaaatatgtaaacttcttgaaaggctctgcaggaaaatccaagttcttggttgaagagggtgtgccgagccaaggtctgangaagccgatttatcctgctccacaactggaaaaggtgatcaaggggactctttgaaagatagcatctagaagggcacgaaaactcgtacagggtcggtgcattttatcatattttagcatttgggagatcattttgtctggtggcattttcaaggtgatggtcctggcttgttggtattagcaggatttcaagccctactattggggcctgggtgtatanctattcattaccgtgttatgtacntgctggtagaaggaagtttctcctggagaaaacccaacgggaantgn

SEQ ID NO: 97001 - DNA, 375 bp, Triticum aestivum
  unsure (1)..(375): unsure at all n locations
  Clone ID: PAT_TA_97001
gttggacaaaaccattccgctcaaaacacttgtngatggacannttcanacatnaagaatgttgttcccggctacacaacgnggggnggntngagcaangaactaatgttgctaacantcangtggtggttanagcagtaaatggccaacagtcaaacaacctaccgcncccagggttgcttcaggcatcaacatcagcacggagaaaatgctctagtatgtctgaancctgaccatcaaacctaagaaanagggcaaggcctcccaaaagggatacaagtacatcaangtganctttcaaaaacaanggaacgtacatcaaggtgaatattcaacctaaaaaaaaacangncaaggcctccaaanagcaccctg

SEQ ID NO: 97002 - DNA, 298 bp, Triticum aestivum
  unsure (1)..(298): unsure at all n locations
  Clone ID: PAT_TA_97002
nggaagagctacctctcntctcttcnccaaagnacaagatgacgaccgccgttcnctcgatttgccccgtcagggcaactccggcgacacggcggatanctaatagattcccctcgtctccctctancatttccccctatttatttgatccngncgccgncaaaaancgtcgccancactcaaatcctaancgccgcctgatncanggtccggtggggnttgccaccgggctgcaacgggcaacaaangtcttccaangcctaacatcnctccggcnaagngcantccatgacancat

SEQ ID NO: 97003 - DNA, 639 bp, Triticum aestivum
  unsure (1)..(639): unsure at all n locations
  Clone ID: PAT_TA_97003
cangatnncagcgggcgatggccgacggagaagaacgcccgccgcccgcccgcccgcccgcacgggcatatccgaactaccgcaaagaaaaaatgctcancctgcaggggagctccgaatccgccgccgtcggtaactgtggaggggaaaaaccttnngggatttgcctagggaaaggaccttccncaaaagactggaaagaattacctttganaggtcaactgcaaaaagtgtttgggacaaaattaatangggagaagggtcctttccgtcctctttgataaatgaaacngcttttaattggttaaaagggctaagccaagtgggtcccaaagataatgntcgtccggttgcccgggagtaaaaagttgggacnaagggaaaaaagtttaactttctgggaaactccgtggtttgtggcctgggaacaaatgacaaaactttggacaatccaatgcccaactcctgccaaaggggaagggtgggatncctggtgggtggtataaacaaatgcctaacnacngaaaggatttcaaaggcaaattgttcaagttttactccggncttgttaaggtnggcnttgttcctgaatcaaaaatccaaaggggaancttcaaagggaaaatcaaatcccgagcn

SEQ ID NO: 97004 - DNA, 578 bp, Triticum aestivum
  unsure (1)..(578): unsure at all n locations
  Clone ID: PAT_TA_97004
ctcctagcaagctatatacctacatagtacaggcatggnccccaccgtgatggcctcgtcgggcacctccgtcgctcctttccaggggctcaagtccaccgccggcctccccgtcagccgcccctccaaggggngctngcctcggcaagcgtcaagcaacggtgggaaaggatnaaggtgcatgcaaggtgtggcccatccnanggggcatcaaagnaagttcgaggaccctgtcttacctgccaccgctcaagcacgggngggccctcctcaaggcaaggtcgaactaccctggatccggctccaaaggtggggggtgccttggcctccgaagttcaagcaaagggttgggggttcaatcttcccgnngaagccacaaaacggcaatntcctgggggtaactacgaatgggcccgggtatttgggacaaatggtgggaaaagcttgccctatggttcgggggtggcaacttgaacgccacaacaagggtgattcaaaccgaagggtggggcgggagggggtcaangaaagggaggtaacccctgaccgccggtattgttcccgcaatcaatcggggg

SEQ ID NO: 97005 - DNA, 585 bp, Triticum aestivum
  unsure (1)..(585): unsure at all n locations
  Clone ID: PAT_TA_97005
ccgctcctaaaaactantgggattcccccggggctgcangaaattcnggaacgaagactcccctgcctcccccaanagctccgttaangggtttctccttttttcnggggaanaaatctcaaaganggcggcaccaatgctcgngtaccaaggacaaagctttccggcgaacgagcttcctgtccggattccttcngggnngagggaagctggagaaacngcgtgctctgggaaatccatggccattgggtccttcaaaggagcanttgatgtggacattggagccaatccctctgctgagggtgggtggtgatgattaaggtgttgatgaccaaagctggtgaangtggttgacattgttgacaccttcccgtcttcaagancaacctgccttttgacaaaaaacantttatctnctcaaatgaaagcgctacaatcaaagaaacctctcctgncaaagctttgaaagggggaatgaccctaaatncttttcaaagaaaaaatgnttgagtcccgccaaaaaagtatcttccntancaaagcctcaaaggaccttcaatttctttgttggccgaaaancaatcn

SEQ ID NO: 97006 - DNA, 583 bp, Triticum aestivum
  unsure (1)..(583): unsure at all n locations
  Clone ID: PAT_TA_97006
aaatggtgaaagattcaagttgaaagtgcaatcaagctgccanagacagctggatttgaatcntaacttccataaaggncgagatcatgcagatgattctcttcatgggggtacaaggnttttggaaacccgaagcattaantgatgtcctctgcacccgccactggctgagggcgctagcccatggggtanngtttgtgggtctgcgcaanatcacccaatccaaaccgaatttcttcaagaatcattcccaaaanctgcctgggtggtacacaaacgtcaggangggatttccgtttgccaacacgtggaacggaaagcaaatggaccaccgttggatcccccaagccccctcaacacctggagcaaagcgggntacaacccttttccntgggggagggctggcaaccccancaagggttcaatgggaggcaactncgggaggctgggacaaagggtcctggncgcaancaaatgggtggattggtgncaagcacctcctgggaaacnaagccgtcngcccagggagggatgantgaaatcaagcctccgttggccnaaaacaatgtccgggacnaattgn

SEQ ID NO: 97007 - DNA, 514 bp, Triticum aestivum
  unsure (1)..(514): unsure at all n locations
  Clone ID: PAT_TA_97007
ctccgattcagcgccgcacacacccaaacatntcgagtagtttccaagctcgccggngaagcatcaagcaagatggccggnaggaagggcgggcgacaggaanaaggcggtgacccgctccgtgaaggccgggctccagttccccgtcggccgcatcgggcgccacctcaagaagggccgctacgcccagcgcgtcggctccggcgcccccgtctacctcgccgccgtcctcgagtacctcgccggctgangtcctggangcttgccggcaaancgccggccaagggacaacaagaagaacccgcaatcatcccgcgccaacctggctgctcgccgtntccgcaacgaccaaggagctcggcagggctgctccgccggcgtgaccatncgcccacggggggcgttgattcccaaacattaacctncggtgntggctccccaangtaagtncccgggcgccgcccgagaagggaagccaangtcgcccaaagaatgaangaccaaccaacaaant

SEQ ID NO: 97008 - DNA, 650 bp, Triticum aestivum
  unsure (1)..(650): unsure at all n locations
  Clone ID: PAT_TA_97008
nntatcnaagcttatcgataccggtcgacctccgagtttttttttttttttttttttacnagcngagggnnaaaccagcatcattngggacaancagttcaatcaggaccaccatattacctgggcagggtaacctaccnaggnctggntcctccacaagccccnaaaacgggnaataattggctcgaggctagnataaccaaaanttacccaaaaaggaatggggattcaanttttgccangaccattggcnananaattttcaaganccaacnanccccctggaaaaaaactaagaggttcaaacnatccggggctttggctttttaaaggaattagnaccttcctnggttttaagtncgcccctttgccggggcggggaaggggagcnaanccccctccgggtggaaggcctngggcctttgcccaacccccgttgggcctgggcaagnaggcnaaccgtttggggcaagccctgggggcaacaacccaacgaacgggtcctnggtggaggtnggctgggaacaacaagttagtggatngttggaagcaagcccctgggcaacctttgaccgtcccaatgaaangnaagggagtttgggggaagaacctngggaccnaagggcggcctttcctccntgggggccttg

SEQ ID NO: 97009 - DNA, 575 bp, Triticum aestivum
  unsure (1)..(575): unsure at all n locations
  Clone ID: PAT_TA_97009
cggcggtgnccgaagaggagaaagcacggcgacctagcccgagctcgcaaccatggctaggggtttgaagaagcatctgaagaggctcaatgccccgtctcactggatgcttgacaagcttggtgggagcttttgcccccaaagccatcatctgggtcctcacaagggccaagggaagtgcctgcctctgatcctcatcctggagggaaacagactggaaaattatgctctcaaccctaaccngtgaaagtgcaaatctatcccttatggcangcggtcaatatcaatgggtttgaatgggnaaagggtccgcnactgacaaagnacctaaccctggctgggggttcaatgggaccatcattttccaattcccaaaggnactgggtggagaaaactacaanggcttccttttattgaacaaccaaaagggggtncggcttccngcctttcaactctggttcaaggggattgagggaatgctaaacgnttcaaaggcttctgcaaagggtcaagggtctggtccnagttcgggccanaaaggggcaatccccctaaccctgaaacaaccttatgan

SEQ ID NO: 97010 - DNA, 576 bp, Triticum aestivum
  unsure (1)..(576): unsure at all n locations
  Clone ID: PAT_TA_97010
agcgaaaatccaagatccngggaancancaagtcncagcggaagcgcaaaggaananggcggctgganaaagcaactccccnnggggggtgcctcncctccgccatggggatcggctacgtcatcggcatcctccagcggcgcccctcctccgcccacgcccgcctacgccaccatccaaatatcgctgcgngtgctgaaagatcaccggnaagaaggaagttctccgggggcccgccagttggantgtgattgatgcaagctgctcctggggggcttgccttatgncatgttgggggcaangtgtcctncttgttccaaacncaaaagttccctttcnnggtgctccccccaattctggagggaagaatacgatcgntaatccgcctcccaaanccaaaaacccctgggattttcaatnaatcttcaaaccaaaccgttggaaaagggcgcttgccctttcaaaacgcaacacctttgaaaatttgaaanaatattgaaccanaaattcctgttccctttctttgtcaatgtaaccnttttgcccanngaaggaaggaattcaatccccntttnt

SEQ ID NO: 97011 - DNA, 539 bp, Triticum aestivum
  unsure (1)..(539): unsure at all n locations
  Clone ID: PAT_TA_97011
tagattagctatctcagtctcgaagtttatagattggggtgantcatgtgcaactaagcaataagtaanaaggcaagcgatcaagaggtgcaaatccgatgatcgncacctcacattacaaaattttcattcttttgtctttcctagctcatcttcggattttgtttcggagacaaagaataatccagttttgattggggaccctcttgtgggagaaatggctatagctgaagggtaccaaaanactgtttttgagcagctaactacacttggcatgagntaagcttctttttattgaaggaggncatgggacaagtttgctctgngccctgggggcccgcaggccatgggacaatggtgtccttcccaatctcttctcnnctctctctctctctcttctctctctctctcctcctctctctttcctctctcctcctctaaagtggtggtgttgtgtggtggtgccgtgcnntngtggtagtgtgntgtngttccganttccaactnccgattctgggaggttgngngtttctgnttcn

SEQ ID NO: 97012 - DNA, 450 bp, Triticum aestivum
  unsure (1)..(450): unsure at all n locations
  Clone ID: PAT_TA_97012
cacanacacacncacacccagnaggcgaaaccactcttcgctcaaancgtctcgggagcanaggctctcccttcaccttcgtcttcctccctcncggnagttcgaactttgcanggcangnagtggtctagctccaaangggcggggtgatcgcngggagcctcgtgggagcncgtcctcgccggaaaaggccancgtctccccgnagganggcgggggcacgcgtcngcctacgacanagaancgtggnacgagcangtgcgcccggcctttgtgncgngacgaatgtgatcggcggcgccgggggngncccagncaaagtnctnggnggtccctnanccaanccaccgggggtttttcggccccgccggtgngttcgaccnccaaagatgggccggcangtctcncnggccnggtcaagcgcccgnncaaagggngggcccctccgtg

SEQ ID NO: 97013 - DNA, 536 bp, Triticum aestivum
  unsure (1)..(536): unsure at all n locations
  Clone ID: PAT_TA_97013
ctcctagcaagctatatacctacatagtacancatggcccccaccgtgatggggctcgtcggncacctccgtcgctcctttccaggggctcaagtccaacgccgggctccccgtcaagccgccgctccaacggngctaagcctcggcagcgttaagcaacggtgggaaggatcaggggcatgcaggtgtggnccatcgaagggcatcaagaaagttcgagaccctgtcctactttgccaccggctcaagcacggnnggnccctccttaaggcaggtccgactaccctgatccgctccaaagtgggggtgccttgcctcngaggttcaacaagggttgggtttcatcttccggtgaagcacaacgcatccccttgggtactacnatggccgggtactggacnaatgtggaaagctggcctatgttccggatgcaccggacgccnacgcagggtgatnaaacgaaggtggntggagggtcaangaaaaggagtaaccctgacggcctatgttccgcatcatcgggattncgacaaacn

SEQ ID NO: 97014 - DNA, 612 bp, Triticum aestivum
  unsure (1)..(612): unsure at all n locations
  Clone ID: PAT_TA_97014
gggggaacccggggccaaatntgggggccttanggggccaactgggtcctaacaaggccggtggccgggcgtggnttccgctgtctctngaaccgggtgaanagggtggggagcaagctcaaaacaaggggaagcgggcggacgccgattgggcatgccttttggcaacacnaacngaaccaagaagctttacgnggcatttcaaggggcctangcggggccctggtatgcctccctgctngtttgccgtccgggccgggaattcccgttcnggtgacggtgggacggttggggcccctcccccgcgtgcttgaacgggtggctaactnaactcccgaagttccccgggctccctncttcttccgtttggtggcanggtcccctaacgttcgccgggggcccgttgggttgaagaacaagcaaagggcaaaagcttcaaanggcccgttgtttgggcgcnaaagggttgggtggtcccggttttggtgggccgaacccctcccgaaaagccgccccgaaanggttgaaanggntggggaattcggggaaaatcccttgtcgggaactggggccgaacaaacgaanatgggtgggcggcnttgaagggggttt

SEQ ID NO: 97015 - DNA, 203 bp, Triticum aestivum
  unsure (1)..(203): unsure at all n locations
  Clone ID: PAT_TA_97015
gcgcgctgaacacctccccttcgaatccgcggnnnccatggtttcttaaacaantcagccctgnggaagnacagcngcatcacaccgggaggctgcggtngaatcttcaagggtcctgattctcgggggatcttgatggggatctgcncgtcctcggancacctcnggcaanatgggcaggaggcggncnanagcatcgtcta

SEQ ID NO: 97016 - DNA, 600 bp, Triticum aestivum
  unsure (1)..(600): unsure at all n locations
  Clone ID: PAT_TA_97016
ggccgcaacatttccatcacaacaaccattgccgcaaccgcaaccatttctgccacaactaccatatccgcgaggccacaaccatttccaccacancaaccaatatccacaaatcgcanccacaggtatccgcaaccacaacaaccaaatttcacagcannggangcacaaacatgcataacaaacaancaacantcaaacaatcagcaagcanccaacaaacangcaccaagcangcaancaagcaacaaacaaacaaancaagatcccttcaatcaagntttctgcanacaaccaaaccaacctggatttccaatgcaaggggatggtcngtncttggcaacaaacacaaccanttagcggcaatgncnaagcctcacaaagtnatttgcnacaacaggttngctnaccaaacctggtntgccaaacantttatggttggtcaaacggttttgggnggncaagatcccccggaggcaagttccgccgggtggcccaaggccaatnccnacaactggtcgtttcaatggctaattattccnggcaaccancaaaccaancatncaaaccaacaagcaaagcanccaacgaaccaacagg

SEQ ID NO: 97017 - DNA, 513 bp, Triticum aestivum
  unsure (1)..(513): unsure at all n locations
  Clone ID: PAT_TA_97017
atcagatnagattaaggcagagacacaaagcaaagcggataaactcgagggagattcgatnatcaccacaccaaccatgtcgtgctgcggaggcaactgcgggtgcggatccngctgcaaattcctggnnngggtgcggagggtgcaaaattgtaccctgagatggacgagggggtgaacaccacctccgagaccctcatcatgggcgtcgccccctccaagggcaccccntccttcnaggccgccgcccganaccggggccgaaaacggangggttgcaaatgccgccccaacnngcaacctgcaaccccgttgcaactgcaagtngattcatcaaatcgttggcaaagggagacngcatggncggacctttatgaaaggagcactagtanttgttatgcatggtgttcgccntgtgttgtttcctttttaatttgccaaccgangaaataacaccgagattcgattcgtaccgttgctagcttaattggctttatgtngtncccccttggg

SEQ ID NO: 97018 - DNA, 517 bp, Triticum aestivum
  unsure (1)..(517): unsure at all n locations
  Clone ID: PAT_TA_97018
agtcctcacaagcatcctctcaagtccttagcttccttccctcgccgccacccaccaaggaaaggaggatgtcttgctgcggcggcaactgcgggtgcggcgccggttgcaagtgcggcaacggctgcggcgggtgcangatgttccccgacgtggaggccaccgccggtgccgccgccatggtcatgcccaccgcctcccacaaggggaagctncggcgggttcgagaccagccgggggaagaccggcggctgcgactgcaccaccctgcaagtgccggcaccgcgtgcggctgctcctgcngcaagctgcaantgaagccggccgctcanagaggccggccgggnagagggcgaagcaacganggatgaggaggacaagncangcaaagcgaccatcaccaccaagttcaccaaccaacccaggggtaataatcaatnagcccgccgcattgcgtctccgcggggcgcgcgngcctgaatnaaaaattaaaaaccaccggtttcgtggttccggt

SEQ ID NO: 97019 - DNA, 577 bp, Triticum aestivum
  unsure (1)..(577): unsure at all n locations
  Clone ID: PAT_TA_97019
aatagtnctacaacaacaaccaccatttttgcancaacaacaaccanngtctaccgcaacaaccaccattttcgcagtaacaacaacatnnagttctaccgcaacancaaataccatttgttcatccatctatctngggggggaggnaaacccatgcaaggtattcctccaagcanncaaatgcaagccctgtggcanatgccacaaagtcttgctaagggtcgcannatgttgcaagcaagacgcannttgccatgtgaatgcaacaacaantgttgccaagcaagttgccgcanaatcccccnangcaaattccccgcttatgnaanngcaaatcccgtgctaatcatcctaccccaatcaatccctgccaaangaacaaacaaacnagggttcaaggggnttccatccaaaacctccctcaagcaagcaaaccccaaacaagcttngggcccaanttggttttttcccaaacccccaaanaagcaagtcnacnaacaatcaancctcngggcaaacnaaccctcaaacaaacaaacaaattnggcaanaaagggtanccttttttgcaagccna

SEQ ID NO: 97020 - DNA, 500 bp, Triticum aestivum
  unsure (1)..(500): unsure at all n locations
  Clone ID: PAT_TA_97020
ggcgcctccacttctctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaaggagctcaagagcgacctcaaggacctgtacatcaacactgcaatccaagatggatgttgttggcaacaggaaggccgtggtgatccatgtgccgtaccgtctgcgcaagcccttcaggaagatcaatgtcaggctcgtcagggagctggagaagaaagtttagcggcaaggatgtggtctttgttgcaacangaaggatttgtgaggccacccaaagaagggttctgctgttcagcgccctcgcaccaagaccctgacangttgttcatgatgggtatcttggagggatgtccgtgtaaccaagcttgagaatgttgnggaaagcgttgtc

SEQ ID NO: 97021 - DNA, 220 bp, Triticum aestivum
  unsure (1)..(220): unsure at all n locations
  Clone ID: PAT_TA_97021
gacaggtcaanctcaccgaggagaagaaangngaagcgagaangatgtcggggcncggnaagggaggcaaatggtctgggcaagggcgggcgccaatgcgccaccggaaggtcctccgcgacaacatccagggtatcaccaagccgggcgatccgtcgtctggcncgtccggggcggcgtgaancgcatctcgggggcctcatctacgaaagaagacccg

SEQ ID NO: 97022 - DNA, 629 bp, Triticum aestivum
  unsure (1)..(629): unsure at all n locations
  Clone ID: PAT_TA_97022
ccnctctctacncccacccctancacaaccttcaaggaacagcgagatcnagggctccgagatcggagatcccggccanggcagcaatgggaagggacgggtgactgtgcccttggattcgtncgggtgcaatcgaacnnccgctngcttcaaagggacgnaggctgggacatcggtggattccccgaaccaatcccgcaattctccgaactttcctttggagnattgttgggcggccccctttcnttccaagcccgttancaaccctccattcaattcggtccaangaaccgggtgancccccaaagcaaaggncaatcaaagggtttcccggaaggggcttccgaactaacgaagcttttacaaaccggcaaaccgaacaatcaaatccgcnattctcgggccccaaangggccctcaattgcaatcctccctttcaaangggacctcccgccgtgnccgcntggccttccgggcttacaatgggnnctcccaaagaaagnaacgttaccgtncttcacccantccnaacgaactaactgnctttcgtngggccaaagggncccaatcctggggaaaaaggacaatcaaatngcttccttggngcaagcnaanatcanagnaacctc

SEQ ID NO: 97023 - DNA, 300 bp, Triticum aestivum
  unsure (1)..(300): unsure at all n locations
  Clone ID: PAT_TA_97023
cccccgggctgcaggcaagatcccaattcttgaatagattagctatcgaagagggtatatcaataactacagctgtcttagcacaatatgaaaaacggaaaggacggttttttgaagagatcgactatgtccttactgatacaattagaggttctgttgttgacttttttacaagtctggcttcctgctccctactatttcgctcttatctaattgctgacaatggttcctgggtgagaagcttggagccttggttaaaagattggttaaggncactgccaagataatgcaattcaaaaa

SEQ ID NO: 97024 - DNA, 561 bp, Triticum aestivum
  unsure (1)..(561): unsure at all n locations
  Clone ID: PAT_TA_97024
gcgttttcttgcttgtttcccaagaagaaggagaagagcggagtctgatctcgtcggcggcgatggcggcgattcggcgtctgatcccgtccttcaaccgggtgctggtggagaaggtggtgcagcccaagaagagcgccggtggcatcctcctcccggagacctccaaagcagctgaaactctggtaaggtgatagctgttggcccctgggcagcccgtgacaaaggaaggggaaagctgaatccctgttgctctcaaagggaagggngaccatggtgctcctgccttgagtatggcggtctttgaagtcaaagctttgcctcctggagaaaagaagtnacctcctcctacaagaagaaccgaacgaacattcctggggnacccctccaacgaagttgatttcaanaatgggtngcggggaaagtcaatcaancttgctttttaattccagttaaggaagaagggaatgttaaaangttttcaatgttaattccggattaaaatcttaaaagtagaaacttgtccctcctaaggggggttgaattgaaatacnatttttg

SEQ ID NO: 97025 - DNA, 311 bp, Triticum aestivum
  unsure (1)..(311): unsure at all n locations
  Clone ID: PAT_TA_97025
aaanagnatcgtctcgtctcgtctcgtcgaangaatcancagccatgggcggcggcaangcgcagtanttccanagatcgtgagggagaaggaatcctcnangaagnttgaacnggcggcaatggggagncangcctcgaggccaacaagaagcgncatgaacatccaagtgccaagactattgcattgcatactttcatnctgcaccacctctgaagcaaaagttgcaagngagtcatgnccgagggcnnaagcaatncccaaggagccgaggctcngtccaaggtggctctcccctncaacctccaagg

SEQ ID NO: 97026 - DNA, 245 bp, Triticum aestivum
  unsure (1)..(245): unsure at all n locations
  Clone ID: PAT_TA_97026
ggtcaccgttgtttantcgatggatatgtcgatgcagcggtgacaaataaagtgtcacacaatgtcatgtgtgacccgcccaaactagttgtttaaattctgaaataaaataaaaataaagttgtatcaagacaatgttcatattggcattgtgtggntgtcaatctgattgccatgcttgcaagttcataagtttgtctttccttgtcacaaaaaaaaannaacaaananaaaaancaancaca

SEQ ID NO: 97027 - DNA, 535 bp, Triticum aestivum
  unsure (1)..(535): unsure at all n locations
  Clone ID: PAT_TA_97027
cagatncccaccaatctcgtctccaatcgacccgaggntcgtcgaatcctccttccccaccgcctcaagatgcagatctttgtgaagacactgacgggcaagaccatcacccttgaggtggagtcgtctgacaccatcgacaatgtcaaggccaagatccaagacaaggagggcattcctccaagaccaagcagcggctcatcttccctggggaagcagcctggnggatggccgttaccctcgctgactacaacatccagnaaggagtccaccctccacctttgtcctgcngtcctgcgtggggggcaatgcaanatctttcgggaaagaaccctcactgggnaaagactaannacccttttaagggtngagagctccnnaatnaccaatcgannaatggtcaaagggccaaannnttcaaagnncaaaggggtggggatttcccccggggacaaanaancngcctggaatctttggctgggnaagcnaactngggnggatggnncgcaaccctccgcccggactaaaaaaaant

SEQ ID NO: 97028 - DNA, 574 bp, Triticum aestivum
  unsure (1)..(574): unsure at all n locations
  Clone ID: PAT_TA_97028
gttcggcgaggccgtgtggttcaaggccggcgcccaagatcttctccgagggcggcctcgactacctgggcaaccccaacctggtgcacgcgcagagcatcctcgccatctgggcgggtgcaggtggtgctcatgggcttcatcgagggctaccgtgttggtggcggggcccctcgggcggagggcctcgaacatcatctacccgggggcgggcgccttcgacccacttggcctcgcccggacgaccccgacaccgccgcccgatgctcaagggtganagggaagctcaaaggaaacgggcccgccctccgccatgttctccaatgttcgggcttcttccgtggcaagggccaatccgtcaacccggggaaggggggcccaagtttgaagaaacctccttcggaccaacgtncgnccggatcccggggtcaaacaaatcaaacggccctnggggccttcggccaaccaaacttccgcccccccggganagctaaaatggtgntttaaggcccgttncgttccgtccgttccgttccaatcgggacggangatattgcatntngttactntgntt

SEQ ID NO: 97029 - DNA, 479 bp, Triticum aestivum
  unsure (1)..(479): unsure at all n locations
  Clone ID: PAT_TA_97029
ccccaatacgctctcaaatccctaacccttgcacactcccgcggcgcccaaatccctccatccgccgccgtactcgcgtagccggtgccacactgccgccccaaatacctcctttcgccggactcccgcacccatgggtggcgcgagcgtgaccgtgagctcggtctcaggcgagggcggcagcctcgtatcgtctctcccgtcgggcgtagtcgtcgctgccccgcccgtcgtcagccgtgcttccgaccggagaccggncacgttctccttccgcggnccggcttccctggatgagctcgttggtgctcgcgacggttgtcggggatgggtagttcagcgcgtgaangctcagcgcctttttgggnggncatggagaaaaaagtngnaacngtccntgccgcanaaggtggggcaattggagggtgaactgtccgattatnnctttcccggttcngtcaagaanaaggttgccaaca

SEQ ID NO: 97030 - DNA, 194 bp, Triticum aestivum
  unsure (1)..(194): unsure at all n locations
  Clone ID: PAT_TA_97030
ctccctccttcgatccatccgcacaagcagaggaggcgcnccctanccgtctcccgcgccagtgtcgngggacctaaccctancaccgcaacccacccgatatctcgccgccggccaatctccgcctcggncctgccccccctcctctctgccttgcccccgacccccttgccgcgnaancncaacagttgccc

SEQ ID NO: 97031 - DNA, 599 bp, Triticum aestivum
  unsure (1)..(599): unsure at all n locations
  Clone ID: PAT_TA_97031
gatcaagtagctgggcaaagagctttgagcgccgttgcaactttgcaanccggtcgatcgatggcgtccaaggtccgagctggtggtggaggtgaagtcgcccggccgnganaanctgtgggacggngatncgccgagtccgacgggagctgttccccaaanatcttcccccggagcaagtacaaagancatccnnagacccgtgggaaggggcgacgggcaaagtccgccgngcaccgtcccgccctcatcaaagtacaccgagngggggtttcccnaatggtgaccgtttccgcccaaagggagaaagggtgggtagggtggncgngacgaacngaagaaagaaaggtgggtgtccctacaagcngtggntgggacgggcngaatctggggtcannctttctacaaaaggaaactttcaanggggtggaacgggtggcannggtngacccgaacaanngggccggccgaacnggacggcggggccgncggntgggtgaaaactgggnncgcccggcgttccngtccgttccggtcccaatnccaatccaatccaatggtctaacngggcnatcggttaacntttcaaangggggggg

SEQ ID NO: 97032 - DNA, 560 bp, Triticum aestivum
  unsure (1)..(560): unsure at all n locations
  Clone ID: PAT_TA_97032
gggcgggacgaggtaaagaancaacaacccgcaagcngcgacaaccgcggaggaaaaacctaccgccgccggacgcaagaaagcaagccatggggtatcgacctcgtccgccgggcggggaggaacaangagggaccaaaagcgcgtcgccgcccaaagtccgacgatgtctaacctcaaagctccctcgtcaaagctctaccggtttccntgggtgaagggaagggaccaaagagcaagtttcaacncccgttcatcctcaaagaagggctcttcaattgangcaaggactaaanccgccccgccggctctccatgcgnccggccctctcccaaactttcaattgaaggggaaaaanggggggaggaangaacnatttgctggtgggttggtttggtaacaantcactaaggaangancaatgtgccggntttcaaagagggtcccaaccaaattgaaaaggtttacttgcctcctggagggttcaaaaagangaaccaancggangggggaannggatttatcaantgnctgggtgggggnagttgncctcaactttt

SEQ ID NO: 97033 - DNA, 604 bp, Triticum aestivum
  unsure (1)..(604): unsure at all n locations
  Clone ID: PAT_TA_97033
anaagatgaaggncctcttcctcaanaagacngcttgctctggtaacgaagcaccccctttgcgcaatatagccgaagttgttggcaagttacnatgttgctgggcgggggtggggtgctcaacaaatgccctgtaaaagacaaaagctaaattcatgcaaggaattacctgctaagaatngatgctcaacgatngaaagggatttccccgggtcacctgngnggttgngtggaaaatggtggaaangggagggntngtcaaagangctccttgggggaagttgtttgcaantcgngctcgggcccaaaatgncancngcaaatggcccgcttgccaaacaatcaatccaangggggtccaattccnaagggnggaatctccgggtgggcaatcttccgggntttttcanccggtggatncggggccaaagccaaaangtggnttacaaagaaaagcccaaanaaacccttgcccnccccaaaggtggcaaaccaanngggccctccccntggcaaacaatcccccggggaactaattggnctaattanctggggggaatgttncctttccaattttaatgacctangccnaaataaacctggg

SEQ ID NO: 97034 - DNA, 592 bp, Triticum aestivum
  unsure (1)..(592): unsure at all n locations
  Clone ID: PAT_TA_97034
tgggatgcttaaaccttttgtgaagatggcaacgggnatcatctcacacctactcccctctcctgctcttgttcctcctgggcctgttcatgcaggggcatcatccggccatgcggttcgaccctgcctgccctccgggccaagggcgtcnggggctggcagtgggaaacctccggactgcggcgggacctccggtgccaaggcaccgggntccgcacgtcccngggtccccggtgtttccccgtacgacngtccaccccgaatgcaagttccgcgctgaaaccctgggangtacaaccngaagngcccgacgtttcttccctccacgcaagcgnttcnggttgataggggccttgacccaagaatcngcncctcgnaanccttgaaccgtttggggaaggggcccgccctccgnggtgggggngccaattgnaaaggggcaanccctccnaccgaaggttgancaatgggcgncaatcncccgtgggcgtttgggcctttcaaagaaangtccggtncnaccgttgaanggggnntactccaaanaacaacaagnttgggttgngggaatttcccnanggccaaaaggatg

SEQ ID NO: 97035 - DNA, 574 bp, Triticum aestivum
  unsure (1)..(574): unsure at all n locations
  Clone ID: PAT_TA_97035
agatcaaacgcaagcgggcggcaccaactttcctcttccttccaagctgacctaagctttcttgcgtgctcaagcgatgggcgtcgaatcgccgcaagccaacccccgncgccaccgncgagcaggcccaaggatctcatccgacgccgcgaggtacgacgaagctgggaaagacgtttgtcgccctcttctccgccggngtccccctcgaactccggcaagattcgcaaagggcccgaaacgggctcttcatatgggcttctgccaaatggggcatcttgctgtgggntgggaagttactttgattcaagaatgggaggccgaaatggttaaactctgcaaaacttggggggaaagaaacacgcctcctccaactgggggcatgccctcaatgggacaatacaaagagggtaatcaangggcttttgaatatggtggcgnggggggctaatcggttaaggtggcaactgaaacaaggccatgaagaaaaaccccctaatgggatgaaggcnacttgaaccccttgggaaaagatggggaagtggnncgatggcgaatngggtggcaacantng

SEQ ID NO: 97036 - DNA, 553 bp, Triticum aestivum
  unsure (1)..(553): unsure at all n locations
  Clone ID: PAT_TA_97036
ggnaaggtatatacctanatagtaacagccatggcccccaccgtgatggcctcgtccggncacctccgtcgctcctttccaaggggctcaagtccaccgccggcctccccgtcaagccgccggctccaacggggctagcctcggnaggcgtcagcaacggtggaaggatcaggtgcatgcaggtggtggcccatcgagggcatcaagaagttcgagaccctgtcctacttgccaccgctcaagcacggaggccctccttaagganggtccgactacctgattcgctccaantggggtgccntgccctccgagttcagcaaggggttggggttcatcttccgtgaggcacaaacgcaatcccctggggtactaacgatgggccgggtactgggncaaatgtgggaaagnctggccctatgtttcggggntgcaccngacggccacggcaangtngaatcaancgaaaggtgggcggaagggncaannaaagggagtaacccctganngccctaangttccggcaatncaaatccgggattcgaancaaacangg

SEQ ID NO: 97037 - DNA, 575 bp, Triticum aestivum
  unsure (1)..(575): unsure at all n locations
  Clone ID: PAT_TA_97037
cacanacataaacatcgaagcangcttggtagccaancaacatgaagaccatgttgatcctcgctctcattgccctcgccggcgactagcgtcgtttgcgcagctggacactacatgcaggccaagggctatgggcaatgccaacagcagccacaacaacaaggtgaacacatgcgctgctctcctgcagcagttgntangcccggacaccatatgtccaagtcacaaaatggtgggcaaggcaaagcgggtttgccaagttggattgccgggcaacaagttgctgccaaaccgctgggnccaagaatcttcggggaggcaaggctccgggtggccaattgcccgttcctgccgggtggtgggcccaaggttcantcaatgccggggaagcaagcaaanggggcnaacagtnttccgggtcaagccctcaagcaatcangcnacgggggcaaaagtttttgggccangccctcanaacangnaggggtttcccattggnggatanagaaagggatggggtgctttcanaacccctttccantcggaatgttggaaccgttgacacaatcccgcaa

SEQ ID NO: 97038 - DNA, 595 bp, Triticum aestivum
  unsure (1)..(595): unsure at all n locations
  Clone ID: PAT_TA_97038
ctcctgaggtacaangccaaaagtttgatgctctggttaatccaaaatgaanggaaagcaagagaagncatctcctggaagggaatcaagagagggatantagaaagggagatttgctggaanttgaaaagagatgaagaaaaaggattcagcacaatggncaagcaagacgaagtacttcngcngaagcaccctggaaactcaagaaagaaagtttgatgatggagattccgttatgattactgggggatactaagattaacggggcgaaaaagtcccaaagttcctttttactaagaacatgcaaataaatnactttattttgttccctcctggggaatcctcaatcatccaataaccttggggtggaanttccaataacnatggtggggacctggggccttgtttgaaaattccaaacaataaactncttnaacctttggtggccttttctggttggggccctcnatccaaatttttaaagggggttgcccaagccttttattttcaaagcgtgganncngacggcctatacaaacctccgaagggggggggggccccggggtaaccccaaatttccgccccctaaaaaagg

SEQ ID NO: 97039 - DNA, 604 bp, Triticum aestivum
  unsure (1)..(604): unsure at all n locations
  Clone ID: PAT_TA_97039
gcagcatccagcancaggtggcaagcgagctcactcgatcgcgctcgccatggncggcgtccancgccgcccgacgcttcctcctcctcctcgccgaaagtgaccgtcgtctccgtggncgcccgcggcgccggcgccgggcgccacccccggccgttcccgggngcggtgtacgccgttngggggaactccgttcacggggncaccgggcaaggggggcactccaaccaaccgggnnccttactccggtaacggggtacngttctccaaaccccggcccctacggggggcccaacctttcttccaaccngggtccaancaaaacggctaactncccggacggggccggcctccgtcggtcggaactttccctgggccaaccggaccgcggctcngnggctggccctccctttcctccccggcnctaaacttcctnccctccgccnggcccccaaaaggtgccaaacctccggnccangggaagnaaaggangcaaggcaaaggtnctacgggggggccnaanttctcccggtgggcccgggcaggctnacgngggcaaatccgangcacngaactttctttccgccaaagaaacaaaccctnn

SEQ ID NO: 97040 - DNA, 273 bp, Triticum aestivum
  unsure (1)..(273): unsure at all n locations
  Clone ID: PAT_TA_97040
ggtgggtgcctcgangggaccggtgccttcangcgtgcccctcgccgccganctccacgggngccgactgcattgcacagctccacagcgcccgcctccaacgcgccatgctcgggccaggagccatccaagatngtaccggtgtctganggcaccaccttcggtgtcgtcgctggcgccaagacagacacggnggnaatcgccagagtgcgcgtccgcaancctgttgcgggccgatcaangaaagcacatcatcggagcacttccatcaca

SEQ ID NO: 97041 - DNA, 600 bp, Triticum aestivum
  unsure (1)..(600): unsure at all n locations
  Clone ID: PAT_TA_97041
agacacggtacaaaaccacacaacacaanaanggataacgtcgccgtcgtcctcgccgccgggngccgatgacttcgccgtccgcccccatcctgnccaagacccttcgtaacctcctgccaaggtctcggccccgcacccccgcatccngtccgcgggggcaagccgtcgcccgtttgcccgagggaagaaatatgggcgcctgcccctgctcccgaatcgtcngctgccctccccgaaagggattcccgggcnggggagcttgtaccaagaggaactccaaaagttccgtgnccgcctgaaacgcccggaaggaccccgatgttaacggaccggcccgggcnaataattgctcaatcgnggatttcggataaaaaagcgaagnacccgtnaaagaattcaanggaggttcccttgaaagggaagctncgaacgggtggatttttccctcaaaagggtgganttcaattgttacaagaaagaaaaatgacnnaaaacaanacttttggttggggaatggctattgcnanacttgangcaagcctaaatgttagaaagcctgnttaaagaattttngaaaatctccaacanaaagaaann

SEQ ID NO: 97042 - DNA, 254 bp, Triticum aestivum
  unsure (1)..(254): unsure at all n locations
  Clone ID: PAT_TA_97042
ggtcaccgttgtttagtcgatggatatgtcgatgcagcggtgacaaataaagtgtcacacaatgtcatgtgtgacccgcccaaactagttgtttaaattctgaaataaaataaaaataaagttgtatcaagacaatgttcatattggcattgtgtggatgtcaatctgattgccatgcttgcaagttcataagtttgtctttccttgtcacaaaaaaaaaaaaaaaaaaaaaaaaaaaaanaaaananccaaaa

SEQ ID NO: 97043 - DNA, 591 bp, Triticum aestivum
  unsure (1)..(591): unsure at all n locations
  Clone ID: PAT_TA_97043
agattttccctccctgtcgccctccctccttcctttcctccactcgcgcttcgctctcaagatcccttctcctccgtctcgcccgcgtgtgggggtaggagccatgggcggaccagctcaccgacgaccaagatcgccgangttcaagggaggccttcaagcctcttccgacaagnggacgggagacggntgcatcaccaccaaagggaagcttggaactgtgaatgccgctccgcttgggggcangaaccccactggagggcaggaagcttcaagggatatggatcaaattgnnagttggcctgctggactgngcaaangggnaacngattgaacttttcctgangttcctcaaaccttgaatggccgccgntaaggatgaaagggacaacntggaattcccggangggaggggagcctntaaaggganggcctttcccgcggtggtttggacaaggggaaccaagaaattgggttttcaatcctccggncaagcttganacctcccgccaatgttcaatgaaccaaacctttgggtggaagaaagctgnacaagaacgaagggaggtgggattgagnatgaattccggg

SEQ ID NO: 97044 - DNA, 302 bp, Triticum aestivum
  unsure (1)..(302): unsure at all n locations
  Clone ID: PAT_TA_97044
cccactancancatcatcacacattcccaagcgcagatcgtctcaagaactcancagntccgtcccnatggagtcgctcancatgatggcgtccctctccgcngccgtngcngtcgaccggcgcgcnngganccccgcncccgcgggctcggggtgggccgggccgccaangtccagggccancanganccggcggncaanatggcaacccgtggagcccgccaaccgaaggncgccgtgccgtnggtgtttgntggccgccgctgcgganttgtcnggccaattggngggggtggcgtttc

SEQ ID NO: 97045 - DNA, 529 bp, Triticum aestivum
  unsure (1)..(529): unsure at all n locations
  Clone ID: PAT_TA_97045
ccctgattcatggtctcgtgatatcatatgtgatgatcaattcacggacactgaaagagcccaaatgatctctgttatgtgggcaatctggcattcgagaaatcgagtgactcatgatgatgactagctggagcctttcacttcggtgaggcggattcgggaggacttggcattgctggatatcccgcattctcatgctgtagtgctaccaggtcatggttggagaccgccggactcaggggtggttaagatcaacacggatgcagctttgagtatggattccgacaaggtgggtgtgggtggtgtagcacgctctaacacaaccttgttgggtgcttggagtaaaccccatattggggtcacggatccttttatcggtgaagacgctcgcgcttccagatggagttatttttgcaaatcctacggggtttgtcacatgtgaataatgggaaacnggatttgccngggagaattgttaatcccctgggaacaactcaacaacaacaagcctcccctggtgggtgggcac

SEQ ID NO: 97046 - DNA, 519 bp, Triticum aestivum
  unsure (1)..(519): unsure at all n locations
  Clone ID: PAT_TA_97046
cagtagtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcnatgataactcgacggatcgcacggccttcgtgccggcgacgcatcattcaaatttctgccctatcaactttcgatggtaggataggggcctaccatggtggtgacgggtgacgganaattanggttcgattccgggagagggagcctgagaaacggctaccacatccaanggangcaacaagcgcgcaaaattacccaatcctgacacnggggangtagtgacaataaaataacaatacccgggcgcaataatgtctggtaaattggatgagtacaatctaa

SEQ ID NO: 97047 - DNA, 154 bp, Triticum aestivum
  Clone ID: PAT_TA_97047
gatcaagaagagtcgtggcctaggctagtggtccacattgcacttggtggatgcgctggcctaccatctccccaagtgggagagtggacgtcgtaatttgtgatagagggggtacgcgttcgcgcggcccctgcttaaaaaaaaaaaaaaaaaa

SEQ ID NO: 97048 - DNA, 554 bp, Triticum aestivum
  unsure (1)..(554): unsure at all n locations
  Clone ID: PAT_TA_97048
ggaatccgccgcgcagtttctcctctcccctcctcccctctcacgtgttcatcgttctcctccctactaatccccctcccccctccctctccggnctcactggaacaactgccgctgctcggcgcgaccgactggcatctctggaccggagcgagtgattgcgtgtcccagatccaacagtatagtacagtattcaagaagtggtgccacccaccgcaaacacctggggggtagttggcggcgaaccgggccattcaagtccgacctcacctcggtggcgcctgcggatattcggtggncctccgccactccancccgccgcgcgagttcttggtccnctccgccggagttcgtcggggcccgcccgcgaatgcagtaagaagcaagcaaaggtctcgacaatacaaaaatctgncancggggagggtgaaagaccccggngggctcaaagcccaaaagaaggttctcngaaaatatttgcgggganntgcgaagctgnttccgggattcaaaaaaaggnacccccncaanagggcaacccgngnnggtccttg

SEQ ID NO: 97049 - DNA, 528 bp, Triticum aestivum
  unsure (1)..(528): unsure at all n locations
  Clone ID: PAT_TA_97049
cgangccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcaagcgccttccaccgcgtgatccccgacttcatgtgccagggcggngacttcaccaagggcaacggcaccggaggcgagtccatctacggcgagaagttcgccgacgagaagttcgtccacaaancacaccaaagcccgggatctctccatgggcaacgccngggcccaacacaacgggtcccanntcttcatctggaacgtccccttgcaanttggctcnacggaaagancttgtcctccgggagggtcntccaggggcaaggncctcctnaaanaa

SEQ ID NO: 97050 - DNA, 520 bp, Triticum aestivum
  unsure (1)..(520): unsure at all n locations
  Clone ID: PAT_TA_97050
ccctcccatcccacgccgccgccgccgccgcccaccaccccggcgacctcctcaccggtgatcctccagcctctccctctccttctcccctgcattcattcatctccaccccagctccacctccagccacagctctagagggaaggagagagagctcgattcgatggtggcgtcggtggtgctggcgctgctgctggcgtcggcgctggcggggacggcggccggcggcgacatcatgcaccanggacgaccaggcccccaaagatncccggctgcaacaacgacttcgttctcgggttagtctgtggccgtggncgtggggaatccaaatcgggaattgaaccgcactgaagcanctgaaatggactgggattggctgggttaacttatcaaaccataaattcttccgcgcctaaggtaatgcaaggatttggttcgcggnggctccaatggcaacctcggggctgctctcaaaacnttctttcacaaaaattgaaaaaaaaatctcaaaggtttcttg

SEQ ID NO: 97051 - DNA, 321 bp, Triticum aestivum
  unsure (1)..(321): unsure at all n locations
  Clone ID: PAT_TA_97051
ctctctctctctctctctctctctctctctcactctctntctcnctctctcnctctctctctctctntctntntctctctctctatcgcactngnngatgtcttgctgtnngcggtanctgcnggtgaggcgncnggatgaaagtgccgcaacggatgcngcgggtgtaagatgtncacagaagtggagggcacggtgtggttgctgcggnatggtcatgtggagcggcncncacagggggagctccngcgggtncgnaaggggcggggagatcggcgagctgggantgcacaacctgcaagtgnggcanggngagagggg

SEQ ID NO: 97052 - DNA, 518 bp, Triticum aestivum
  unsure (1)..(518): unsure at all n locations
  Clone ID: PAT_TA_97052
ggcatgaatggtgagctacatcaaaaaggaattacacccatcttatttgcatccgaaaagcatgttactcgttcatatatccaaatgaaaccgggatctcttccctacaccccgtctgaagtaggggtggtagtacgtccgcttgccgggggaggaggataaatcttggcaagaagcaatccgaaggaaaccacggncgacccaaaaaccaagcggccgagggtccggtcgacaagctgcctgctctttctccagcagcttcatgtacgacgcgtggcctaatcgccttttggctcggccatcgccgtgtcgtcgaagccaatcagatangaccgcacgaccaacgaccctgaagaaggtgctcggcggccttgcctatggcgctggtgagaagtccggcgaaaagaaggagtccggaacgcgatcgtcnccatgtcgcaactccgccacaatccaatttggggttttgttcgaagaaaacctnatcnggcggggggggggcccggntccccaanttn

SEQ ID NO: 97053 - DNA, 525 bp, Triticum aestivum
  unsure (1)..(525): unsure at all n locations
  Clone ID: PAT_TA_97053
ttgcagcaacacaacatagcgcaaggaagatcacaagttttgcaacaaagtacttaccagctgttgcaagaattgtgttgtcagcacctatggcagatccctgagcagtcgcagtgccaggccatccacaatgttgttcatgctattattctgcatcaacaacaacaaaaacaacaacaacaacaacaacaacaaccatcgagccaggtctccttccaacagcctcagcaacaatatccattaggctagggctccttccggccatctcagcaaaacccacaggcccagggctctgtccaagcctcaacaactgccccagttcgaggaaataaggaacctagcgctacagacactacctgcaatttgcaatgtctacatccctccatattgcaccatcgcgccatttggcatcctcggtactaactggaggaaagaaaaataactctagtactagatatatgaaacaccgttttctcagtccatngtttgggtcgtgtagcggggaaaaaataatggtggcatgcn

SEQ ID NO: 97054 - DNA, 184 bp, Triticum aestivum
  unsure (1)..(184): unsure at all n locations
  Clone ID: PAT_TA_97054
ggggaaagaaagaaagaaaaggaaaaccaaccagaagaaaagctcgggcgtttcttagcgtgggaggagaataggggagcgtgggcccctttctctnctntcctntcttccnnctctcnctntntccttcnatccnctctccnccttcccnacntngtccttttnntacgcatctgggnctccc

SEQ ID NO: 97055 - DNA, 514 bp, Triticum aestivum
  unsure (1)..(514): unsure at all n locations
  Clone ID: PAT_TA_97055
gcaacaacaacaacaaccacaacaaccaatttcacagcagcagcagcagcagcaacaacaacaacaacaacaacaacaacaacaacaaaagcaaatccttcaacaaattttgcaacaacaactgattccatgcatggatgttgtattgcagcaacacaacatagcgcatggaagatcacaagttttgcaacaaagtacttaccagctgttgcaagaattgtgttgtcagcacctatggcagatccctgagcagtcgcagtgtcaggccatccaaaatgttgttcatgctattattctgcatcaacaacaaaaacaacaacaacaaccatcgagccaggtgtccttccaacagcctctgcaacaatatccattaggccagggctccttccgggcatctcaagcaaaacccacaggaccagggctctgtccagcctcaacaactgccccaagttcgaggaaataaggganctagcgctacaagatgctacctgcaatgtgcaatgtctacatcccc

SEQ ID NO: 97056 - DNA, 524 bp, Triticum aestivum
  unsure (1)..(524): unsure at all n locations
  Clone ID: PAT_TA_97056
ccccggcgaagtaacaacggcatccatggcccccaaggcggagaagaagccggtggcggagaaggccgagaagacgacggcagccaagaagaccaaggccgagaagcggccgccggcgtccaaggagggcggcgagaagaaggggaagaagaagtccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtcggccaagcttgcgaggtacaataagaagcccaccatcacgtcccgggagattcagacctccgtccgcctcgtcctccccggcgagctcgccaagcacgccgtctcccgagggcaacaaggctgtcaccaagttcanctcctcctaagctaagatgcttttctgtaatagtcaagctgttcanaccatgtcctcctgtaacttttgttgggtctgtgggaacaacctn

SEQ ID NO: 97057 - DNA, 520 bp, Triticum aestivum
  unsure (1)..(520): unsure at all n locations
  Clone ID: PAT_TA_97057
gcaagctgtggtcaatacaaatccaccatgaagacctttctcatccttgccctccttgctatcgtggngaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcaagccacaaccatttcgancacaacaancatatccacaaccgcaaccacagtattcgcaaccacaacaaccaatttcacagcaagcaagcaggcaagcaagcaacaacaacaacaacaacaacaacaacaacaacaaaaggcaanntccctcaacaaaattttgnaaacaacaactggattccatgcatggntggttggtttgcaagcaacncaacataagcgca

SEQ ID NO: 97058 - DNA, 355 bp, Triticum aestivum
  Clone ID: PAT_TA_97058
gccaccggcaacctccaccatttctacagatggatgatcccttctctaccagttcccataaactcaggtcaagatctgaagggagggagaatatcaagggtgtacactaggagttgacctcttctttccaacacacatgctgccatcaccgttttgaaggaatggagcaactcagcgggaggatagatggtatatcttgaaggaatggaggagcaactcaactcaaatctgtaatccatccgcagagataaagcctcaagccgtaacgctcattccctatgtaagttccgtggttctccctatcaaatccaataaatttgtctaagtcttttgtgtgttgaaaaaaaaaaaaaat

SEQ ID NO: 97059 - DNA, 541 bp, Triticum aestivum
  unsure (1)..(541): unsure at all n locations
  Clone ID: PAT_TA_97059
ggcagctccctcccaactcccatcaaggaccgcgaccaccgcgtgttgaagctaaaaatcccccacaatgccagtatcctttgttcgtacatggccaggaccagccgcagcagaagccctcgctctccttgcttcctgctgagaccaaccagatcgcctcgccgctccccttcctgcccgcccatccgctagcgagctgagctganctgatggagcaccggaagcagcagcggagccccagtccccggagcggnggcagctcgggcaagcacgggcggcaagggggccagcaaggcgggcggcancgggggcaanaaagccgatcaaggtgggtgttcatctccaaaccccatgaggggtcaaagaccanncgagggcgggnttnccgcgccctcgtccanggaagctcanggggnccgccatgcccgacccctncaaggtacaaattancgaccgaangggccgccgcgggggcaaggatcttgaancccccggngggggaancgccgggcttggggtncaaccaccttgacgccggggg

SEQ ID NO: 97060 - DNA, 559 bp, Triticum aestivum
  unsure (1)..(559): unsure at all n locations
  Clone ID: PAT_TA_97060
nnnggcaacaagggtactacccaacttctctccagtaagccaaggacangggcanncaagggcactacccangcttctctgcagcagccagnanaaggacagccangacaaaggcaacaaccagtacaagggcaacatccacaacaagggaaacaaccaggacaagggcaacaagggtactatccaacttctccacagcaagccaaggacaagggcancaactaggacaagggcaacaaggggtactacccaacttctccgcagcagccagggacaagggcaacaaccaggacaaggggcaacanggggcantgcccaacgtcccccgcagcagtcagggacangcgcaacaanccattgacanagggccaacaatataangacnagttgcaacanccatgacaanggcaacaaagggtactacccaaacttctgttgcangcnagccctggaacaaagggcaacaaatcaatggacaaagggcaaccnagtctanggacaaanggacancaanccaaggncnatgggcaagcaaatcnnggtcaaggagcancnantg

SEQ ID NO: 97061 - DNA, 514 bp, Triticum aestivum
  unsure (1)..(514): unsure at all n locations
  Clone ID: PAT_TA_97061
ccactctcggcctcccccaccctagccgcacactcttccttcccactcttggcttaacctagccgcacgagtgaaggcggatctagcaccttggcagtggcaatgatgaatcctcctccttccaagcagcgtggatcagtgccatggcgacctagcgcgctcccttcccgaccttgacctcgaaaggtgttgctatattggatgtggtgaatttatttgggcagatcctggaaganaggagggggangtggtggctgcngncaatggcaaacacanccaacagangcatggngctctccgctgggtctaccnccctggntgaacaagctcccgatccatgttacaanacagggngaatannaatgaatttcanaagataaagaattgagctttgngggaaacanggcctttganaanggattgggtggaagttatannccgtgaattttctgctttttcaagancanttntgctgcccgaatgaacanctatttgggaactttcccaaangang

SEQ ID NO: 97062 - DNA, 510 bp, Triticum aestivum
  unsure (1)..(510): unsure at all n locations
  Clone ID: PAT_TA_97062
gatgagcatggctgagggcacttttatgcatcagatgagcatagctcagatgagcccatgcaccctaccaaacaagcaaaagtgggtcggattgggaacttttgccctcatacacccttcatgcaccctaccaaacacacccatagttccctctatggtttatatcttttcataatgttcagattctgttactgcattctaaagggtcctttaattatgtactccctctgttccacattgttgtcgtggttttagttcagaaggacaataattttggaatggaggtagtagttaatttcaaaaaagttgacatttttccttttgttgcacaagtatggtaagttaccgatagagcttgctgctagacgtgactgcatgggaagaagntgaaatgttgtttctttggcaaccccaaattccaancaatcccaaaactngggtataagatgggatnaaccncgcatgcnaaattgggacgtgcaaagccactnggggtgggangnaacctgg

SEQ ID NO: 97063 - DNA, 526 bp, Triticum aestivum
  unsure (1)..(526): unsure at all n locations
  Clone ID: PAT_TA_97063
accacactcatctgatnacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatgggccgcagcagctcggaccgcaagataacgtgcaggtgcctcaagaagcctcgccaccaagcatcaaagtccatcaacatgggcaaggtctccggcgtgcccggcaaagtgcngggtcagttgtgcccttcccatcaaacaatgtccaacaaacttgcgaanactggttcaaactagtttcaatataataaaccctttcctacgtggcaatgcaatnggaccgcnccttgttgtgggngcnttaatgtccan

SEQ ID NO: 97064 - DNA, 513 bp, Triticum aestivum
  unsure (1)..(513): unsure at all n locations
  Clone ID: PAT_TA_97064
ccgactcgagccctagccagtagcgactgttgcgccgccgccggccgctccgtgcgcctccaccgcctgctgctgtattccgagcgctgcccgctggtgtcttctgctccgtgccgctgctgcctgctgagccaccgcccgacgtcgagaaggggtgaataatggcgtcgcggcaggccgccggcctcaccgattacgagcgcctccgcgaggagaacatccgccgcaacgaggncatcctcgcctccctccgccgcaaggncgacgaagctctcggccgccatcaagtcctcgtctaaacgaggacgaggacgccccaacaatcaagccccgcaagaagcccgccgccaagaaaaagcccggngaagctccgccgctccctcgantctctnaagtcccccctccantccccggacgccgagcccaagcccggggcccctccggttgccgcgcaacaacangttctctcctcgctcgcgttctccaatattgaagtcgcctcgcttggggccg

SEQ ID NO: 97065 - DNA, 212 bp, Triticum aestivum
  unsure (1)..(212): unsure at all n locations
  Clone ID: PAT_TA_97065
cttngcttggattcatngctncncaccccaanaacattttnttgccccgtgcncggngggganaatcnaagaactaagnggntccccgggctgcangaaatcgggaacgaggntttctcctccccttcncnggttcggggtctggttcggttcnggtccgaaagtatctagccnanntctagggtttccgtagngaggtcacggggatgagg

SEQ ID NO: 97066 - DNA, 516 bp, Triticum aestivum
  unsure (1)..(516): unsure at all n locations
  Clone ID: PAT_TA_97066
ctcttctcccctcaacccaaactcaaatccaaatccccgaacccaccggcgatggngcgcggnggncgctccgaaaaaancggcggcgggtgcgggcggtgctgcctggggttcctgctcaagctcctcnccttcctgcaggncttcgccgncctctccgccgtcctctangccgnctccatcctctcccggtgggggngccaccatgagctccacatccancanctcctcccananctatggttcgcgtgcgccgtcatgggcgccgggctcctctactgngccatcctcctcgcgggntangtcgcccccgaggtcaagcaaagggtggtgcctctgcttctanaaacggcttgggaatggggatgatgctgctccnagggcgccgtgggcgggacgcatcctcctcaacgagcactgggttcaaagatctggccgcatgaccgcaccngagaagnttgagaaactcgtctcctttgtnaatggcaaacntccacctctgcaaaatgggggtgt

SEQ ID NO: 97067 - DNA, 520 bp, Triticum aestivum
  unsure (1)..(520): unsure at all n locations
  Clone ID: PAT_TA_97067
agagcgcatcatttaagccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcaagccgcaaccatttcgaccacaacaaccatatccacagccgcaaccacaagtattcgcaaccacaacaaccaaatttcgcaagcagcaagcaggangcagcagcaancatcaacaacaacaacnaacanatncctacaacnaantttgnaaacaaacaactgattccaaggcaagggatgttgtttttggcaacaacacaaca

SEQ ID NO: 97068 - DNA, 562 bp, Triticum aestivum
  unsure (1)..(562): unsure at all n locations
  Clone ID: PAT_TA_97068
gttcacttcaccgccggcggacgcatcgaagcgagggaggagcaatggcggaccgcgggggctacgtgnatgtgcagcacgggcagtacggcggcgggcaacacggcgggcagcaacagcacgggcgccagatgggggagcanatgaagggcatgctccaangaggaangcgccgtcggcgtcgcangccctgacggtggcgacgcctgttccccgctgggcgggctgctgcttggtgctgtccgggggctggcgctggcggggcaccgtggtggggctggccgttggccacngcncgttgttcctgcctcttcaaccccccttgcttggtncccgggcccggcgctcanccatccgggccttgncccgtcaccggggttcctcacctccgggcccncntgggggcctggggcgggcctcctcctcngctcaaccggtgtttggctnaacacgggccccgccaaggcngttccagcggcaaccccgggacctacgttggaaggaaggcgcccccaagccgcnatggcccaacggccngccnccggaccgccgggggcanaaa

SEQ ID NO: 97069 - DNA, 514 bp, Triticum aestivum
  unsure (1)..(514): unsure at all n locations
  Clone ID: PAT_TA_97069
cccagatcacgccgccgccggacgggtcaggcggccatcaccgctgcggaggtgagcacccccctcatccattccctcctccccatttccaccgtcctcccctcctgccccctcttccgtccgctggtgctccactccccgcaccccgtcgccgtccatctccgtctaccggcgcgcctcctcgccgccgtagaggccgctgccgccgctgggaaagcttaatcgccagcagccatgtccatccgatctctcatctccgcatccaggtccagatatgccctcgccgcttccancatctctcaagcaacttccaggacgcaccaagcacgcctgcgtgcctcctctgctctcggggnttggnccactcgcatgcgcctttagctcaagcgctgcaagttagcagatgttaaattcaangggtccgttgtcattggaagggcaganttttncaaaatgtctanctncaaaggggnagttctactccttttgggnnccaagcnaattggangcaatg

SEQ ID NO: 97070 - DNA, 509 bp, Triticum aestivum
  unsure (1)..(509): unsure at all n locations
  Clone ID: PAT_TA_97070
aaccaatacaaccatttgtagataatagtttatgatttgttacatcatcaaaggcatgaaaaacttgtgtcttcaaccaatacaaccatttggaccaccatagtaaaatatgtagcccctattgattttaacagtgaagtcagtttctttgtagcaatctggcctgtcaactaacttgatcatgtgagttgtaattgggtcccgagcatggccgttggcatcgtagatcttaatatgcttaaagtatgcagatctcttatcatcttcatcatctgggaattgaccacttcccattggaggggcatgtgtattatttagggaattaacaaatcctgtcagggcttgtnttcgtgattctccaaggcaaaagttgtcctgcaaaatgcccccaccaatgatggacgggncaaatccgtggtcgatacaccaaccccaatccccanaattccggntccttggnttaaaggctaaaccctgggcgttaatgattcggnctgggcaaaaaaatt

SEQ ID NO: 97071 - DNA, 515 bp, Triticum aestivum
  unsure (1)..(515): unsure at all n locations
  Clone ID: PAT_TA_97071
cggatcagaccagagacacagagcaaagcggataaactcgagggcaatagatnatcaccaaccatgtcgtgctgcggaggcaactgcgggtgcggatccggctgcaagtgcggcaacngctgcggagggtgcaagatgtaccctgagatggacgagggggtgaccaccacctcccagaccctcatcatgggcgtcgccccctccaagggcaccccgtcgttcgagggcgccgccgagaccggagccgacaacggcgggtgcaagtgcggctccaactgcacctgcaaccccgtgcacctgcaaagtgatccatcaaaatcaaggacaaggagatggcatggcatgggatgggacctaaatgaaaggaagcactantaataggttatngcatggggtggtgcgtttggtgttctcctttttaaatngccgccgagaataaagacgaagatttatcgtatcgtttcgttatcgttatccgagctanttcatggncccttgttgggcttgtaccgtnt

SEQ ID NO: 97072 - DNA, 574 bp, Triticum aestivum
  unsure (1)..(574): unsure at all n locations
  Clone ID: PAT_TA_97072
nccccgggctgcangaatttcggcaanaagacaaanaatataccccataaaatgactcncaataaggttgtacaatacaatgcaatatcgatgagctttgattttccacacgaagctaagattaagtttgcgtacaatcaagctgcaggggcagggcaaacctaaagctcccccttgagtacaagcgacaggcaatggcaggagagtgctatggacaaacngtcgttccaaggagagcctaaaaanaactttgttgaactggccgctcaaggaacccttcacgtttgagtacaagccgtaaagcgaagtactgctgcaaggttcgacacctccgtaccaacgaagttgaggancgactcntgctttgtcccgtgccccgagaaaggcaactgggatggccgatgctgcnntccaatggattcctggntaaatggctcctgcaaaatgttttgtttctgatnggcgcaaaggtttgcnttgcccaaaggcaaaatgaaantttgggttcccctggtgggaagggaancgcaacccaatccctttttccaaatggcaaaggttccttgaaaccttg

SEQ ID NO: 97073 - DNA, 423 bp, Triticum aestivum
  unsure (1)..(423): unsure at all n locations
  Clone ID: PAT_TA_97073
tcaaaactccttccaacgccgctgcctccctccgctctcgtatttggatattcccctctcggttcgaagcancanggtanggtagggttcctccggaggggttaggtattttccgaccncggtgatggcgganggggtcccggagganggccgccggggcgangagccggagccggtgaccccggcggcggcggtggcggcggcggnggaagggtcncaagggctcgagggacangcgtctgctgcggtcncggtacctcgcccgtcaagagccanatnaacgacnagaaggacaaatggcgagcgcggactccgtcaagtttcantcccgtcatctcncaagtggagaagctgcaacaacacgttcanaatccaaggaagcaangtancttgatgcaaaagcaattgctgggcnatnccaac

SEQ ID NO: 97074 - DNA, 262 bp, Triticum aestivum
  unsure (1)..(262): unsure at all n locations
  Clone ID: PAT_TA_97074
gcgctccaggcgggtcacagcaggacgggccgggggatncctgcgcaccaccggacggccggcggnctcatcatccatctccgcgagatnaacccacctgagcaccggagcangcaccgggggcgaggaggggatgggggaaggcanttttccnncccccccacntgttgtgcaagtgtgggaangaactcccngcggcntgggtngcgcngcgctnagtcnccctccnggtcgcgagactcatttttctcctncacacttg

SEQ ID NO: 97075 - DNA, 386 bp, Triticum aestivum
  unsure (1)..(386): unsure at all n locations
  Clone ID: PAT_TA_97075
cttcgatnagtaaccagctagaccagcaagcaagcgagccatggnagcgacctcctcctcctcctacgccgtcgcggtcgctctcctctgcctgctcgccgccaatggntgctgcggntgccctggacccgcacctgcccccananctanacctaaacgtgcccccgctanccccagccccgtccccgttacacctccaactgngccagctccccccanccccgtctccgttncacctccaactgtgcccgctantcccaaacccaangntccggggtncgggtccgggaanganaacanctcctccggngggtgggtttacacnangggcacctggtatggggcanccnattgggccgggggcgggaccaaaaattgggggggcg

SEQ ID NO: 97076 - DNA, 514 bp, Triticum aestivum
  unsure (1)..(514): unsure at all n locations
  Clone ID: PAT_TA_97076
attcgctccaagctcgaacaaaggagagaccgtcagccatgtccgggcgcggcaagggaggcaaggggctcggcaagggcggcgccaagcgccacaggaaggtgctgcgcgacaacatccagggcatcaccaagccggcgatccggcgcctggctcggaggggcggtgtcaagcgcatctcggggctcatctacgaggagacccgcggcgtgctcaagatcttcctcnagaacgtcatccgcgacgccgtcacctacaccgagcacgcccgccgcaagaccgtcaccgccatggacgtcgtctacgccctcaagcgacaggggcgcaccctctacggnttcggcggggtaagggtcgtcctcgccctccctgcaaantccgatgtgcttgttcgcaatgtgcgcangagtctcnctgtcnaaaaaaattancttgaaatgaaatccccatgtttatctcccctggttccctcgtangaataactgtttnntcaaaaaaaactgtttccaacaaa

SEQ ID NO: 97077 - DNA, 364 bp, Triticum aestivum
  Clone ID: PAT_TA_97077
gatcaattatttaatgacatcatgaagtgcgcttagcatatccattgatctctatccactgggacaaatattgcagttgcacttgccaaagatcttcccatcacaccaatgttcgtggatccacttgtcattccaatgaaacaggcattcaagcttgcattcatccttggtgcagaacactgtcagatagcgttgaatgaaacaattctctgcaggtgtagtgcttctgaacaagacaagcatcaccagaaaacaagcagtggaagaccttccatccattcttgaattatacactccaacgagagccaaagggtcaatcaagcctactaccaacaggttgtccctgatgaaagccaaggggggg

SEQ ID NO: 97078 - DNA, 511 bp, Triticum aestivum
  unsure (1)..(511): unsure at all n locations
  Clone ID: PAT_TA_97078
tcctcctagcaagctatatacctacatagcacagccatggcccccaccgtgatggcctcgtcggccacctccgtcgctcctttccaaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaaagctgcctatgttcgggtgcaaccgacnnccaacacaggtgatnnaccaaggtggnagaagtcaaagaaaggagtaaccttgacgcgtacgttccgcatcatcgggatttcgacaaacnatgcc

SEQ ID NO: 97079 - DNA, 339 bp, Triticum aestivum
  unsure (1)..(339): unsure at all n locations
  Clone ID: PAT_TA_97079
tcgtcncgtcncgtgctgcgtttctcctcctcccccgcncctcccccattcgccgtccgnggttctctccaacgancaagctcacacatcaanacaataaataaaancncntttgtttggggccaatcaaaccaaacaacaaagttcatgtctgatctcnangtcaaggttccanctgcttttgatccgtttgcngaggcaaangcngaggactccggtgctggngcnggatcaaagaantangtgcatgtgcgtgtccaacatcncaacggaanaaaaannctgactactgttcagggnttnncaaaagattacaggnacaacatnattccaacgatc

SEQ ID NO: 97080 - DNA, 539 bp, Triticum aestivum
  unsure (1)..(539): unsure at all n locations
  Clone ID: PAT_TA_97080
aatcattcccccagcaacaaccatttccaccacaacagccatatccgcagccgcaaccatttccatcacaacaaccatatccacagccacaaccatttctgccacaactaccatatccgcgtccgcaaccatttctaccacaacaaccatatccacaancggggaccacagtatccgcaaccacaacaaccaatttcgcaacagnagcaggcagcaacaanaacnacaacaacaagatccttcaacaaattttgcaacaacaactggattccatgcagggatgncatcttgcaacaacataccataagcgcatgcaangctcaacaaagttttgcaancaaaagtacntaccagttggttgcnaacaaattggngttgtccaggcaagcctggtgggcnagatccccngaagcagntcgccgggtggccaaagccaatccaacgaangtttggttcatgctatntatttcctgcagtcaaacaangcaacaanccntnccaaccaacaaannaagcaanccacgcgnnctatcaaccaa

SEQ ID NO: 97081 - DNA, 506 bp, Triticum aestivum
  unsure (1)..(506): unsure at all n locations
  Clone ID: PAT_TA_97081
gatgaagttaacaagaagaatctattatatcatttgggttgagagtatctcatctcaactcatcttgtgctgtggtgagaggggggcataaatacagcgaaagaacttttacactgggttgggtccctttccctgctgctgctactactaacaactattactacccatggtaaactctttcaccaatcaataacacaacgcaacgcacgcacgcaccgcccatcgccgccgtgcgcacggcggcgggcggctgatatatatgtatgtaatgtaaatcctgtaagatggtacacaggaaggctacatgggaaagacacagaaaagctaaggaaaacaaacagtaagatgaagaagaagcaggggtccttgcttctctcttttcctcctgacaaagcctcccgcgccaaaaacttccgactgttgtataatttacagcaaccgcgtaaggcccgggacaaacctccaacaatccgggngccccggnaaaanngggcaacttnccgccc

SEQ ID NO: 97082 - DNA, 517 bp, Triticum aestivum
  unsure (1)..(517): unsure at all n locations
  Clone ID: PAT_TA_97082
ccaaaccctagcctccactccgccccctaacccaaancctacccgccgccgccgtcgccgccgcaacgcgcggaggcgacctcgcaccgccgccaagatgcagatcttcgtgaagaccctgacgggcaagaccatcacgctggaggtggagtcctcggacaccatcgacaacgtcaaggncaagatccaggacaaggagggcatcccgccggaccaagcagcgcctcatcttcgccggtaagcagctcgaggacggccgcaccctcgccgactacaacatccagaaggagtccaccctccacctggtgctccgcctccgcgggggcgccaagaaagcgcaagaagaagacctacaccaagcccaagaagcaaaaanacaagcacaaagaaggtgaaagctcgcccgtcctccagttctacaaaggtcgacgaacgccaccgggcaaaggtgaccaaggctcaaggaaaggagtggcccaaacgccgaacttgcnggggccggnaacnttcatgggcn

SEQ ID NO: 97083 - DNA, 495 bp, Triticum aestivum
  unsure (1)..(495): unsure at all n locations
  Clone ID: PAT_TA_97083
ttcaacaaaatgctgtactctgttcattcatgagatccagttacacgtacctgccggagctgagtcgccatggcctctcccaccggcacggattgcagcagcctctatcagtgcatgcagcttcgtctctccaccagtgatctcgccgggagcagcatttccctgccggcaccgagatcgagcaccaagccccacatcggcagatctacctgctcagccacagattcagcagatgcacattggtgaccacctgcttgtcctgggcgttgttggtcctaattttgggcaagcaaaccagttaaacggtcctttagctaattagcctgagtgttgtcccaaatgtaccacgaactatgcaatctgtcatttagatttggaaagtacgcgctaagccctttgtcatcaaccctgaagggtcttttgtgtctgtaaaaagtccgctggtaatcaagggttctaccaataaaataacgaacgggcgccaaacatggnngg

SEQ ID NO: 97084 - DNA, 489 bp, Triticum aestivum
  unsure (1)..(489): unsure at all n locations
  Clone ID: PAT_TA_97084
gggactttagcctcctgcgccgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccagcgccgagttcccgaacgctgcccgctggtacgacaccgtcgccgcggctgttgcttcaaggttccctggccaagtcctctggggtgagtgcatcatcggctcctgctgcaagctgctcctgccgcttccaaggatgaagatgacgatgatgacatggatctgtttggcgatganaccgaggagggacaaaaaagctgcagctgaagcgtgaggctgccaaagcctgcaaaagaagaaaagaaagtggcaaaatcctccgtcctcatggacatc

SEQ ID NO: 97085 - DNA, 515 bp, Triticum aestivum
  unsure (1)..(515): unsure at all n locations
  Clone ID: PAT_TA_97085
tcgagcgcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaaggcctgctgcagcaccaagctgcgaagccagcacctgctgagaaaccagcactgggcagctgccgatgtaaccaagcagattccagctggcattccaggtagccgggcgaacaaactactaccgtgcagatggccaagaacacggggcaacttccttacgggaccgtccttcaaccaaggtttcatgctgctcccggcnggtggctccgtccctggggctactttgtttgggcggggaaagtgaatcttctggttaaatggatggctgcccaatgnaattgggcctgttatctnctgttatccaatgtggtgaaaaactgggaaagntgtttgggtttcancaagttttaccancctgccgtcnatttt

SEQ ID NO: 97086 - DNA, 377 bp, Triticum aestivum
  unsure (1)..(377): unsure at all n locations
  Clone ID: PAT_TA_97086
cccctctcgccctcctctcgattcgatctcggcttcctctccaagccacgcgaagaccaaagctccggccatggccgccacgatccaatccgtcaagggccgccagatcttcgacagcccgcggnaaccccaccgtcnaggttgatgtgtgctgctcaaatggaaccttcgccaagggccgctgttcccaacgggtgcatcaactggtggtctaatnaagctttgngagctgaagggaagggtgggattctgactaactttggggcaaaggggtggtttcccaaanggntggttaaacaaanttgaaactccaattaattggcaacctnccttttggtcngnnaaaggaaccctaccnccncaaanctngngccccg

SEQ ID NO: 97087 - DNA, 489 bp, Triticum aestivum
  unsure (1)..(489): unsure at all n locations
  Clone ID: PAT_TA_97087
ctcctccctggccgccaccacctccggcgccctctgtccgccgccacctccggcgccctctgtccggcgagatcgatatggatcgatcccctccaaccctccgactccacgactcatcctcctcctctctggatcccaatcccggcctcctccacgctgagccgagcgacactccccactcccagacgaaaccctagcctgagaccccttcctcctcgatgggcaacccctccatggcggccggcggcaggatgccgttggcggagggggtccgcaccgtcggggcccanatccgcaaccgcatccgcatcttcgtcttctctctcttgccggctccggacagagagacaaacttcaaatctctctcgctgcggggcgagcggggcggggatggagagccccacatcggcggcgtccggggtgggacttctaacgggnttcctcgaccggcatggcgccgcccaaganggcgccgggcctcttccggct

SEQ ID NO: 97088 - DNA, 502 bp, Triticum aestivum
  unsure (1)..(502): unsure at all n locations
  Clone ID: PAT_TA_97088
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcaacgncttccaccgcgtgattcccgacttcatgttgccaaggcggcgacntcaaccggggcaacgggcaccggcggcgagtccatctacggcgagaagttcgccgacgagaagttcgtccacaagcacaccaagcccgggatcctctccatgggcaacgcggggcccaacaacaaaggntcccaattcttcaatctgcaccgttccctgcaaattggctcgacggcaaacaagtggtcttcggcgaagtcgtcnaaggcat

SEQ ID NO: 97089 - DNA, 292 bp, Triticum aestivum
  unsure (1)..(292): unsure at all n locations
  Clone ID: PAT_TA_97089
aggtattcttgtaagtactgagggaacgtctgtattagaatcacgtgtttaaacatcaagttccatattcggttaagttgctgcctagtcctgttctgttggttgtaaagcactttgttgatatttctttccctttccacccaacacagggtaagtgataggtctgatagcaggatgatgtatttttccttgagctggtttctctagaacattcatttttgtagtaatacttaagtgtggaccaagccgtcatgcttaccttcatcagatgatcttaaaanaaaaaaaaaaa

SEQ ID NO: 97090 - DNA, 493 bp, Triticum aestivum
  unsure (1)..(493): unsure at all n locations
  Clone ID: PAT_TA_97090
ctctgccgttgtcgtcgtagagccaattggaattactgaaagaaaaggtgttcatatgatgagatcttcctcttcttccatggnaccagccatggcaatcctggctatcacactcatacgctgctccctgccatgctctgctgacatccaagttcatacggagggaacccgtgagcgacagagccctccggcgccacaggcagcgccacgccagggtatggcataccgccgccgccccaacactacgccgccggcacctgcagtgctgcaccgcaagaccctgcagcaggctgttccagtgccaccgatgtgatggactatcctacgtgcgctcagaaagttaatcgtttttgttggcagagtgaagtagtgtcactgccagcgatattttactaactccagaaaactaagtatgtagatgcatangctctagtgctcttttataaaaaaaaatctttcaataagatggctatatgcatcgttccgtaataat

SEQ ID NO: 97091 - DNA, 492 bp, Triticum aestivum
  unsure (1)..(492): unsure at all n locations
  Clone ID: PAT_TA_97091
ctgcttggacttgtttaacacccaacaccgtaccaccgcttcctcctcccttcttcgagtgacatcgccgcagaccggaccggcagcgaggcgcggcctttcgtgctcctcgggatgctcgaggcaaatgagggtgcccatggcgacggcgagcagtgcgacaaggttcagagttcggacgtgatgagtttcttcagtgaatatggagatgcaagcagatacaagattgaggaaatcatcggcaaagggagttatggggtggtatgttcaagccatcgaccggcagaccggcgacagggtggccataaagaaggtgtccaacatcttcgagcacataaccgacgccgctcggatgctccgcgagatcaagcttctccggcttctcangcaccccgacatcgtccagatcaagcacataatgctgcctccctccaggagggactacaaaggacatatttgttgtctttgagctcatgggncacggggnctcca

SEQ ID NO: 97092 - DNA, 517 bp, Triticum aestivum
  unsure (1)..(517): unsure at all n locations
  Clone ID: PAT_TA_97092
acgcacgccacgccantcatgcgcctcggnaacaccgcgtccctgctcgcgcctcggccgcccggctggtggggatcgacccgtccgcccgccgccggagatcgctgctggtgagggcctgantagggggcggggatttgatttgcgattcggttcgtgcggctgcgcgcnangggggtgctgtcgcggccgnaggaggtgtcggcgctgctcaggntcaagctgggcggtcgggggcgggatcaaggcgccanattcccnccccaggangcactgggncttcgccctacnacatgctccagccgggtctcccgcagcttcggcagctcggtcatccannaacttcggggnccaaaaagctcccncaaatgccggtggtggnggttctttctancctcggtgnctccnggggccccctgngacnacccggtcggagnggaccgaanaaccgccaattcccctaaatngnanggtcaangcnttgccccnatccnttctggggaacttcctacccggc

SEQ ID NO: 97093 - DNA, 260 bp, Triticum aestivum
  unsure (1)..(260): unsure at all n locations
  Clone ID: PAT_TA_97093
gccgcaggncgccagcccgccccccgccgccgcggccgcagccatggtgccgtcatcctcccgctccaangtcccactctgggnggcgggggcggnggccacgtctcnctnctccctctcgnccttcctccctgcagggcacaccncctccctcgggtnaatggctccgntctnntcaatcctcctgctcgtggctcttctccntcggncttcctctatcgacaatctncgcntcggccnaacggtcnnccgcgcctcgg

SEQ ID NO: 97094 - DNA, 512 bp, Triticum aestivum
  unsure (1)..(512): unsure at all n locations
  Clone ID: PAT_TA_97094
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggnggccctcctcaagcaggtcgactacctgatcccgcnccaagtgggtgccttgcctcgaagttcaagcaaaggttgggttcatcttccgttgaaggacaacgcaatccccnggggtaactatnaangggccnggtactgggnncaatgtgngaaggctgcctatgttcgggtggcacccgacggccaacacanagtnnatcaaccganggttggngtgaaggtcananaaaggagtaccctngacgncntattgtccngcaatcaatccggttttct

SEQ ID NO: 97095 - DNA, 506 bp, Triticum aestivum
  unsure (1)..(506): unsure at all n locations
  Clone ID: PAT_TA_97095
gcgccatggaagccacctcgtccctcacgcgctccctctccctcgtcccccgcccccgccgctcctcccgcgccgccaagtccccgcacatgcccaccctctccccggcgccgcgcgtcctcccgctccgccgcgccaggtcggacgccgacctcctcgggtccgtccccgccgcggcgccagcctccgccggntccgtcctcctccgctcgccccgcccacggacgngcaacgatgaggacgcgccgatggaggacttgcttccacngcgcgggncgccggcaaaggggcaacaacanctccggccgcggtcggggggcanccggagggcgccggcgggaaacnggccaaganngccggnaatgggggggaagcaactaacccgcnacggntgctnaagggctgggagccggnaaaacccgcttgctggctggcncaaantaaangggaaagtnacttgcancgaaagttggagncgcgattnttggcnggggnccctaagaagt

SEQ ID NO: 97096 - DNA, 244 bp, Triticum aestivum
  unsure (1)..(244): unsure at all n locations
  Clone ID: PAT_TA_97096
cctcactcctcnattctttcacttanaaataattgtatttggggggggggggggcgctctataactangngggngggcngggtcttnatnaantcctggncggaacccctctccccanccacttttcccttcttctcgganggggggncaaatcaactaacccctaaaccnttctactgaaataaatgnnatccccaagattcctcnanggactggcgactanctgtcgtgtgtgttcnttttc

SEQ ID NO: 97097 - DNA, 542 bp, Triticum aestivum
  unsure (1)..(542): unsure at all n locations
  Clone ID: PAT_TA_97097
gggggtcccccgggctgcangaaatcgctcccaaagttgctgttgccaagaanggccatgccaaggcccaggccgccaaggttgccaaggctgtgaagtctgggtcaatcaanaanacggcaaagaagatccgcacttctgtgacatttcaccgccccaagaccctgtccaaggccagggaccccaagtaccccaggatcagcacccctggaaggaacaaattagaccagtaccagatcctcaagtacccgcttaccactgagtctgcgatgaanaagattgaagacaacaacacccttgtcttcantgtcgacctcaaggccgacaagaagaaaataaaaggtgctgtcaagaaaatgtatgacantcangccaagaaggttaacaccctcatcaaggcctgatggcnaagaagaaggcgtncgtgaaggctgacaccnagactacgnntgctcttgacgtggnccaaanaggattcgggatcaatattaanccaagangggagggnccctggcagtaaagcgccttggtttcctnggttt

SEQ ID NO: 97098 - DNA, 500 bp, Triticum aestivum
  unsure (1)..(500): unsure at all n locations
  Clone ID: PAT_TA_97098
tttcttgcatccacgagggnaattnccaccgctgatgtccaaaacccatcggccgcgctgacggaggangcgcccgcggtgganaagccggtcgccgccgaggaggtcncgaatacggaggaagcccccgcgccggtggaggccgaagtcgaggcgcctgcccccgtcgaggttgaggagaccaaggangaggcgccggcagcanttgaggcagangagacgaaggagcccganccagcagctgcggccgaaccggaggccgaangcgcccgccgntggtccganacananaccaaggaggccgtggcttnngcaaatccggcggcggccgatgaggtnaangaagaggcggcgcctgctgccgaggccgagccggcccgctcccgctgcttgctgaggaagcaccggtggagggaancccgcgggccgcngntgccaancgtcaagcntgttgaagcnccaacgccgctcngaaggatgaagctggcttgggttcatct

SEQ ID NO: 97099 - DNA, 358 bp, Triticum aestivum
  unsure (1)..(358): unsure at all n locations
  Clone ID: PAT_TA_97099
acaaccttcattttcgcagcaaccactattttcacagaaacaacaancagttctaccacaacaaccagcattttcgcaggcaacaacaaacagttctaccacaacaaccagcattttcgcagcancaacaccaacagcttctgcaacaacaaatccctattgttcatccatccattttgcagcagntaaacccggtgcaaggtattcctccaggcagcagtgtagccctggtggcantgccacaacatcttgctatgtcgcangatgtnggcagcaagaagcagttgcaatgtgntgcangcnaacaatgttgccaacaattgccacnaattccccgancatncccgntatgaagnaa

SEQ ID NO: 97100 - DNA, 534 bp, Triticum aestivum
  unsure (1)..(534): unsure at all n locations
  Clone ID: PAT_TA_97100
agtggntcccccgggctgcangttttgcagcaacaaccttcattttcgcaagcaaccactantttcanagaaacaacaaccagttctaccacaacaaccaagcattttcgcagcaacancaaacagttctaccacaacaaccaagcattttcgcagcaacancaccaacagcttctgcaacaacaaatccctattgttcatccatccattttgcagcagctaaacccgtgcaaggtattcctccagcagcagtgtagccctgtggcaatgccacaacatcttgctaggtcgcagatgtggcaagcagaagcagttgcaatgtgatgcagcaacaatgttgccaacanttgccacgaatccccgaacaatccccgctatggagggcantccgtgctatcatcttctccaatcatcctacaagaacaacaacagggttttgtcnaacctcagcagcaacaanccccancagtcgggntcaaggngtctaccaaacccaacagcaagtcgcaagcaagcagctccggacantgtttn

SEQ ID NO: 97101 - DNA, 494 bp, Triticum aestivum
  unsure (1)..(494): unsure at all n locations
  Clone ID: PAT_TA_97101
agcaccctcccctccgctcgactgcgcggatcactatgctcccgccgcaactccccggacccgccgggcacctcccgctcgcccttgccgtcaccgcctccttcgccatcaagctgcagcggtggctccgccagcggncgctcccgccgccgccgccgcgcgaagcccaagcccatcgtgttcccgcccccgccgctccgccgcctggtctcctcctccctccgccgcctcctcccgcgcccgcgccccctccgcggggggatggctcgggccaagggggaggcggaaggcgcccgccgaggacgtggtgctgctcgtcctctctctgggcctgggcgacagggctcgccgtcctcgctgagggctggngcggcgtccgggcctggggcaaggcgctcggnatctggggcggcggtgtgggggggnanaccagangangaaaaagggcnancgggcttccggagggttcncgggggcntgnttgctngggaatt

SEQ ID NO: 97102 - DNA, 485 bp, Triticum aestivum
  Clone ID: PAT_TA_97102
gatagaccccagtttttttacagaatatacattctgaatttcaggtctcccagaggttgccattgaccattgctgataaagttcaacgttcaaaggcattggttgaatgtgatggtgactcgatagacttgagcggagatattggagctgttggcaggatagtaatttcaaatggtccgactggaaatcatgatttgttactggacctgaaaggaactgtgtacaaatcaactatagtgccatccaggacattttgtgttgtcagcgtgggacaaacagaagcaaaggtttgtcgaccataacatgagttatatatgtgtatttaacttctccgtggaaccaacacttctatcacctaaagccccattttcactaagtaaatttgacgatgtattagttgcattctgtttcaatgggatgcaactgcctacttcaattcccctcctcctttgtagattgaggctatcaagaatgacttcattcag

SEQ ID NO: 97103 - DNA, 377 bp, Triticum aestivum
  unsure (1)..(377): unsure at all n locations
  Clone ID: PAT_TA_97103
gtcgcctcctcctaaaccactctccctatccccgtgtccagaagctaccccccggctccaatggcggcgaaggaaccgatgcgcgtgctcgtcaccggcgccncaggacaaatcngatatgctcttgttcccatgattgccaaggggagttatgcttggngcagaccagcctgttattctgcatattctgggatattgaatttgctgctgaatctcttaaaggtgtcacngatggaagttgatttgatgccgcatttccacttctcaaggggagttgttncaacaacctgatgttgttgaggcctgcacctggtggtgaatgttnccggttatngtttggtgggattcccccaagnaaanngaaagagaaattggca

SEQ ID NO: 97104 - DNA, 380 bp, Triticum aestivum
  unsure (1)..(380): unsure at all n locations
  Clone ID: PAT_TA_97104
cttaactccggctaggtagctagcaatggncgccgcactgagcctcngcgcgccccttctcccttgcgcgccgttngcgccaaccggcgccccgcggtgggccctcncgcccggnggggcctcancctcgccgnccgcnaagcaaggtgcnggggaagccaaggctcccgcncccagncgacgttacaaaggtgaanctggttgaccccccgaaggggcnagggtggagntggagggtccccnattgactttntaaatccnncaacaaaaggccgagggaggntggnggttttactttgccntagnccccttcntgcnccgggttnnttngtttctctctttgcccaggnanctttttgtgntcnccncgtngangttct

SEQ ID NO: 97105 - DNA, 516 bp, Triticum aestivum
  unsure (1)..(516): unsure at all n locations
  Clone ID: PAT_TA_97105
nagttcgtcaataaatangttctccagaaaccccgaaaccccgcgaccaccgcctcgccgcttccacnaacgagtgcgccgacggacgacacctccactaacgcctctcgcccctcgccgcgcgcgancgacgcccaccgcgttacgatggtgancgacgcggccgcgctggcggtcgtgaaggncgcgcgccccgtcttccgcggggcccacgacggagtggcgttcgccgcaaacgccgccttcctcgccgncggatactccttatgcgccgtcgggcctgcccgcgctcgccgaccccctcccccgcaagttgacnnangaggtgggaaattgatggggtggaacactatgggacaaattgctatgccctttctggtactccnaaggaggagggaggggcaaagaaaaaancccattttaagtgaaaatgtctaagtgattggatgacntcccttgcctatttgatgcgctggggtnttgangggaaaacanaaagggaaccctggcaanntt

SEQ ID NO: 97106 - DNA, 211 bp, Triticum aestivum
  unsure (1)..(211): unsure at all n locations
  Clone ID: PAT_TA_97106
gacacatngcngtccacaangtcancattgcaatcttgtgccttaattttgctcatggcactcctctttgcttccctgcagggatctnaaggcgcccngcaggggggttnaagccagaacttancaatactgaccaattgcaaggggtggactcaaaatgcaccagancacctgcggnaacaattttaaattttccccgttanttccgggg

SEQ ID NO: 97107 - DNA, 369 bp, Triticum aestivum
  unsure (1)..(369): unsure at all n locations
  Clone ID: PAT_TA_97107
catgaagacctttctcatctttgtcctccttgccatggcgatgaacatcgccactgccgctaggcagctaaaccctagcaacanagagttacaatcacctcaagaatcattttcccatcaacaacaaccatttccacagaagccanatccacaacaaccatatccatcanatcaaccatatccattgcagcaaccatttcccacaccccaacangaggttccccaggccccaacaaccgagncccctacanccacancaaccattcccccaggnaagccacangcanccttttccacaggncccnacattcatttccttgggaacnacancaaccatttcccaagacccagnaatcggttccctctggg

SEQ ID NO: 97108 - DNA, 544 bp, Triticum aestivum
  unsure (1)..(544): unsure at all n locations
  Clone ID: PAT_TA_97108
acangaaacacaaagcaagagcgggtaaactccgagggcaatagatnatcaccaaccatgtcgtgctgcggaggcaactgcnggtgcggatncggctgcaagtgcngcaacggctgcggagggtgcaagatgtaccctgaagatggacgagggggtgaccaccaactcccaaaccctcatcatgggcgtccccccctccaagggcaccccgtcgttcgagggcgccgccgaaaccggagcccacaacgggcgggtgcaaagtgcggctccaactgcacctgcaaccccgttgcacctgcaaagttgattcatcaaatcaaggacaaaggagatnggcaatggcaatggaatgggaccctaaatgaaaggagcactanttagtaagtttatncaatggtggtgttgcgttttggtgtttctccttttttaaattgcccggcccgagnaataaagaacgaagatttatccgtatcgttatccgtaatcnntaatccgaagnctantttcatgggccccttgtgggcttgttacccgttgtgggtgt

SEQ ID NO: 97109 - DNA, 500 bp, Triticum aestivum
  unsure (1)..(500): unsure at all n locations
  Clone ID: PAT_TA_97109
gcctcctcctcctcctctcggctccttctccttccttccagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaanccgctgagatgaacaanaggtccttcaagtacgcctgggtgcttgacaagctgaaggccgagcgcgagaggggtatcaccattgatattgccctgtggaagtttgagaccaccaagtactactgcaccgtcattgatgcccctggtcaccgtngacttcatcaagaacatgatcaccggtacctcccaagctgnctgtgctgtgctcatcatccnacnccaacactgggngggtttttgaggctggnatctcnaaaggacggncannacccgttgagcaacgccctnccntggcttttcactccttgggagtgaa

SEQ ID NO: 97110 - DNA, 511 bp, Triticum aestivum
  unsure (1)..(511): unsure at all n locations
  Clone ID: PAT_TA_97110
cggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctgttgtcgtcatggtgacgctgatgatcttggcaagggtggacatgagctgagcaaagagcactggaaacgctggtgcccgttgttgcttgcgggaacatcnggcctccangggctaagatgtcatcttcccccgaccaaacgtccttacagatttggggaaccttttcaaaaatgcagatttgcaatcctcn

SEQ ID NO: 97111 - DNA, 312 bp, Triticum aestivum
  unsure (1)..(312): unsure at all n locations
  Clone ID: PAT_TA_97111
cttttccccacatgactcccgagggctccggcggccgcggcggcggcggcgagatggccctccgccccggccctccgcaggcggcggcgccgctggaagacgaggacgtcctgggcgagatcctcgtccgcctccccccgctgccctcctcgctcgtccgcgccgccgccgtctccaggctctgggggcgcctcgccgcggaccgcgccttcctccgccgcttccgcaacccaccancggngggcccccgttctcggngtnttctaggaagcgcnaacggggagntggtgtttaannccgctccttcgaacg

SEQ ID NO: 97112 - DNA, 515 bp, Triticum aestivum
  unsure (1)..(515): unsure at all n locations
  Clone ID: PAT_TA_97112
gcctccacttccatcgcctccccaagatcgcagatccgctccggtgagaatccgtcgccatgtcttccagcgaggtcgcctgcacccttgccgccctcatcctccacgatgacgggatccccatcacttccgagaagatcgcgacggtggtgaaggctgccggaatcaaggttgaggcctactggcccgcgctcttcgccaagctcctggagaagaggagcgtcgatgacctcatcctttccgtcggatctggtgggaggtggtgctccanctgctgctgctgctgccccggctgctggtggtgctgctgccgctgaagagaagaagggagaaaangaaagaaganggcaaagggaagagaagngatgatgacatggggcttcaagcttgnttcgaacctaaagctgttcaaattccaagttctccctgtgggttcttctaatnccnaaaaancnttgtccttaaggtgcntttaanggtcgaaattttgaaagaatttaattaanggntagggg

SEQ ID NO: 97113 - DNA, 405 bp, Triticum aestivum
  unsure (1)..(405): unsure at all n locations
  Clone ID: PAT_TA_97113
gttaacaccaatccacaatgaagaccttcctcgtctttgccctcctcgctcttgcggcggcaagtgccgttgcgcaaatttcacagcaacaagcaagcaccgccattttcgcagcancancaaccaccattttcacaagcaacancaaccaccattttcgcagcaacaacantcaccattttcgcaacancaacaacaaccaccanttgcgcagcaacaacaaccaccgttttcacaacaaccaccantttcacagcagcatcaaccaccattttcacangcaacancaaccacagttttcacagcaacaanacccaccatattcgcagcaacatcagccaccatattcgcagnagcaagcaaccaccattttcgcagcagcanncaancaccattttgcaggca

SEQ ID NO: 97114 - DNA, 495 bp, Triticum aestivum
  unsure (1)..(495): unsure at all n locations
  Clone ID: PAT_TA_97114
gttcgattttattagttgcatcggacaaatagaacacactatgcggatgccatgaaaaacttttattctatttgtccatcgaccagactggccttgcacggagtgcccaactcaaaagtgaacaatgtaacctgcacagttgtctccttcatgcaacgcgttgccgcaccaacgagtgatggcagcccacctttgtagactgatctgagccaaatctgcggcggtaaacgcattgcaaattgccaggaggttcactgaacgcgtcactacttggcaagcatgcctggcttggttcgaatggccagtgcacaccttttctaatattgaacttacagtgttccatcacctcatctttttcaatggcagcttgagacttacttgcccatgtatggtttgggaaaaaagagaccgtcacaaaaactaggagatnagnacatggcaaaccgctcctagcactagtcatatcaatcnactttgaaagatgcggnccaaatt

SEQ ID NO: 97115 - DNA, 418 bp, Triticum aestivum
  Clone ID: PAT_TA_97115
gtttttttttttttttttttaactagaaaactcaaccatccattatattagggatcatcataaggacccaaaatacataaactcatttaatggtgccagagagtcacgttgtactctatgacatctccactggcagggttcacagagttgagacagtgaacgcacaccgttcggagcatgccgtacccttcggccattcggaacacaccacgacctccgatgacggggagctccctggttgatctcaacgggtttctcgagaacaatacaaacgaagctgccattgaatgggccagttgtgatctcaacatcgatggccatcaaaatcgtgtacccatcttttgctgtgccggacgtacatgccctgtgcattcccaagcaccttagacgtgatcgagggcccctcagtgatcacatt

SEQ ID NO: 97116 - DNA, 496 bp, Triticum aestivum
  unsure (1)..(496): unsure at all n locations
  Clone ID: PAT_TA_97116
gttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggcacagggtacctttttgcagccacaccagatagctcaacttgaggtgatgacttccattgcgctccgttccctaacaaaggatgtgccgtgtcaatgtgccgttgtatagaaacaacactagtgtggcaatccggngttggggncgg

SEQ ID NO: 97117 - DNA, 325 bp, Triticum aestivum
  unsure (1)..(325): unsure at all n locations
  Clone ID: PAT_TA_97117
ctctntctnttacanttntnttcagggggagtggggggggggggngaatantcngntggggnggccttcaactaaaaaatggnngtcctcntctccaccaccgnggnctcggntcccttatcctccgcccgcgttcaacgccgggcgntcaacccgctccgtggcctttcctcnccccggggccgacnaggctggcnctgccgctccnccgcnccgaccatnccccganccggtgccntccgangaagcctgcgtcngcgtcggggtccgcnaccgccaaccaccgtcgttcacgnnacaaagcccgacgcgccggctntcggga

SEQ ID NO: 97118 - DNA, 542 bp, Triticum aestivum
  unsure (1)..(542): unsure at all n locations
  Clone ID: PAT_TA_97118
acctctcgccggagtcccagcaaggagcgagcaagccaggaagatggacgccaagcaagctgaagaaggtggccgggaagaagttcggcgggccgaggaaaaagtcggtgaccaggtccgtcaaggccgggctccagttccccgtcgggcgcatcgggcgctacctcaagaanggccgctacgcccaagcgcgtcggctccgggcgccccccgtctaactcgccgcccgtcctcgagtancctcgccgccgaggtgctggngctgggccgggaacgccgccaaggaaaaaaagannaacccgcatcgttgccanggaacctgttgctggcntnccgcaaacgaacaaggaagctncgggaagggtggctgtccngggggttnaacaatccgccgcaacgggggggggntcattccccaaaaattnaaacccgggttggttggtncccccaannaagaaccggccngangaangggccgagaaannaccnccccccaaantncncccaaanaaagggcnacaaagttcccccccaaagnaang

SEQ ID NO: 97119 - DNA, 524 bp, Triticum aestivum
  unsure (1)..(524): unsure at all n locations
  Clone ID: PAT_TA_97119
aagatctcgagtgangtatgaacgcgccgaagtcgacggagggcgcgtgntttcaacacgggccggcaccggcacatcatgtgcgtattatttactactgccactcgtgttttctaccagcgtccactcggtgcggcgcccacccngcgggcgacggggtgacnacggggcgtgacggcagccaccnagtgtactaccgtagcctctgcctttctacnagnacggagatctccgccatccatcccaagtcgtcccgtcgctcggctaactggccaacttccccccggaaggaggancctcaactccccacccccaagccccagccctcccccgccccggctgcnacagttccaaattncccgcctccnggccggggggaccgaacggagggatgccccgcctncaatggcccaaaggctgggctctttcntccttcctccctccttcctcggggccgggggncnggcccanttctttcaaacgngaaggtnccctggaatnctcggcgggcancgggggttccc

SEQ ID NO: 97120 - DNA, 497 bp, Triticum aestivum
  unsure (1)..(497): unsure at all n locations
  Clone ID: PAT_TA_97120
gcagcctcccctcccccaccctaccccgcagcaatggcgcgcaccaagcanganggcgangaagtcgaccggcggcaaggcgccgaggaagcagctggcgaccaaggccgcccgcaagtcggccccggccaccggtggcgtgaagaagccccaccgcttccgccccggcaccgtggcgctgcgtgagatccgcangtaccanaagagcacggcgttgcttgatccgcaaagctgcccttccagcgggctggtgcgtgagatcgcgcaggacttcanganccgaccttccgcttccaataagctcccgcccgtggtccgccgcctccaangaagggccgcccgaaggncgttacctcgtcnggggcgtcctttcggagggaccaacnaaaaccttctggcgncaattcnaacggccaaagnngccggncaacaatcaatggcccaaagggaanaatccaangcttcngcccgccgggaattcngcgggggangaaggg

SEQ ID NO: 97121 - DNA, 381 bp, Triticum aestivum
  unsure (1)..(381): unsure at all n locations
  Clone ID: PAT_TA_97121
aaatccaccatgaagacctttctcatccntgccctccttgctactggtnncaaccaaccgccacaattgcagttagagttccagtgccacaattgcagccacaaaantccatctcagcaacaaccanaaagagcaagttccattggggncaancaanaagtaatttcnanggggngganccancccatttccaccanaanaaccatatccgcagcccgngnccattttccatcacaananaacatntctgcanctggnnacatttccgnagnccggnacctaacatatccgcaagncggngctatcaatattccgncaggcggnanccattttctcgncacanaaaaccantattcnacaaccgccaacnncaagtntttc

SEQ ID NO: 97122 - DNA, 204 bp, Triticum aestivum
  unsure (1)..(204): unsure at all n locations
  Clone ID: PAT_TA_97122
acagtcccaagatcccaagcccatctccagcctgcccctcccccagtccccaaatccgtantcncgccgcgccgcgatggangcgagcaagctcanggcggnaagnctcctgnangcagatgaagccgccaacttcgccaccgangccggggnaaagtagatcnccnacnatgggtcggttttcgtncaaccaagctcaaacat

SEQ ID NO: 97123 - DNA, 180 bp, Triticum aestivum
  Clone ID: PAT_TA_97123
atacgaatgccaagctagcaacaattatgttctttgtgctcctcggatgccgtgttcatatatttatatgattatatccctagtattttcactagtccaaaaacttgtgtacttcacatctcagaatacacatgagctacgatgatgattcgtttaactaaaaaaaaaaaaaaaaaaaaa

SEQ ID NO: 97124 - DNA, 299 bp, Triticum aestivum
  unsure (1)..(299): unsure at all n locations
  Clone ID: PAT_TA_97124
actaacgatactgatatcttggcagcattccnaagtaangtcctcaggctggggttcccgccccgaaagaagcagggggctgnaagtagcttgccgaaatcttcctactgggtaaaatgggaccaaactggnttnggganctgatggnactntaccaantcttgatccgttacaaagggacnaatgctatcacatcgangcctgttgnctgggggaagacagccaatgggatctgttatgtnggcttanccattaagacctatttganagaggggttccgttacnaaacatgtttactt

SEQ ID NO: 97125 - DNA, 495 bp, Triticum aestivum
  unsure (1)..(495): unsure at all n locations
  Clone ID: PAT_TA_97125
agccataagacgggtatcttcaatattttcaattccaagagaatcagcatgcatcctccttcgacaatacaaatggaatattagcaagttgagtgatgagtggttcgcagatgaagaacgtgtccgtcattttgttggcttgcctacaaatggggctgttcttcctgactgccaggagctaacttgtggaatatgttttgaaggatattccacaactgcactgagctctgctggttgtgttcacctctactgccatgaatgttgggaagggtatattacgtgcttcaataaatgatggtccaggatgtttgtcactgcggtgccctgaagccatcttgtactgccatggttcttgaagaaaccattaatagattggctaaagatgaggagaaagtgaacgtacaaacaatttttatcatgctcatacctttgnagatnacaanaaggataaaatgggggtccnagcccctgaantgtaccccgcnctntggggtg

SEQ ID NO: 97126 - DNA, 500 bp, Triticum aestivum
  unsure (1)..(500): unsure at all n locations
  Clone ID: PAT_TA_97126
gccctttcttgcactgatccagcgagcgagcgagaggacagatggcactgtcgcctctgaatctgaaggtcgccgccgggccgctcatatggttcgtgctcgcgcaggggctcttcgtcgggctgatcgtccgcggggtggagctcgcgccgccgccgccggccaacgcgacgctgcccctcgcccgttgtgcagccgggccctgccaccgccagatgatggacgccatgcacgcgttctcgctgctcgccgtgggggcatcggcctacgtcgccctcgccgtcaagattcaccgcagtgaccggccgaccgcggggatctgcatccgcgcccccatgctgctcgccgtccgcgctgtcgctggcgggcaacgtcctccaanacggcgaagctcttctancctgcaagcangtgaaagctgggccgncnactactcctgcttcccccggtcccaacaaaagggtgcntgtggggcctacncgctgatggggctnattncc

SEQ ID NO: 97127 - DNA, 424 bp, Triticum aestivum
  unsure (1)..(424): unsure at all n locations
  Clone ID: PAT_TA_97127
ggttgcttattcgagagacatggacgtccataaggtcaagaggtcgggcttgtgcttgttgttgctcatggcattcctgttgcttcctgcagggtctgaaggtgaaggtgaaggtgggacttgcacaacgttcagcaagacctactcccaccctttttgtgtgcctttaccttgccacaggggcggagccagaaaatttagtcgatgggttcattcattatcttattgtgaggatttggtctaattaattcaatgtaaagtccaattttcacaccaccttacatcaaatatatagtaagtccccttcaaggaagaacaaaaaaatatagcactaaaaatacattanagagagaaacataatttcacttgtgttatttcaagagtgcaaaagcccaaaaatattaccatttgnnatttcaataac

SEQ ID NO: 97128 - DNA, 509 bp, Triticum aestivum
  unsure (1)..(509): unsure at all n locations
  Clone ID: PAT_TA_97128
catatacgccctcaccggcgcgctgccgcgcagccgccctcgccaccgcccacccgtagtgcagaatcagctcaactgctacttcccggcgcgcggttatcggagatcaacgcggagtcctaccgggtgccggatgatcactgagtctctcaactcaccaagcatcgtcgcccaacagtaagcaagcaaagtgaattcaccgatcacaattcacattcaattcgttgcttccattgtgagctacataatccatggattaattggtcacatagagtaagagttggtatgtatgaatcncatcaacagactcgttgtaagcaacaaggtgatcgacttgtcaagttggttttcttattttaaggttgtangtaagtgatattctgtttcaaangtaccaagtaaggtaatatcctgttctgtaagtagcaccaatggncgggntcggtaacnttgggtatcatcangaanctgggganttccccnctcaaaggtacaaggcccaacaagnn

SEQ ID NO: 97129 - DNA, 225 bp, Triticum aestivum
  unsure (1)..(225): unsure at all n locations
  Clone ID: PAT_TA_97129
ntaagccaacaccancacttccngccgtttgncgtcgcacgtcncgggtnggcggccgtgctagtcctgctctcaccgcngtctgccgncgacncanacgacgagctgtgnctggcgatcctccagtagtccctcctccctncggangctggaacganggtccttcttcaccgnccccctgtggangggnttcatctccangntccaggggngtcaccntggcaa

SEQ ID NO: 97130 - DNA, 514 bp, Triticum aestivum
  unsure (1)..(514): unsure at all n locations
  Clone ID: PAT_TA_97130
ctgaggtcaagtctgttgagatgcaccacgagtctctcctggaggcgcttcctggtgacaacgtcggcttcaacgtcaagaacgttgccgtgaaggatctgaagcgtggttttgttgcatccaactccaaggatgaccctgccaaggaggcagccaacttcacctcccaggtcatcatcatgaaccaccctggtcagattggcaacggctacgccccagtgctggactgccacacctcgcacattgctgtcaagtttgctgagctggtgaccaagattgacaaggcgatctggtaaggagatagaggccgcgcccaagttcctcaagaatggtgatgctggcatagtgaaaatgattcccaccaaagcccatgggttgtggagaactttgccacttaccccgcctccttgggtcngttttgctgtcccgttgacatgaaggnanactntggctgntggtggtcatcaaaggcgtccgagaaanaaggacccaanccgggggcaaaggtgaccaa

SEQ ID NO: 97131 - DNA, 422 bp, Triticum aestivum
  unsure (1)..(422): unsure at all n locations
  Clone ID: PAT_TA_97131
ccgctcccggggatcctcgccgtctcccancaaatcgcctcgcctctcctctcctctcctccagatctccgcccggcgacgcggaggccccagtccggcgccattcggccggagccaccccgctccgggctcagtctgccggcggtgatgccgcggacagcggggctcctcctcctgctcgccttctcgggcgccgccgtcgcagcagcagccgaggatagtaccgctggtatcctaccagcaggaggaaacaatggtaccggtataaaggatncangtgttgggaggacanggcaaaatggcgaggcagatnctaccacgcaacagaaagtacaattaggngggggagctcaaagaaantcatttccgagaacactaacacggggtaattccatgggagggancaancaccgggaaaaatg

SEQ ID NO: 97132 - DNA, 504 bp, Triticum aestivum
  unsure (1)..(504): unsure at all n locations
  Clone ID: PAT_TA_97132
cctcctcctagcaagctatatacctacatagtacaagccatggcccccaccgtgatggcctcgtcggccacctccgtcgctcctttccaggggctcaagtccaccgccggcctccccgtcagccgccgctccaacggngctaagcctcggcagcgtcagcaaacggtggaaggatcaggtgcatgcaggtgtggcccatcnagggcatcaagaagttcgagaccctgtcttacctgccaccgctcancacggaggccctcctcaagcaggtggactacctgatccngctccangtgggtgccttgccttgagttcagcaangtcgggttcatcttccgtgagcacaatgccgtctcccgggtactacgacgggcgctactggacaaatgtggaaagctgnctatgttcgggtgcaccgacgccacacaggtgatcaaacnaggtgggaggaggtcaaaaaaggagtaccctgacncgtaacgtccgcatcaatcgggatttctg

SEQ ID NO: 97133 - DNA, 308 bp, Triticum aestivum
  unsure (1)..(308): unsure at all n locations
  Clone ID: PAT_TA_97133
cttgatcaaattcactaaaaaataccatgcaccaaatcactatgtatattatacaaggtcaaggctgattcgagtaaggctgttaccgagtagtatgacaattatcaccatttgcaaacactacaagcgagtgatagtgttacttgtaggagcccaattgtgagaccttttcaggtaactaaatgtatatgtgtgcagtaattcgcacaagaacatatcatcactctatatgcaatatgatttcagagtgaaagatatgattatttcctattggacgaacgtggtttcaactccacaatngggggggg

SEQ ID NO: 97134 - DNA, 503 bp, Triticum aestivum
  unsure (1)..(503): unsure at all n locations
  Clone ID: PAT_TA_97134
ccacaacaaccattcccccagcctcaacaaccccaacaaccatttccccagtcacagcaaccacaacaaccttttccccagccccaacaacaatttccgcagccccaacaaccacaacaatcattcccccaacaacaacaatggatgattcagtcatttctacaacaacagatgaacccctgcaagaatttcctcttgcagcaatgcaaccctgtgtcattggtgtcatctctcgtgtcaataatcttgccacgaagtgattgncaagctgatgcaagcaacaatgttgccaacgactagcacaaattcctcaacaagctccaagtgcgcaggcatccacaacgtcgcgcattccatcatcatgcaagcaaggaacaacaacgagggcgtgcagatnctgcggccactatttcagctcgcccagggtctggggtatcatccaacctcaacaaccagctcaanttggagggggatcaggtcantggtattgaaaactcctccaa

SEQ ID NO: 97135 - DNA, 347 bp, Triticum aestivum
  unsure (1)..(347): unsure at all n locations
  Clone ID: PAT_TA_97135
nccatctccgnctctttccatctgccccgcctcctccgngcgattgggtttccttccttgggcttccgcntcncttcgnccgatttcngtnggttttgaactctctgcgctgcgccgggcctgtaggataaggtcaaggagcatgcggtngccacggtngcggctgcggcggatgangacgaagatnccgccgggagngnggacggagacgangtgncgatggancccgtgnagcccatgccggnaccncccgacgacnccngacccntctgctggaccatgncggacttctgccctctcacnatcnacgggacagtgaaggagtccttnctgnagacctttcggaa

SEQ ID NO: 97136 - DNA, 499 bp, Triticum aestivum
  unsure (1)..(499): unsure at all n locations
  Clone ID: PAT_TA_97136
gagcaatcctctctccgcgcccacgcagcaagccctccactcccgatggcccgcacgaagcagacggcgaggaagtccaccggcggcaaggcgccgcgcaagcagctggccaccaaggcggctcgcaagtccgccccggccaccggcggcgtgaagaagccgcaccgcttccgccccggcaccgtcgcgctccgggagatccgcaagtaccagaagagcaccgagctgctcatccgcaagctgcccttccaagcgcctggtgcgggagatcgcgcaggacttcaagaccgacctccgcttccagaagctccgccgtctccgcgctgcangaggncgccgaggcctacctcgtcgggctcttcgaggacaccaacctctgcgccatccacgccaaagcgcgtcaccatcatgcccaagggacatccaagctcgcccgcccgcatccgtggggagaggggctantatgcttcctanaaatcctagngttcngatctgttct

SEQ ID NO: 97137 - DNA, 515 bp, Triticum aestivum
  unsure (1)..(515): unsure at all n locations
  Clone ID: PAT_TA_97137
gncacaaccatttcgaccacaacaaccatatccacaaccgcanccncagtattcgcaactacaacaaccaatttcacagcagcaggagcagcagcaacaacaacaacaacaacaacaacaacaacaacagcaacaacancaacaacaacaacaacaacanncagcancaacancancaacaacaagnncaacaaatccttcaacannttttgcaacaacaactaattccatgcatggatgttgtattacagcancacaacatagcgcatgggagatcacaagttttgcaacaaagtacttaccagctgttgcaaaganttgtgttgtcngcacctatnggcangattcctgagcagtccgcagtgcccaggcccatccaacantgttgttcatgctattatcctgcntcaacaaccaangncanccagcancaaacaaccatcggagccagggtctccttccaanaggctcancaacaaatntccaattagggcccaggggcgtcccntccnggg

SEQ ID NO: 97138 - DNA, 505 bp, Triticum aestivum
  unsure (1)..(505): unsure at all n locations
  Clone ID: PAT_TA_97138
gccgccgcccaacccaaaccgcacaccgccgccgccctcgccgccgcagcgcgcggaggcgaccaccccaccgccgccaagatgcagatcttcgtgaagaccctgacgggcaagaccatcacgctggaggtggagtcgtcggacaccatcgacaacgtgaaggccaagatccaggacaaggaggggatcccgccggaccagcagcgcctcatcttcgccggcaagcagctcgaggacggccgcaccctcgccgactacaacatccagaaggagtccaccctgcacctggtgctccgcctccgcggtggcgccaagaagcgcaagaagaagacgtacaccaagcccaagaagcaaaagcacaagcacaaagaaggtgaaagctcgccgtcctccaattctacaaaggtcgacgacccaccgggcaaggtcaccaagctcaaggaaggagttgccccaacgccgagtggcggcgccnggaccttcatgggcaaacacttccaaccgc

SEQ ID NO: 97139 - DNA, 513 bp, Triticum aestivum
  unsure (1)..(513): unsure at all n locations
  Clone ID: PAT_TA_97139
cctcctccgccttcgccatctccaccaccaccattaccatcaccacccccaccttcacctccaccggcatccccgcctccancatcacctccgccgccagtccaccactcaccaccgccgccaaagccagtccactcaccgccgccgccaaagccagtccactcaccgccgccgncaaaggccaagttcactcaccaccgccgccaaagccagtccaccactcaccggcgccgccaaagccagtccaacactcaccancgccgncaaaggcagtccancancaaaccaccgcctcctcctgccccgcatccgcatccaaatgtgnccccccgccgccngccctgtgctgtccgccaccagcaattgncaaccgccgcaacctatttacccgggaaaattgccaacntgtgtccgtgcanaatatggnttaacaaccaccggcgacctaattnncccaaaccaattgtnacccgtccccnnggnaaggatatggnttatccggccaacggcctt

SEQ ID NO: 97140 - DNA, 496 bp, Triticum aestivum
  unsure (1)..(496): unsure at all n locations
  Clone ID: PAT_TA_97140
acttgaggtcgagtcctcggacacaattgacaatgtgaaggctaagatccaggacaaggaaggcatccctccggaccagcaacgtctcatctttgctggcaagcagctggaggatggccgcaccctggctgactacaacatccagaaggagtccaccctccacctggtgctccgccttcgtgggggcatgcaaatctttgtcaagaccctcaccggcaagaccatcaccctggaggttgagtcctctgacaccatcgacaatgtgaaggcgaaaatccaaggacaaggagggcattcccccggaccaacagcgcctgatcttcgctggtaagcagcttgaggatggccgcaccctggcgggctataacatccagaaggagtccacccttcacttggtgctccgtctccgtggtgggcantaagtgcctggcaatggagcggcntctctgtgggttgggttcacaagtcttgtgtccttgatatgtcccccaatggg

SEQ ID NO: 97141 - DNA, 494 bp, Triticum aestivum
  unsure (1)..(494): unsure at all n locations
  Clone ID: PAT_TA_97141
tgctgggctcnacaangggatcnttccactccggggncgccanattccttacaccaagaagaagtttgccccctttgagaacantgttgagcttatctaaaagcacgctgttcctgttcccaagggcgagtgcagcaagtcttcccaattgggtaacaactttgctgggggntaaattgccgggtgtcntctgtggctattgtttctcancccnctgaaaaactgggtctctttcctcaaaaaatgccaaggggtgctacantgggtgatgctgttaaacaaaaatgggatgttgggccttttcacaaagaanggctaccccttccgtatcgtcaagattggtactcctaacgggtnctcaagtgggggaatctaangacgccgttcaaagggtcatgggtgggactccccnaccaacgggngggggctccaaccaatttgctcccnggtagaaggaagcaaccnaaaagccaaccgctttgnnttgatttttn

SEQ ID NO: 97142 - DNA, 507 bp, Triticum aestivum
  unsure (1)..(507): unsure at all n locations
  Clone ID: PAT_TA_97142
cccaaaccctgaaaaggtcacgccgcagctgcgactccggncgccggnctcccctcctatatggaacctcagcaagagtcgaccgccggcggccgcaagaggcggcgtataggaggagtcgggaaacgccagaaggattattcttcctcacaacaggnacctccgcctgcccctccagcggatgcggcctcccccctggagaagcggcgacgcaaggccggcgaggccgccgcaatacccaaggggcgcaagcctacgaagcctactcgaaaagatgcgtgcaaggttatctggaggtcatttcaaaatgttaaatgagaaactgtacacttgcaagtgggcaangatgcatttgactactttaaaaacgaagcctgaggcttttttgacgtgtatcatgcaaggatatcaagagcaaatgtcacatttggccggngcangcaagtttaatgtgataatcaaagtgggttgnagaagtcataacaaatcatngggccgtttgctgat

SEQ ID NO: 97143 - DNA, 487 bp, Triticum aestivum
  unsure (1)..(487): unsure at all n locations
  Clone ID: PAT_TA_97143
cactcctccaaatctaccctccccgagcgtcnccggcgtcctccctccaccagcgcccccccgccgatctccggccggcccaatcccccccgcggccgccatgaatccctacgccgacaaccgctacgccgacccctcctcctaccgcgacaggcgcagcgacctggccgcggcccctatactcgcccctccggtccccgtggcccccgcccagaacccctacgccgccccgtacacgcccatggccgcccccgtcggtggcttcggccaaggcggcgggaggctacggcggtggcatgggatacggcgggtanaaggcaaaangcggcggcnggcggcngccggttggaccaangtggcttcccgtnggnggcggtgggaaaanggnggnagcantngggaggggacggggctcgacctcgctctcccctggcccaaaggggggactttccgggggccttatanccgtttcgagaaagaagttttg

SEQ ID NO: 97144 - DNA, 464 bp, Triticum aestivum
  unsure (1)..(464): unsure at all n locations
  Clone ID: PAT_TA_97144
attagagccatgggacgccgaacacacgccgtgccggcggccgcggcggcagcgctgctgctcgccttcctccatcttcacgtggccgcggccgccgacccgcccttctcctgcggcgcggcctcggccgcgccgtactgcgaccggaagctgccgatcgagcagcgggcggcggacctggtgtcgaagctgtcgctggaggagaagatctcgcagctgggcgacgagtcgccggcggtggcccggctgggcgtgccggcgtacaantggtggtcggaggcgctgcacggggtggcgtggagcaagggcatgcacctggacggnccgctccgcgccgccaccanattcccgcaggtcatcctcaccgccggcgtccttcaacccgcacctctggtaccgcatcggccaaatgatnngcacggaggcgcggggcgtgtacaacaacnggcaagcggagggggtgn

SEQ ID NO: 97145 - DNA, 185 bp, Triticum aestivum
  unsure (1)..(185): unsure at all n locations
  Clone ID: PAT_TA_97145
cctcaccctcgcctcgcctttttagagagagaaacacgagctccccacaaccccatcnccacncgcanncccaccgaggtantagagaganaaaccagccncanactttcccccancctgnaccgagtagaggaggagcgaggncatntcncaggcccgtncccgtngaggctntccnnacacac

SEQ ID NO: 97146 - DNA, 382 bp, Triticum aestivum
  unsure (1)..(382): unsure at all n locations
  Clone ID: PAT_TA_97146
cccacccacccacatcaccaccgccgaaaaagaagatnccgggcaagcggcgaccgagcaaggatgccgtctgcgcggccggcggcgttactcgtcncggccgtgttcctgtggtggtcnggggccggcgcgctggcgggacggcgggcaacggcacgggtgtgccctgttcaacgggccccgcaattgcttgccgcccctgnccccntcccggggacgaanccccgnccgaacaangttcnccaattgcaaatttccccctttctgcccccaaaacgggcccgcccggggggttccgggncccttcccgtttgggaannaanaaaccnccccggngttccccccaaggtnccggggtncnggggnttccccccaaaggaac

SEQ ID NO: 97147 - DNA, 481 bp, Triticum aestivum
  unsure (1)..(481): unsure at all n locations
  Clone ID: PAT_TA_97147
gnaagttccattggatgcaacaacaacaacaatttccaggggagcaagaacaatttccaccacaacagccatatccgcatcaagcaaccatttccatcacaacaaccatatccgcagccgcaaccatttccgccacaactaccatatccgcagncgcaaccaacaaccacaacaaccatttccccagcaaccacaacaacaatttccccagccccaacaancacaacaaccatttccccagccccaacaaccccaactaccatttccgcaacaaccacaacaaccattcccccagcctcaacaaccccaacaaccatttccccaagttacagcaaccacaacaacctttaccccaggcccaacaancggnaacaaccattccccaagnaanaacaaacattggnttcagccatacctacancaacaagntgaancccctggaagaanttnctccntgnagnaatggcaaccctggtgttnt

SEQ ID NO: 97148 - DNA, 335 bp, Triticum aestivum
  unsure (1)..(335): unsure at all n locations
  Clone ID: PAT_TA_97148
cagatctggagnaaagactgcngttacctcangccatncnagaggtaaaagaggtgatcctctttaatactgttgccaatgattcatctgtggagacaatggatattgttcatgaanagaanctagtaacttcatctgaaaagaggaaacttggngaccaanaagttgttgcggatgagcccatcanacgtcagcgccatgtggatactctcaaaattcctaagcaacaaacatcaaaactaaggtagctctgattctccaaaggttgtggttcggccngctcnaaaacattttgttggnaaggtcngattcaacagcaaagtgggaggttctca

SEQ ID NO: 97149 - DNA, 594 bp, Triticum aestivum
  unsure (1)..(594): unsure at all n locations
  Clone ID: PAT_TA_97149
agtggctcctcttcctcctcgctctctcgcgcaagggggttcncgttccgaaaaccctaaacctccaacaatgggcgggctgaaanggcnggtgggcgttccgggccctttcccaaaccgcgaagcaagggacatnccaanattgattcctccgcccggccgaacgttccaacctcgggcaaccaaagaaactggcgaactttcaanaattggagcgctnacgttctaaaaaaacncccgcacttgaaccgggnattttnaaatcaatcaaacctttgggnaaaanacctggggaanaaaacttnaaaatggggccgccaaangggtcatttgtttgccaattngaaaaaaccctcnaagataatcaattggtggcaaatcctggccnnaggccctaattggacaanaggggcttgtccctcaaangttttngccccaattacnacttgggtggctnaacgccaatttgctgggaagggcacactccctgggtaacntttcacccaaaaccaagaatgccanaaccttcnattnanattgaggcccccccnntctttatccctgaaccngaacccaangaacttgatttaccaa

SEQ ID NO: 97150 - DNA, 343 bp, Triticum aestivum
  unsure (1)..(343): unsure at all n locations
  Clone ID: PAT_TA_97150
ccaaccgaattcctcgcgattcctctcccctccgcctcctcgtcctcccccctcctaanggggatcgccgganaaggaatcgcgacgaagggcttcctcctatcagtttaaatcaaaggccaatggggcnnaaaggagaaccggcttgccaagtcncnggaaagggtccccaatccntttgcgttcaataactgcgggattctttgggcaatngnngggcaacnatnaaaanatgttgcnccaagtngccaaanaaggggaaatgggncgaattnaacccaagggncnaaggcccaagcntgggtngcccccccccttttcaaaaagnaatcntncaaagggg

SEQ ID NO: 97151 - DNA, 167 bp, Triticum aestivum
  Clone ID: PAT_TA_97151
ctccacaccactgatcactattgacgagatggaggcagcggcaccaaggtcctcgtcaactagctactagatcgtccggtcgtccgttgatcgatctcccatggaggcgagcaagggaggcgacgggagctcgggcgcctcggcgagcaacgatgacagcacggggg

SEQ ID NO: 97152 - DNA, 500 bp, Triticum aestivum
  unsure (1)..(500): unsure at all n locations
  Clone ID: PAT_TA_97152
atnaccaaccaaatcccctcccctcctctcccgcgggacgacgagcaccanccaccggacatggacgcctcanccaccggagccggagcgaaggcgaanaanggcgcggccgggcgcaagggcggcgggcccangaaaaagtcggtgacgaagtccgtcaagggcgggctccantttcctgtcgggcgcatcgggcgctacctcaagaanggccngtacgccaagcgcgtcggaacgggcgccccgtttactcgcgncgttctccnagtactccccgccggagcttgctgggagctcncccgggaaccccncccaaaggacaaaaaanaaattcccgcaatcttgcccaaggcaaccttgctggttnccccgttaagggaatgaaccaaaaaaacttcgggaaggnttgctggcccgncgtttacaatcccccncggggggggggttgttgcccaaaaattaaanccngtngttgntggccaaaaaangaacggnggggn

SEQ ID NO: 97153 - DNA, 473 bp, Triticum aestivum
  unsure (1)..(473): unsure at all n locations
  Clone ID: PAT_TA_97153
gataaagctcccctgtcgctcccgcgggcgggtcgggagctaaacctaaccgccgccgcgagcancccaaccaacgtctcttccaacactcgccgccgccggtggcantcgccgggcaaagcccgtgcggctcggcggcggcggggcctttctcctcctccgtccgtggctggctggcgcgggccggttgcttcggcggatgctcgggcancaacgcacgtccggggcgattcttctggctggcgangctgcgcacgangatgtgggtgaacgaagcgcgcgtaagaggcgcgctggattgcaaatctggtgcatccaagggcgcgcggtgctgcattgtgaacgcgttcggttccgggccccggattgtggcggcggctcaacgaagcaacggcggtcccccgttggtggggctcaaagccaaaagcttggcttggtcccttgggcgtccgcccctggtggtggcgcaactt

SEQ ID NO: 97154 - DNA, 275 bp, Triticum aestivum
  unsure (1)..(275): unsure at all n locations
  Clone ID: PAT_TA_97154
gcgtgagaaataagcggtgcttgcccagtagagagagagagagagagaganaganagatggcggcgtcngcggngacggngacggcgacggcgacggcggcggcggtaggggcggnggaggtgatctccgtccacancctgnancagtngcncatgcaagatcgaggaggccaaccgccgccaanaagctggtngtgattgacttcacngcatcatgntgcggaccatgccgcattanggctccaatttttgntgatctcnccacnaagttccca

SEQ ID NO: 97155 - DNA, 468 bp, Triticum aestivum
  unsure (1)..(468): unsure at all n locations
  Clone ID: PAT_TA_97155
ggaacagcagacagtaagcttcccgaagcctgctgcggtggaggaacagcagtcagtaagcttcccgaagcctgctccggtggagaaacagcagactgtaagatccccgaagcctgctccgatgaagaaagagcagacagtaagctccctgaagtctgctttggtgaagaaagaacagacagtaagctccctgaagcctgctttggtgaagaaagagcagacagcaagcttcctgaagcctgctccggcggagaaccagcagacagcaagctccccgaagcctgctccggtggagaaagagcanacagtaagctccccgaagcctgctccggtggngaaagagcagacaagtaagctccctgaagcctgctttggtgaagaaagaacagacagtaagctccctgaagcctgctttggtgaagaaagagcagacagcaaagctccctgaagcctgctccggnggagaaa

SEQ ID NO: 97156 - DNA, 348 bp, Triticum aestivum
  unsure (1)..(348): unsure at all n locations
  Clone ID: PAT_TA_97156
gcancatccagcagcaggtggnaagcgagctcactcgatcggcgctcgccatggccgcgtccaccgccgcccgacgcttcctcctcctcctcgccggagtgaccgtcgtctccgtgggccgccgcggcgccgggtgccggcgccacccccgccgttcccggaacgggtgttacagccgttcggggactcgttcacggganacggggcaaanacgccactccaancaccgggtccttacctcntaccgggttaacggtctccaaacccgnccctaacnggggccaacctttctttccaccggcgtccaancaaaacccggctaactcccggantggggtcgccctcggt

SEQ ID NO: 97157 - DNA, 452 bp, Triticum aestivum
  unsure (1)..(452): unsure at all n locations
  Clone ID: PAT_TA_97157
gagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccanggagtgcctgcctctgatcctcatcctgaggaacanactgaaatatgccctcacctaccgtgaagtgcaatctatccttangnagcgtcatatcatgggtgatggnaagggccccactgacaatacctaccctgctgggttcaaggacatcatttccattcccaagactggtnngaactacaggcntctttatgacaccaaaggggtggtttcgcctttcannctgtncagggaangaaggtgctaaattcaaanctctgcaaagggcangtcttgtccnattntgncaaaaaagggcaacc

SEQ ID NO: 97158 - DNA, 387 bp, Triticum aestivum
  unsure (1)..(387): unsure at all n locations
  Clone ID: PAT_TA_97158
ccacttctcccctctctctctctctcccccanctcctgctagaaaggttttctttccccaaagtccggccaaccaagatgcanggcgccnccgccgaggggaggagcaaggcttcgccggaccaaagccgacgaggagancgccaagaaaccgcgcctggacatgccngacgcccgcgtgaagcaagagntcatcgccggaggangggaaggganccncatcatcnncgaggcggcggaggggcngtntattcctncanagganctcnncgtgaggattganaagcganctgcttatcgatcaccnctgcagcatccctcttcanncnccccgtcttncactgnaaaanccngggcaagcttgccctccggcgtntgcgtcccccca

SEQ ID NO: 97159 - DNA, 490 bp, Triticum aestivum
  unsure (1)..(490): unsure at all n locations
  Clone ID: PAT_TA_97159
ncgccgccgccgcacanccgcangtagagaangcaaggaggaanggaanatgccggcggggcacgggctgcggtcgcggacgcgcgacctgttcgcgcggcccttccgcaagaaggggtanatcccgctcaccacctacctgcgcacctacaaggtcggcgagcatgtccacgtcaaggtgaacggcgccgtccacaagggtatgccgcacaagttttaccacggncgcaccggtcgcgtctggaacgtcaccaagcccgccatcggcgtcgagatnaacaagcangttggnaacaaggatnatcaaaaaagaggattcatgtttcgttgttggagcacgttgcaaccatccaaggttgcaacgagggagtttctccaanagggaagctcaaacaacnacaaanctnnaaaggggggnnggccaaaggtngccttgnttgaaggtcatcaancacccaaanaagggaagcccaacnagggccccaaancc

SEQ ID NO: 97160 - DNA, 453 bp, Triticum aestivum
  unsure (1)..(453): unsure at all n locations
  Clone ID: PAT_TA_97160
gagcactgcggccatggccgccgccgccgaggttgggccgatgatggcgacggttgccctggagtgcggcggcgacatctcggcgtcccaggaggacaccctcgccaactcctccttcctcggcgccggcaacgccccctccgcctcgcaggcgcggggggccgaggacgacgccgaggaggtcttcgccacccctcccgagctcccccaacaagaccccatcaccatgtgcagcctccccttcacccccagtcccgctcagccccagtcgccctcgccacctccctccgacgacgacgacgccgccaaacctcgccggaagcctagggtttgcaccaggaaggtcaggggcgccaagttcaagcaccccagccccggaccccgagccccaagcaagcaagcagcagcaagccaagagcaaccgccccgttgccgtcgtcgatcctctctana

SEQ ID NO: 97161 - DNA, 462 bp, Triticum aestivum
  Clone ID: PAT_TA_97161
tcgactcttgatgctcctcggtgctgcagaagtctgcccttttcttgctagctcatctgggtagatcaacatcgtcagatgtgtggaattgtagaccaattgacgataatacaactagtgcatgcaaatccacatgcacgcgatgaatttcaaggatggagtttctctgctgcaagccgccgcccccatggatccagacgcactggtgtgatccaccctcaagatgagaagcacatgcctcgggacagcgccgctaccatgcagcctcgatgcgcccaaccccgagcaccaccatcacgaccctgctgcccagaagcaacgacgccgcagactctgggcgacttcccccgcctcactaaattccacctctaaatggtgggaggcgcatcatgtcgtctccaatatcagattggtatctcttgcaatctctttttcaatattgacatcaaaagtcatcctcgg

SEQ ID NO: 97162 - DNA, 438 bp, Triticum aestivum
  unsure (1)..(438): unsure at all n locations
  Clone ID: PAT_TA_97162
tccacctttgctccggatcgtaagcccgagctcgggctctcctccgtagctgcctccttgcctggagtgctgggttcggtgcggggtacgtacgaggatcatgagcaactcgtcgtggacggcgccggggtcgtcggcgctggagacggtggagaccaagatcagcccgagcatcctcttcatcgtggccgtgctggcgatcgtcttcttcgtctgcggcctgctgcacctgctggcgcgccacctgctgcggntgcgccgccggcgccgggcggcccgcgacgacgccgagggcagcgtcaccgcgttccagggccaagctgcaagcagctcntccacctccacgacgccggcgtcgaacaaggccttcatngacgcgctccccgtcttcctctaccgcaacgtnctcctcngcggggancggggattggggccggg

SEQ ID NO: 97163 - DNA, 510 bp, Triticum aestivum
  unsure (1)..(510): unsure at all n locations
  Clone ID: PAT_TA_97163
ccttaccactgagtccgtcgtcgcgagccccgacgcggagggcggcgccgccgccacacaggcggacgatgaggcggagagtggggcgcccggctccccttccccgccccgaccgccgcctagcatctccgggcgccgcgatcctctcagggccgcgtgcttccggaggctggctgcctcctgcgaagcccgccgactccgcgaggcggagctcctccgtgcgtctaaaccgcccgcggagaaggccgaggaccccgaggagccaatctggccaccaaaaagccgccattggtggcgcttcgtggaactaaaaactatggggtccaacccggccaatcctgtgcccaaccctgatgaagagttcattatctcatatcaaagaagccaagatatgtttagnctgacaanggtttgtgggaccaatgggattgacaagttgacactgaaaaactcctctgggaaagtgcatcatatcaagtttgttcccttacaanaaatnccaangggaan

SEQ ID NO: 97164 - DNA, 460 bp, Triticum aestivum
  unsure (1)..(460): unsure at all n locations
  Clone ID: PAT_TA_97164
gtggtctctgacaagctgtaacaacattcgacgatggtgatttcgagccgaacatgctgttatctccttttttccgggttttacagaanatgtgcanaggcnaganggatctanctatgtctggatcctatctcggctgcagtagctccttttcccggcgaggtggccggcggcgagctgagaggcggtcagatggggagaccggcggcgcggtctcanaagatgtcgaggacgtcgaggatggcggcgttgcagaagcgggcagcggccgcggccggcgaggagctcgcgggcgcaggcgcggcanaaggtgtggccgcacgggatgaaaggccgcgccccttggtcccgccgccatgcaacacgcaagcancnagcccggcgcctccgccccggntccggcagctccgcgtccgtcctcccggnaccaggcgcgtcctgngacgacgggctcccgacg

SEQ ID NO: 97165 - DNA, 488 bp, Triticum aestivum
  unsure (1)..(488): unsure at all n locations
  Clone ID: PAT_TA_97165
gctgattcagctacctcgtagcagatctagtccagaatgtgatcaggacatccttaatgtatttgagagatctctgaatgagcaagttcgttcaaatgagctcaaagaacttgaaatagggcttaatatgaggaagttgcaactaaagcaatctcatttagctctcagctcctactcacacatgttagagaagatcaagatctctatgggatttcagaaagctgctttcagagaggagaaattaaagactcaaatgcaggacacgagacatgctgaactcctcaagaggcttatagatatgcttctgacagcagtagtttttatgtctgcctgtttcggatatggnacatatatttattcgtaccagcggataaccgctgttactgcagcctgtgcagctgcttcaagggagtccaaatcttgggggggttccaaactctggtatcaactttcaactcaaggattgctgtttttcaaatgtcaattng

SEQ ID NO: 97166 - DNA, 323 bp, Triticum aestivum
  unsure (1)..(323): unsure at all n locations
  Clone ID: PAT_TA_97166
tcatggcctcctccgcgctcaacttcngcacccgggccacngtcacggatccgggcgcggngatcgacgccgctgatnccgtcncaagtnaangnatactacaccgtcganctccggtccgtcaaggtcgggtacaacaccttcgnggcgncggatcagtctccccggtcatncgtcnacccccggcacgacnctcacatacntcgcggaggcgcatnttaanaccccacttgcttgancaggagctgnacaactngcggaattaaagtttcncggcctggccccagttcnccnaacaataaagtttcctngccgcctgngtc

SEQ ID NO: 97167 - DNA, 227 bp, Triticum aestivum
  unsure (1)..(227): unsure at all n locations
  Clone ID: PAT_TA_97167
agcagcaatcccaacaatcanaacaaccttttcccgggccccaacaattatttcctgaantccaacaaccantttccccagcaatcacaananccattccccctgcaagcgcaacaancattcccccagcaantcgcaacanccattcccccagcaagcanancaaccattccccctgcnaccgcaacaaccattcccccanacanccacaacnaaccattccccca

SEQ ID NO: 97168 - DNA, 493 bp, Triticum aestivum
  unsure (1)..(493): unsure at all n locations
  Clone ID: PAT_TA_97168
gccgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaanaacatgattaccgggacctcccangctgattgtgctgtgcttatcaantgactccancactggtgggtttgtngntgggtatncccaaaggatgggcaaaacccttgagcaacc

SEQ ID NO: 97169 - DNA, 516 bp, Triticum aestivum
  unsure (1)..(516): unsure at all n locations
  Clone ID: PAT_TA_97169
cggcgatggaggtggaggcgatgagcagcgcgctcgcggggttgaagatccacagcagtgacggcgtgggttgccgtaatcgtgggagggagaacgtcggcggggcgaagacgacgaggccgctccgcctcaagatcaagtccctgacgaggaagagccgaatccgtcgcgatgagaatcggccgcctactccaacccgggacgagcgatgggccgaggaaccggagaatctgccggaggtcaaggaggaggacgccatcgccagggagccgtcgaatctgggataagcgttgggccggccgttacggtgccttcnagggatgaaacgagtatcggtcccatgcgctacacatccaaaaccgcctaccccaagaatacctattcacagaaacagancgtgcnagattttctccatccagggtcaggggccccaaacaanatggtctcaaattggccgctgccgtgttcaatgggccaaaattgccaaccanaagactcnnattggatnaagaatcc

SEQ ID NO: 97170 - DNA, 172 bp, Triticum aestivum
  unsure (1)..(172): unsure at all n locations
  Clone ID: PAT_TA_97170
ctagtactaagatatatgaaacactgttttcttagtccatggtttggtcattgtagcggtgagaaaataaagtgacatgcactatcatgtaagaacccgaactatactagttcaaacttgggaataaaagacaaacacaggtcttgtctacannaaaaaaaaaaaanaaaaa

SEQ ID NO: 97171 - DNA, 533 bp, Triticum aestivum
  unsure (1)..(533): unsure at all n locations
  Clone ID: PAT_TA_97171
ttttagcctccagcgccgccgccgccgcccagcgaattcgacaagcccccgagctcgccggatccgatggccgtcacgttctccgacctccacaccgccgacgggctcaaggccctcgaggcgcacctcgccggcaagacctacatctccggcgatgggatcaccaaggacgacgtcaaggtgttcgcggcggtgcccgtgaagcccancgccgagttcctgaacgctgcccgctggtacgactccgtcgccgcgggcgtttcttcaaaggttcctgggcaaggcctctgggggtgagtgcaatcctcccggctcctggctgcaagctggctcctggctgctttccaanggatgaaagaattaatgaacgattaacatgggtttgttccgncgaatnaanacccgcnggagggncaaannaaaacaaacaactngaacgnttaggnnggcaaaccctnccaaaanaaaaaaagaaaagtgggaaaatcctcccgttcctcatggncaatcaaaccaatngggaacgaatgaga

SEQ ID NO: 97172 - DNA, 224 bp, Triticum aestivum
  unsure (1)..(224): unsure at all n locations
  Clone ID: PAT_TA_97172
gtgcatggtgatgtcggtgatgctggtggtggaggccctgtacaactgcgtggtctgatcggcgtcaaggccgtcggctggcgccccgagtggcggttcaagtgggagcccctcgccggcgacgacgaggagaacgggggcccccactacctccgtggtcctcntccanatncccatntacaatnaagttgnaggtgtataaagntctncaatcnnggncccat

SEQ ID NO: 97173 - DNA, 155 bp, Triticum aestivum
  unsure (1)..(155): unsure at all n locations
  Clone ID: PAT_TA_97173
cttatgcgcatgtccaacatgangnancttattcatcggtaatggtccttgacgatggcacnantcttcnccactggcaaatatgctggtcgancctagcncnccgcgtacaanggccacaaagaacacccacccncccagtcccaacaaccatt

SEQ ID NO: 97174 - DNA, 557 bp, Triticum aestivum
  unsure (1)..(557): unsure at all n locations
  Clone ID: PAT_TA_97174
gattccccgggcggacggttttttttttttttttttttgggcaccaagntcaaatttattcnatgaaccangcntcccctcagagggaaaatncaccanctaattaanatttaattaaatctggggcgcacgcaccgggaccattaacctaattttaagttancctggtgcngnacncaacgcnccaaattaaantggaacnttnccttgatcaaaactcccgggtaaccgggccanttagcaanaaaantggtctgtctccccgacgggttgggaaaggggaacttgcaaaactcaaggaaggctccgccgcccgtgagcttcaacaacctccttccnggnaactggggaggaactcctttccctcaagcaangccgaagctcctgatnaacaactacgcaaacatgctggcttgaaggtcccgcaacctgcaacaaatccgtttggtttgatgttcnggcaactggctgggcancaatccncttaagganaaacctccgggnaaccttgactggcccaacaanacnnggggggnttcaacaaatgggcccgggng

SEQ ID NO: 97175 - DNA, 481 bp, Triticum aestivum
  unsure (1)..(481): unsure at all n locations
  Clone ID: PAT_TA_97175
catctgatcacccactaagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaagggctgaacggcctggcccgcaacagcccggaccgcaagatagcgtgcaggtgcctcaagagcctcgccaccagcatcaagtccatcaacatgggcaaggtctccggcgtgcccggcanttgcngggtcagcgtgcccttcccatcancatgtcaacaactgcaacaatgttaactaagttcaatatataaatcccttcctaacgtgcaatgcatggaccccccttgg

SEQ ID NO: 97176 - DNA, 472 bp, Triticum aestivum
  unsure (1)..(472): unsure at all n locations
  Clone ID: PAT_TA_97176
ggcagctgaaaagactaaagtgcttattactgctctgaagaagcaaggggcgtctgaagttggcgttggaggttattgctggggtgcaaaggtanccgtgggagctatcaaagtctgaaaaaattcaagtgattgtcatctcgcacccttcactagtgactgtcgatgacatgaaggaggtcaagcatcccattgagattcttggaggagagcttgatcaagcttcnccaccgccgatagtgcncnattttgaacagcccttggttcagaaaaacaagtttgcccactttgtgaatatttcccgggcgtaccccacggtttcgnttgcagatanaacgccagcgacgcgttcgccgtcaaaaccgccgaagaggctcgtgcaaacatgctcagctggttcgacaagtntctgaanaaacacaaagagtcttcncccacgactcttaaaaaccctttcncncaaagctgttng

SEQ ID NO: 97177 - DNA, 189 bp, Triticum aestivum
  unsure (1)..(189): unsure at all n locations
  Clone ID: PAT_TA_97177
cgccttcttttcatctcnncgcgtgtttctgctcttctctgatctctcttcntanatccttcttgaacgttgtcgctctcgctcgtgcaacacaaaccgcaatggcggcnganaagctcntcacctccgtgganttngaggacnacacgatcacagccaccgtcacgtcntcaggagatgccgtcaagg

SEQ ID NO: 97178 - DNA, 471 bp, Triticum aestivum
  Clone ID: PAT_TA_97178
gacaggatcatgcaaggacctcaaaacgcctgcagcatggcttttccctcatagctgagatagatattttcctccatatgattcatgctttagctgatagttgagctatggaccgctgacattgtcaactggatgctctccatccaatctccgtgattcgtttggatgtagcatgtgtttgttttgtcaggttttgcatgcactcacacaagaattatgaccccactattttggagtatgtaaagctcctgtcgtaccatgatgtcaagcacacaacaatcatgtccatgctatctgaaaatgaagatggaagctacttcctaagcatgaccggacgagacctactaaccagcaagtattcaaaaatgcacatactgcaatgtacatagcatcttaagtcacaaccctttgctagcaaaaataacaaatgcatgtttgcatttaatttggaggaaagccatgaattcaagg

SEQ ID NO: 97179 - DNA, 460 bp, Triticum aestivum
  unsure (1)..(460): unsure at all n locations
  Clone ID: PAT_TA_97179
ccccatccgatctcgccgggaaacctccgatctaagcgaagccaaggctctctcgtcctcctcctcaagatgcagatctttgtgaagaccctgaccggcaagaccatcaccctggaggttgagtcctcggacaccatcgacaacgtcaaggctaagatccaggacaaggagggcatccctccggatcagcagcgtctcatcttcgctggcaagcagctcgaggatggccgcacgctggctgactacaacatccaagaaggagtccacactccaccttgtgctcaggctccgtggtggcatgcagatcttcgtcaagaccctgactgggcaagaccatcacccctcganggttgagtcctcgggcaccatcgacaacgtcaanggctaagattcaaggacaanggagggcantcccccgggaccaacaacgtctcaaccntttgctgggaaagcanctccc

SEQ ID NO: 97180 - DNA, 476 bp, Triticum aestivum
  Clone ID: PAT_TA_97180
atcccgccgccgccgccgccgccaacaaactcgcaagacctgatggcgctgcgttctctgctgacgaaggtgccggcccttggtctcaggtctcgggggcccgtccacgcgctctcgccgccgccggctgctcggcttttgtccagtggtggtccggggggacaaatcatttctgaaggactaccatatattctgaagaagtaaaagccctggaaacagactgcgaaaggctccaggagaagatacacagggacatggatagtttttctgaacttctgaggtctgatgctgaatattatcgaaggcttaccaagcaacttaaaatggtggacactgcatgtggtgctgctatagtcctgggtgtgtcggcagcagtttttatgacggttatttgatttctagggtggtggatattttactatgagtaaattttaagctataatggttggatatgtgcctgatttcaaatattaagc

SEQ ID NO: 97181 - DNA, 295 bp, Triticum aestivum
  unsure (1)..(295): unsure at all n locations
  Clone ID: PAT_TA_97181
tggggcggggcggctcctaagaaactaagtgggattcccccggggctngcaaggaatttcnggcaacgaagaanggagccaacgtcaagacaaacaatccaaatgtttggggcaaccttgaaataaagcccatcctaattcaagggctccttattcaatgggggctcaaataagaacaactaactaactctaatttgcaaataaaatttanccgcaaaaaaaatgaagctccgaggggggggggccccggtaaccaaatttcgccctataagtgaagtccgttattacgccgcgc

SEQ ID NO: 97182 - DNA, 616 bp, Triticum aestivum
  unsure (1)..(616): unsure at all n locations
  Clone ID: PAT_TA_97182
tcaaccccgctcctgggctttattaacccggcctctaactccaacaaacttcaacaagnccaacaagctcaacaaacaacaaccaancgnccgnccggctggccctcaagcttccccttcccgggagcaagccaaancaagccgaagcaagggaagggaacaagaacaatggggaggggaaaggaggaaggaacgttgcgggctgggcgccaacaaggttactcgggagcgggnaagcccatccgggacggngnggggcaaagggcgggccggcnnaacnaacaannggactaacaagggangcccgccccccggngccgctctttcgaagcccggggggaagctcaaagtccttggtcccttctaaccggcgccngggcaattcgcccggaagttcaatccgnccaacctttcctccttcctcctaangtcaaccggtttctcaaccgtcaatggggaagttctcccaaagttccccccttccaaaagttgcgcccaacccgttcnggcgttccaaggggcaatncggcctgggtccntccgggngggcatgattttcgcgcctccgttctaantggcaaaccgccccgggaatctcaaatggagggggcancan

SEQ ID NO: 97183 - DNA, 649 bp, Triticum aestivum
  unsure (1)..(649): unsure at all n locations
  Clone ID: PAT_TA_97183
ggtgggcgggccgctctagaaattattggattcccccggggcttgcaaggaaattcggcacgaagccgcgggcgttgcaaccgccgaacaaccgaagaaagcttgacgaccaccaaacgtccgttgccggaagaccggagccgcggcaacgaaaggagggaggcgggccgtcccggtttcaangaaagaaacaatcctccgggccgaaggagggagcccggcgttccccgcgggacggcaagcgggcaaggggggcgggccgctgtcgttacatgcgccaccgcggcaagcacgaagcgcgactactacgggggattgagcgacacgaaggctgtaccaaaaacgggccgggngntaactaacgaacgttggaggacttgacaaagttacgggcttaccggnttacgaagtccaaccccgggttgcgggacgggngccncccccgaaccccgaaggacaaacaggctcccggggntacgggncggccccccgggccgccaagcgggaagcttaccggcgaaggcgggnccgggnttacgaagaaacgaacaaacggggggtggggggggggaaacaaaaacgaacgaaccggngggggttccaaggaaaaaaccaaaaacngggcaattacaaatccaatgagnttaaa

SEQ ID NO: 97184 - DNA, 479 bp, Triticum aestivum
  unsure (1)..(479): unsure at all n locations
  Clone ID: PAT_TA_97184
ctcccctcggtcgctcccgcgggcgaccagggagcgaacctagccgccgcaagagcctcacaccggcctcccctcccctcgccgccgccgacaggaatcaccgggcgaagcccgcgcggctcggcggcggcggggccctcttcctcctcctgggcgagcggcgcgggccgatcacttcngggggagttcgggctcgcggtggtccggggcggcgcggcgtggctgcagggcggcgcagggcgctcggtgcgtggggtcgcacggggcgggatggtgctgcgtggcgtggggcgcatgcctaggggcggccaagttgctgcggggcgcgtgcanctcagatctggcgctgggcgacgcgtctcggtgggcatanactggtgcgcgcggcgtcgcggctcnaatggncgtaagtnnggtgcgcgcggcgtcctccctgctgcgcggacgggcggggttgcactggcgctccgacngggtna

SEQ ID NO: 97185 - DNA, 477 bp, Triticum aestivum
  Clone ID: PAT_TA_97185
ggggaacaagcgccgccgctccaaccctgctgcgccgccgccgctcgacgtcccggccccctcgggggacagcaactcccatggctacaatgggatcggttcctccacccccggcgccgccttccccgacgagaacggcgccgaggatgtgatgtatctcgagcaggagagcggccaccacctctattttgacgagggtgctgcttttgttgccgacggcaaccttgatggcattaccttggacgggattgcgccggaccaggctgagaccatggctgttctcaccgatgtcggtgacaatggagttgttgccggtgacaatggagttgttggcaacgacgcagctccccaaaatgctgtgaacaatggaggtaatccccaaaatgctgtgaacaatggaggtaatccacaaaatgctgtgaacaatggaggtaacagtcaaaacggtaactgcaatgtattgctgccgcgtagcaa

SEQ ID NO: 97186 - DNA, 486 bp, Triticum aestivum
  unsure (1)..(486): unsure at all n locations
  Clone ID: PAT_TA_97186
ggaatacaataagagccgcttcataccaatcaagcgggagccgctttcacacttgtttaggcttccgcgcaccgcggtgcttggagtggccgtggatgtggctttcttcctgctaacggtcgctggtcttctggtagcgacgatgtcgccgcacgtggagggttcgaaatctcatggtcaaatggccggttccgtgatcatggaagtggggttatttggtatgcttgtgacagcttgctttgttaccatcccagcgttcattctgcatgcctggaggaatgaccaagcggnatggnaagcacggtcacagtgctgttganatgaagctaagaanagagggtgtccgcnaaatttggcaaaggagctacagtggccaatctgctgatgggtgtgaagtgattccaacanatgcaaagttttcaaaaggaaaaacaaacctttgaatacttgcctccttctactaatangnaattctaaancgncatn

SEQ ID NO: 97187 - DNA, 468 bp, Triticum aestivum
  unsure (1)..(468): unsure at all n locations
  Clone ID: PAT_TA_97187
ccgtcccgtctccancaaacctcccatctccgtctagcgtcggcggnagttccactccctcgccatgggcaagattaagatcggantcaacggtttcggaaggatcgggaggctcntcgccagggtcgccctccagagcgacgatgtcgagctcgtcgccgtcaacgaccccttcatcaccaccgagtacatgacctacatgttcaagtacgacaccgttcacggccactgggaagcacagcgacatcaagctcaaggacgacaagactctgctctttggcgaagaagccagttaccgtctttggcgtcaggaacccctgaggagatcccgttgggngtgaggctggtgccgattacgttgtggagtccaccggttgtcttcactgacannggacaagggccgcctgctcaacttgaanggtgcntgccaanaaagggtggtcatctnctgcccccaatgtaaaagaa

SEQ ID NO: 97188 - DNA, 508 bp, Triticum aestivum
  unsure (1)..(508): unsure at all n locations
  Clone ID: PAT_TA_97188
cgccgccacacgaacccccacccnaacccgcagcgancgccggccgaggaggaagataatgtgagatggctcgcggcgcggcggcggcggcancggtcgnnaagggcaagaagaaggggtccgtctccttcgtgatcgantgcaccaagcccgtggaggacaannatcatggagatcgcgtcgctgganaacttcctccangancgcatcaangtcgccgggcgtgcaaggcccaggnacctccggcgactccgtcaccgtccacgcgcngacaagagcaagngtcacccgtcacctcgggaggggcgcctttctccaaagtagggtanctcaaagntacttggaccaagagagtacttgaaagaaagcacaaangttgcngggnactgggcttcggtgnngatncgccagccancaaannaagccgcacccgngntaagnagctnccgggntacttncaaacantctnctgatgaaatgacggggcngnngggagggatngnttcat

SEQ ID NO: 97189 - DNA, 448 bp, Triticum aestivum
  unsure (1)..(448): unsure at all n locations
  Clone ID: PAT_TA_97189
gccgccgccgcctcctcctctccgctccttctccttccttcgagtttcagccatgggtaaggagaagactcacatcaacatcgtggtcattggccatgtcgactctggcaagtcgaccaccactggccatctgatctacaagcttggaggtattgacaagcgtgtgatcgagaggttcgaganggaacnccgctgagatgaacaanaggtctttcaagtacgcctgggtgcttgacaagctganagccgancgtgagaggggtatcaccattgatattgccctgtggaagttcgagaccaccanggtactactgcaccgtcattgaggcccccggtcaccttgacttcatcananaacatgagttactgggtaccctcccaaggntgactgtgcctgttgcncatcantgacctccancactggnngggttttgnangccgggtatcn

SEQ ID NO: 97190 - DNA, 262 bp, Triticum aestivum
  unsure (1)..(262): unsure at all n locations
  Clone ID: PAT_TA_97190
gctangcgtcaatggcgaccatacccacgatgaccatgctcaagncccgccaagatcanggccaggtcggtgccttcgtcgccgtcntccancgccaaggtggcgtcnccgagcatctcgctgcncancctgcanaagaacgcggccaagaatggagccctggtcgtgtccccggcggncgcggccatggcgatgcnccttctttcanctcnctggnctcgtcggtngcngtgatggcntcgcatacggatcnngtgacgtt

SEQ ID NO: 97191 - DNA, 437 bp, Triticum aestivum
  Clone ID: PAT_TA_97191
atactctccccttattttgaggaaacttcacggggcagaggatcactacaattttttgtttcaaataggaaatgaacaaaacatgattttgccaacctctcatgtagtatatatgtacctatttcataaagtacatcggtttaaatacaagtttgcaactcatgacgatgagtcgaggagtgaaagaagtttggaactcacacaagtgtcatactcgcatgaccaaatcaggctacgaagacaagtcttcatgcgcacatgattgccgattttagttacacaagtaccatttaaaaagcggctgacatttgatgaattgccgaagggtggtggctggacaccatgggggacagtgttccaagatggttagacgttagctactgattcacaatctatcaatcctatcttcatgtatctgtgtgtgttaggtacatcta

SEQ ID NO: 97192 - DNA, 462 bp, Triticum aestivum
  unsure (1)..(462): unsure at all n locations
  Clone ID: PAT_TA_97192
cccgcccgccgccgccgccgccgcagagccgcagggagagaaggcaaggaggaaggaaggggaagatgccggcggggcacgggctgcggtcgcggacgcgcgacctgttcgcgcggccgttccgcaagaaggggtacatcccgctcaccacctacctgcgcacctacaaggtcggngagcacgtcgacgtcaaggtgaacggcgccgtccacaagggcatgccgcacaagttctaccacggccgcaccggccgcgtctgcaacntcaccaancgcgccatcggcgtcgagatcaacaagcaggtcggcaacaggatcatcaagaagaggatccatgtccgtgtgtgagcacgtgcagccatccaggtgcaaccgaggagtttcctccacagggaanctcaacaacgatcaatnctnnttggcgcgntgccantgcccctcggcctcggtcattcatgnaccn

SEQ ID NO: 97193 - DNA, 440 bp, Triticum aestivum
  Clone ID: PAT_TA_97193
cacacaccttaatagctgataaaactgacttttcagctttacgtatctctgttatagatgagcagcaacgttttggtgttatccaacgaggaaggttcaataataagctgtatacttcgtcttcaaagctgagtgatgaaaatacaagcgaagatgcggcttctgattctgaaacatttatggctccccatgttcttgctatgtcagctaccccaattccaagaacactggctcttgctttatatggggatatgtctcttactcaagattacagatttgcctccaggaaggcaacccatagaaactcttgctcttgaaggaaatgacgctgggtttgaaactgttttccagatgatgagggatgagcttatggatgggggcaaagtgtatctcgtttatcctatcataagaaagaatcaaaggcacctaccacaacttca

SEQ ID NO: 97194 - DNA, 455 bp, Triticum aestivum
  Clone ID: PAT_TA_97194
tgcaggttatgtagcgggtatcatcacttacctagctggtcagaacatccctctatctcttcccacttcactggcggagatcccatttatcacgggttcgtaaaaggttggccatgatggtcctgtactgtaagaaagagagcttaccgaagatcgagaagagcatgcgagcacaccggcagcaaagaaacggtttctacaacttggtcacttggctcataatatatatacgggttgaaataagcgagtcgtgaaaccacgccgtgatcgagccccttggcctcgacattttgtgtagtggtagtgaaaggctcggtgtggtgttgatgcgggtcaaatgtggtaggctaagagctgaatggtcatgtaaattatgctggtagaccgtccctgtccacagggggacaaaaacatgtactctgaattcgtatgatcaagttttgaagctggtctgc

SEQ ID NO: 97195 - DNA, 470 bp, Triticum aestivum
  unsure (1)..(470): unsure at all n locations
  Clone ID: PAT_TA_97195
cctggtcctcatcctctcgcctctctccccccacacaggcttaacaatctagcgttagcgcctccgtccatctcgtagctgcttcgatggcgatnaagaggaccaaggccgagaagaagatcgcgtacgaccagaagctctgccagctgctcgaggagtacaccaaggtgctcatcgccgtcgccgacaatgtcggctccaagcagctccaggagatncgcaagggtctccgcggcgactccatcgtgctcatgggcaaagaacancctcatccgccgctgcatcaaggtgcactcggagaagaccggcaacaaggacttccttgagctcancaanctcctcgtcggtaacgttggcctcaacttcaccaaaggtgacctcaaaggagggttcgcnaaggaggtcgccaaagttacaaaggntgggcgctncctggctccgtgtttggggctaatttgcaccttgtttga

SEQ ID NO: 97196 - DNA, 457 bp, Triticum aestivum
  unsure (1)..(457): unsure at all n locations
  Clone ID: PAT_TA_97196
caacccccctcacatcccaccgaaaccccatcttcccacacgctccaaccaccagcacccatggnacccaaggcggcggaaaagaagccggtggccacggccgagaagacgacggcggggaagaagcccaaggcggagaagcgggcgccggcgtccaaagaggccggcggcgaggggaancancggggcaggaagaagggcagcaaggccaagaagggcgtggagacgtacaagatctacatcttcaaggtgctcaagcaggtgcaccccgacgtgggcatctcctccaaggccatgtccatcatgaactccttcatcaacgacatcttcgagaaagctcgccggcgagtccgccaagctggcgaggtacaacaaagaagcccancatcacgtcccgggagattcanaactccgttcggctcgtnctccccgggggaagctcgccaaagcaacgccc

SEQ ID NO: 97197 - DNA, 468 bp, Triticum aestivum
  unsure (1)..(468): unsure at all n locations
  Clone ID: PAT_TA_97197
ccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccaagcatcaagtccatcaacatgggcaaggtctccggcgtgcccggcaagtgcggggtcagccgtgcccttccccatcaacattccacaacttgcaancaatgtcaactaagttcaatatataatcctt

SEQ ID NO: 97198 - DNA, 354 bp, Triticum aestivum
  unsure (1)..(354): unsure at all n locations
  Clone ID: PAT_TA_97198
caaaaacatggtctccgagctgaagggtgcacaacaattttaggacaattatacatcctggaccgataacacaatattgagtagatatactataaatagatagatatggactgaacccactgctctttgtgctggatgctggtaaagctacgggataacatgcataacaaagactctttcagcaggtgtaaccactaagaaaatcaaagaaacatctcgttgatcagtgcagattctatttacacttatgtgtgctcccctccacacttcactcctcggctcctagtcctacgtctgtgttgaaacacaanattttcccactgttccagaaaaggcgctggcagcaggttgcga

SEQ ID NO: 97199 - DNA, 161 bp, Triticum aestivum
  unsure (1)..(161): unsure at all n locations
  Clone ID: PAT_TA_97199
gccgccgccgcagccgcccgccgcattccgagcggttcgagttcgccggagagggagganatatggccagnaanggcggatantaggaanaangntgttnccaggtccaccaangccggtctctagtttccntcgntcgnatctggcncttccttcaagaa

SEQ ID NO: 97200 - DNA, 481 bp, Triticum aestivum
  unsure (1)..(481): unsure at all n locations
  Clone ID: PAT_TA_97200
cccgtttattattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcaagaaccccacggaggcggagctgcaggacatgatcaacgaggttgacgcggacggcaacggcaccatcgacttccccgagttcctgaacctgatggcgaaggaagatnaangacacngactcggagggaggagctcaaggaggcgttcccgcgtgttttgacaanggaccaagaacggcttcaatctcgggcggnnggagctngcgccaccgtttatgaaccaacctccgggggaanaaacttgacgggaccaaagangtnggaccaagaatgattn

SEQ ID NO: 97201 - DNA, 223 bp, Triticum aestivum
  unsure (1)..(223): unsure at all n locations
  Clone ID: PAT_TA_97201
cctccgcgtaggatctgactgcccgccggagccgccgcacnggccgctcggcgttccccggnttaaacccttctcctcctcgctccctcgccgccccatagncgctaaaccngggggagatgcggngcctccacatgatcnctccatcctcgccgnccgctccagcccnctcgcncgccatnggancccctctcnctcttcngtctcncntctcacaanagaa

SEQ ID NO: 97202 - DNA, 458 bp, Triticum aestivum
  unsure (1)..(458): unsure at all n locations
  Clone ID: PAT_TA_97202
gccgcccctcccacccacccaagaatcctccaccataatccccggcaacccacgcccggctccgatggnccgcacgaagcagacggcgcgcaagtcgacgggcggcaaggcgccgaggaagcagctggcgaccaaggcggcgcgcaagtcggcgccggccaccggcggcgtgaagaagccgcaccgcttccgcccgggcaccgtggcgctgcgcgagatccgcaagtaccanaagagcacggagctgctcatccgcaagctccccttccagcgcctggtgcgggagatcgcgcaggacttcaagacggacctccggttccagagctccgccgtgtcggcgctgcaggaggccgccgaggcatacctggtgggcctgttcnaggacaccaacctcttgngccatccacgccaagtcgcgttcaccatcatgnccaanggacatccaagctcgcccgccn

SEQ ID NO: 97203 - DNA, 456 bp, Triticum aestivum
  unsure (1)..(456): unsure at all n locations
  Clone ID: PAT_TA_97203
cacaccacacggaaccgaaattttaggtgcacgccctcctcccccctccccttcccaatccccaaaccaagcgccgaaaatcgcatcgcgccgcgccgcgccgccaccaagacgccgggtttggcgggttggggcgctcccgtggccgccgttgctgttgccgcgtgtccgccctggcggtggcggttgcatgtatgcgggaggggagagccaatggtggggtcgacggagagagaggcggcgcttgatgccgccgccggtctcgtgggcgcgcttcggcggcagaggccggggccagtcccacccgtcctcgtccggctcgggccgcgtcggnggaanggggagccaannaacangggagggcgcaaagaagcaaagcggcggggaancangtcttgaagggcgaattccnngaaccgggcttgccttccccccgccccgcntgctggggggaaa

SEQ ID NO: 97204 - DNA, 458 bp, Triticum aestivum
  unsure (1)..(458): unsure at all n locations
  Clone ID: PAT_TA_97204
gggggacatgatcctgctgccaaacggcgccgaggtggtgatcatcaacggcgccatggacggcaccgccgggtgggaggncgccaacaccccggcctacgcgcccgtcgtgtaccggccggaccacgcgcccggggaccggttcgaggagcaaaagcgcgaccgacatcncgcggctgtancactcgtcggcgatcctcctccgcgacggccgggtgctggtcggcgggagcaacccgcacatctactacaacttcaagcaacgagcagtaccccgacagagctcagcctggaggccttctcgccggagtacctcgacaagctccaacgacgccctccgtccaaagattaccaaccctcgccggcctaaccgggggtgaagcgtgaagtanggtgactccatgaccctgcagttcgaggtgcaagcggtcgccccnaagaaagagaacgccccgggg

SEQ ID NO: 97205 - DNA, 500 bp, Triticum aestivum
  unsure (1)..(500): unsure at all n locations
  Clone ID: PAT_TA_97205
cgtcttcgtactcgcctctctccgcgcaaccgaagccttcgccctcgtcctccccatttcgccagcggcgcagcccaccaaccacccccacccgccgccatgagggagtgcatctcgatccacatcggccaggccggcatccaggtcggggaacgcgtgctgggagctctactgcctcgagcatggcattcagcctgatggccaagatgcccggtgacaagaccgttggggganggtgatgatgcttttcaaacaccttcttcagcgangaactggtgctggggaaagcaacgtcccccgtgctgtcttcgttagaattctccgagcccactgttgatttgaatganggtgaagggactgggcgnctttancggcccaagctnctttccacccctgaagcaagcatttantcaaggtggccaaanggagggattgtaagctcananaaatcttnggccccgttggggccatttacaanccnatttgggncaaaagggagg

SEQ ID NO: 97206 - DNA, 457 bp, Triticum aestivum
  unsure (1)..(457): unsure at all n locations
  Clone ID: PAT_TA_97206
gctactggaagagctgcactggactgggagacgagagtaaagatatctctcggcatggctcgtggactcgctcatcttcacgctgaggggagcgggaagttcatccacggcaacctgaaatcgtcgaacatccttctgtcacagaacctggacggctgcgtctccgaattcggcctggcacagctcatgaccaccctacctgcccctgcgcggctcatcggataccgtgcgccggaggtcctggagacgaagaagccgacccagaagtccgacgtctacagcttcggcgtgctgctcctggaaatgctgaccgggaaggnccccctgaggtcccccggncgcganggactccgttnagcaactgccgcggggggtnnaatnccgtggtcccnggaangagtngacccccggaggtgttccanccttggacctggttggngggaaacccaaanaaaaa

SEQ ID NO: 97207 - DNA, 578 bp, Triticum aestivum
  unsure (1)..(578): unsure at all n locations
  Clone ID: PAT_TA_97207
ttttttttttttttttttttcggcatttgcngtagcttactgatttaagtttacatgctctctctactctcttctattccaactagatacctattcttctctattcattcttctctctctctcctctattctttctcggtactcggncgtgctgctggggcctcaagggatgaacccaacccgaattctcttagnttacccgttcatcaaanatggctctatcctatgattgaaacgggntaacctccgaaggggggggggcccgngtacccaaattccgcccctaataagttgaagtcggtaattacggcnccgctcaactggggccggtccgtttttaaaaancgtccgtggacctgggggaaaaaccctgggcggtttaacccaaacttaaatccgcccttggcaagcaacatccccccccttttncgnccaancatgggnggtaaataanccgaaaagaagggngcccgcaacccgaattnngncccctttccccaaaacaantttgcgnccaagnccctgnaaattgggnngaaatgggggaacngccgnccccttggttacncgggcgtcan

SEQ ID NO: 97208 - DNA, 463 bp, Triticum aestivum
  unsure (1)..(463): unsure at all n locations
  Clone ID: PAT_TA_97208
ggtaccaacaaattaattaacaaaaagatgcaaaatatatgaagagaaaaaaaggcgaaaagtgaagaaaaggaggnctgagaattttgcaaagggatctanctaagctaactaggctgcgcgggcgcgcgatgatgcacggctaactagctaggagtacatccgtacggncggctcaagcgatcaacatatgccgtagtcatggaacatganctccggcttcacggtcaccccggggccggggccggccgccgccgctgccgcgtccaaacngtggntgccgcggatgaaaacganctccttctggcgggngcaagctccatcaacttgcggtgagagttggaagtgctgcgtcagcaagaacnatggggcttgccgccgggcgggtactccgggcaccaaacgtccttgacttgaatcgcacgccgcacgcgttgcacaanntctttgggncccaaccggg

SEQ ID NO: 97209 - DNA, 505 bp, Triticum aestivum
  unsure (1)..(505): unsure at all n locations
  Clone ID: PAT_TA_97209
tcaaaaccgaatcagaaatctcaagctcagcacagcaacaatggccgagcagaccttcatcatgatcaagcctgacggcgtccagaggggcctcatcggcgaggtcatcaagccgcttcgagaagaagggcttctacctcaaaggtctgaagctccagaacgtggagaagtcgttcgccgagcagcactactccgatctgtcctccaagcccttcttcgctgggctcgtggngtacatcgtctccgggcccggtcgtcgctatggtctgggagggcaaagagcgtccgtcncccactgggacgcaaagatnatttgggggccancaaacccctgggcctctgaggccccggnaaccatcccgtggtgactttggccgttcgacaatcgggnagggaacgtcatccaatgggaangcgaactcnagtttgagaagtggccaaggaaaaggagaatcgcccttgtgggnttcccctgaaggggaattgcaaaaattgggaggnagca

SEQ ID NO: 97210 - DNA, 305 bp, Triticum aestivum
  unsure (1)..(305): unsure at all n locations
  Clone ID: PAT_TA_97210
aaacaacactgccagcagcagcagagtgagcgcccccgccgcactaatctcgctcgaatccatcaanccatggccatggcgggcgcgagcatcggcggngcactgggnttcctcgccccgcgccgtcgcggggtgtccttctctgcggcggcaggtcgtaagaggccgtccctggcggtggtgcgcgcggcgtcctactaagcgggcgtcngggtgatggngaccaangtggggatgatgacctacttcnanccggaaaacgggaaaccngtgccngtgacggtggtcgggtttnannaaggggg

SEQ ID NO: 97211 - DNA, 292 bp, Triticum aestivum
  unsure (1)..(292): unsure at all n locations
  Clone ID: PAT_TA_97211
ngccaaatcnagcagtanccaacacaaatccaccatgaagaccttcctcgtccttgcccnccttgtcgttgtggcgaccattgaaaccnccaactccnatattctacgtagtgatcaaccacaacaatcatttccacagcaaccacaaccagnaaaaccgttcantccttttttggancaacaanttgatttcatgcagggatgtcctgttggatgccaantgnaacataaccggggacccgtcctttcaanggtcaacaaaaatanttgcanggnaaaaatngttttgtgg

SEQ ID NO: 97212 - DNA, 344 bp, Triticum aestivum
  unsure (1)..(344): unsure at all n locations
  Clone ID: PAT_TA_97212
caaatccaccatgaagaccttattcatcctaacaatccttgcgatggnaacaactatcgccancgcgaatatgcaggtcgaccccagcggccaagtacaatggtcacaacaanaancattcngccagccccaacaancattctaccaancanccacaacaaacatttccccaaccccaacaagcattcccccatcancnacaacaacaatttccccagccccaggcaancacangcancaatttccgcagtcccaggcatacccacaacanccatttccccaagccccaacaagcccaactaccatttccccagacaancacaggcattccattcccccaaccc

SEQ ID NO: 97213 - DNA, 482 bp, Triticum aestivum
  unsure (1)..(482): unsure at all n locations
  Clone ID: PAT_TA_97213
ggagaaaaaaangcgatggggttcggggggggcaatcaacggggaacaaggggggggtgctaaaacttctgggctggacttcanctccttgcatgaaccgcctgncgccancacctcccgactggggggcctcctccngcgangactaaactcngagttgcctccaacactcccaagggaggttccaaacgcagggaacaaggatntacaaaggagggagcaacgtcaggataaaaactgctgctccgcaaaggcaaaggagggaaacccaaaggaggctccctgctgttgcaanctcancactaacatccccttttcaatttttttcttangccttttgtttgttgcaagcgcttccatgttcgggtatnagcaaangcaantaaattacctaaaacatttgcacccctncccaacctccnatgaatttggttcctaaaaancaattnantttngataaaacnaccctttggtcaaacaaa

SEQ ID NO: 97214 - DNA, 529 bp, Triticum aestivum
  unsure (1)..(529): unsure at all n locations
  Clone ID: PAT_TA_97214
gtcgatnacacacgctctcctcgccgccaagatgttcgggttcgggcaccaccacaaggaccangcgccggnggngtcgggccccaaccaaatcttcaagatctactgccgggcctcggaggantactgcctcgccgtccgcgacggtgaggtggtgctcgcccccgtcaaccccaaggaccgaagacccagcactggctcaaggacatgcgcttcagcaccaccgtcaaggacnaggaggggcatgccggtcttccgcgctccgtcaaacaaggccaaccgggcctccgcccgttcaaagcaactccatcgggccaagtcccacccccgtttaaagctggttgcccgtttcaacccngggccgttacgaanggaanncgtccngttgctgttggnacnggangaagcnaaanggaccgttgggggcaaaggggtttttccgnccttgcaantcngcaatnggtcaaataaaacaccccggccctccaaacntttcgnancgcccctccaaacnggggcncaanggggg

SEQ ID NO: 97215 - DNA, 469 bp, Triticum aestivum
  unsure (1)..(469): unsure at all n locations
  Clone ID: PAT_TA_97215
aacaaaaacctanccgtcccctcaaanctcgncgncgaagnaangaggtcttnctccaacggcgcaaacatggggacccaagattannaaagaaaaagaagtttgtgagcgatggngttttctacgccgagctgaacgaaatgctgacccgggagcttgccgaggacggntactccggcgtggnggtangcgtgacgccgatgcgcacggagatnatcatcaagggcacgcggacgcaaaaacgtgcttggtgagaanggncgcangatnanggaagctcanctccgtcgtccaaaaacgcttcaacttcccgggagaanggngttgagctttactccgagaaagncgtcaaacgttgggctctgggccatngcccaagctgagtcactccgctacaagctcctcncgtgggcttgccgtccgcaagggaatgcnatggggttcctcccctttgtttatgggngaaggg

SEQ ID NO: 97216 - DNA, 348 bp, Triticum aestivum
  unsure (1)..(348): unsure at all n locations
  Clone ID: PAT_TA_97216
ataacaaggagagtgcnacttccaagaaggccaagactcanaacgatgaggaggtcaaatctgaggtcnaatatnagggtagcgatgaggaaaatgangacgatgattgagtaaatantgctatcacatcatgaggtaccaaattgggtgttgggtccccgcnttantgtactatntttgctatccatgcgtatcctcggtgattagatgaatnaagatttgngtantanatgctgcgcttgtgtgtttaanggggggcccccttttaagacttgntgngaaccccatggtnttgatnanangtatgcttagataactgctaattaacccaanaacaangaaaggcct

SEQ ID NO: 97217 - DNA, 430 bp, Triticum aestivum
  unsure (1)..(430): unsure at all n locations
  Clone ID: PAT_TA_97217
gtcccgtcttatcggcccctccccaaatccctcctcccttccccaaacaaatccatccccccggcgacatctcccgcaagctgagaccaagcgccgtgcgtgcatccctcggcgcggnggtccctctcctcttcttccgctggcgctggnactgggctagcacggagtggggatcgatcgggcgccggcctctccgtcccctcgcccacagatgaaggaaagcctttgatccgcccgcctcggcggcagcagcaacgccagaagcagataacggngcctccatcttcacgaggaaaaacatttggagtgatgcggctgccgagggagacgacgattcctcgccttggccgtgggacgggtgtgaagagtgaagaggatgccgattttctttctcatgcaaacagggctttgtcgtttctgggattatgaa

SEQ ID NO: 97218 - DNA, 465 bp, Triticum aestivum
  unsure (1)..(465): unsure at all n locations
  Clone ID: PAT_TA_97218
ccgcagtccacgaacccatcgctacagcggtgcggcctcgcctcacccacccacccacatcaccaccgccgaaaaagaagatcccgggcaagcggcgaccgatgcaaggatgccgtctgcgcggccggcggcgttactcgtcgcggccgtgttcctgtggtggtcgggggccggcgcgctggcggacggnggcaacggcacggtgtgcctgtgcacgggcccgcagtgcgttncgccctgccccgtcccggggacgacgtccgccgacgacgtcgcccgatgcagttccccctttctgcccgcaagcgtgccgccgcgcggtcggggcccttccccgttgggnagcagcaancncgcccggcgtcncccgaggttcggggtctgggggttcccctcagggacgncggggccttcctcctcgggtnagnaancggncaatccccccnctngggaantccnggcggc

SEQ ID NO: 97219 - DNA, 431 bp, Triticum aestivum
  unsure (1)..(431): unsure at all n locations
  Clone ID: PAT_TA_97219
ccgggatccgcatcctggtgacctccgacgccgccgacggctgcgcggccgagtggcgctcgctggcgtcgctcctgccccgccccttcggcccccacgacctcctccccaaggacgcccccctcgtcctcgagccgcacgacaaccgtctcggcgatcccgttgacgccgccgccaatggcttcgccgccggcgacctggaggggcgcctgaaggatgccgcggaggcggcggcgcgcgcggcgcacgcgccgtacagcgggtgcccgtcggggttcgcggtggcggacggtgaagggaaggtgtacgccgggggctgcctggagtccgcggcgtacaacccgacgctgggccccgtgcagacgggccatcattgcgatgattgccgcctccggcggctccgccgggcgatgttggtggcggcancgctg

SEQ ID NO: 97220 - DNA, 435 bp, Triticum aestivum
  Clone ID: PAT_TA_97220
gctgaccaagaaactgagcaaggtagcctcactatagataaatcctgggaggattatgcttccagagagttcaccatggtcttgagtaaaactttgaagaatggtgcaaaaatcatgctggaagccaagattaaaattagcatggagtatcctcttaggccaccacttttcagattgcagctggtttctgaaaagaccgaagatttaaaatggcacaatgatcttcgtgcaatggaagctgaggtgaatcttcacatcctccgaattcttcctcggtcgaacgaggactatatattaacccaccaagttctgtgcctggctatgttgtttgatatgcatttggacgaggatcacgagaaaaggaaagttacttcagtgattgatgttgggctgtgcaaaccagtcaagtggaaccatgctcactagatcaagtca

SEQ ID NO: 97221 - DNA, 426 bp, Triticum aestivum
  unsure (1)..(426): unsure at all n locations
  Clone ID: PAT_TA_97221
acgaaccccctccgccgccgacctcgcgtcttctcctgcgcatctcggaggtgcttcctagtttccacgatgaagctgatcgctgcctacctcctcgcctatctgggtgggaactcttccccaagtgccgctgacgtcaagaacatcctggactcagttggtgccgaggctgatgaagaaaagcttgagttccttctggctgaactcaaaggcaaggacatcacagaagtgattgcatctggaagggagaagtttgccgctgtgccttcaggtgggggtgccattgctgtgggagctccagctgctgcatctggtggtgccgccgcacctgctgctgagtcaaagaaggaggagaaggttgaagagaaggaagaatctgatgaagacatgggtttcantctgttcgactaagcgcttcagttcctc

SEQ ID NO: 97222 - DNA, 426 bp, Triticum aestivum
  unsure (1)..(426): unsure at all n locations
  Clone ID: PAT_TA_97222
cgcgcgagcaatggggtccanctcctgcttcctccancantccaacgcgcgcctggccgcctcggnacgccctgcgcccgccgtcgggcgcanccagctgttcgtntgcaaggngcaaaaaagcgacgaggntgcatctgacgctgccgtcgtcaccaaccggngcgccgcgctgtccctcctcnccggtgcgggcggcgtcgccgtcaaggtctcccccgccgctgccgcctacggagaagcaacgaacgtgttcggcaaggngaagaaaaacaaaggacttcgtggcntacagcggcgaggggttcaaacttatgatnccggccaagtggaancccancanggagcgtgagttccctgtgcaggtgctccgcnccaaggacaaantttantccaacancaaactctccgttttaaataanccca

SEQ ID NO: 97223 - DNA, 274 bp, Triticum aestivum
  unsure (1)..(274): unsure at all n locations
  Clone ID: PAT_TA_97223
gatacgtgatantaaggagtgtgttgaggggttggggtattctcctttcntcctctcccgcgancgcgccgnccccgcgggccggccggccgcncccanccctctctcccgcgcgcctctccctcccncttcntctctgccgccgtcgccggngcccnctgngggcctgtgctcgggcgannaatggtggaggccngccccctgtcnttttcccctctcgggatgtctgaccgncgcngtgacnagggtcgaacnccaggggcngtgcttcaaa

SEQ ID NO: 97224 - DNA, 479 bp, Triticum aestivum
  unsure (1)..(479): unsure at all n locations
  Clone ID: PAT_TA_97224
aaaagattctccccccatctctctctcccgttccctcactgttccaatctgcccttctctcttcttggtgatttggccgcggcgtctgctccgcggtcgcctgacacgaccgtcggaaaaggcagagacgggcgaggatctcgaccgccgggagcttcgatcggcttcagtcccgtgaaacgaatactaagctagtggcctgagatggaagcagaacaggcggcggaagtaagctctggggagacgaccaatcttaagtcgcctgacacgattctggtacatgatgacaaagaaaatttaagtaaatgggaattcaaatcaacatgtgaaggaaacacccaatgatgatgatgatggaacaagatctgatgggttttgagctggganaatgatgtcctcaacctttgacaaaagggaagttcccaaaagaaggatggggaaaaacttnaanaatcctgccaaccttnaaaccaanaaaa

SEQ ID NO: 97225 - DNA, 344 bp, Triticum aestivum
  unsure (1)..(344): unsure at all n locations
  Clone ID: PAT_TA_97225
gcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattgntgccaatcccncngctgagggtggtggtgatgatgagggtgttgntgaccacnntgtgnaggtggttgacantgttgacaccntccgtcttcaggagnaacntgcttttntnaagaagcagtttntctctcncaagaagcgct

SEQ ID NO: 97226 - DNA, 481 bp, Triticum aestivum
  Clone ID: PAT_TA_97226
cgagttttttttttttttttttgaacaacacataatagaatctggatagctttagatcacaaccaaaacaggcaaaacattctcagttcaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaggccagcagccttccaccgctgaactgctcctcaatgtgagagtccagtgtacgtccctgctggcgcttctcaagcttcctctggacattgttgctcttctttgcttcctctgtggcaagcaagcaagcaacctcagactcttgtccctcagcaagcatcct

SEQ ID NO: 97227 - DNA, 476 bp, Triticum aestivum
  unsure (1)..(476): unsure at all n locations
  Clone ID: PAT_TA_97227
agcanatcatcgccgcctcgccgggcaaccaacatcagcccagcctagcaagatgggttcgcggtacgaggtggaggtgaccgtgggcgcggcccgggacctgaagaacgtcaactggcgcaacggcgacctcaagccctacgccgtgctctggatcnacgccggcgcccgctgctccacccgcgtcgacctggacagcaatgagaaccccgcctgggatgagaaggtcgtcgtcccgctgccccccgccagccgcctccaggacgccgtgctctacctcgacgtcgtccacgccaacgccgccgagggcgtcaaaaccgctcgtcggctccgcccggctcccgctccgcgacgtcgtngacgacgccggcgtcggngggcaaagtgttcangaaacttaagctttaagcgggccgtcccggtangccccaagggggaaagcttggacgtccgcgntcncccgttgaaaggagccg

SEQ ID NO: 97228 - DNA, 243 bp, Triticum aestivum
  unsure (1)..(243): unsure at all n locations
  Clone ID: PAT_TA_97228
gttcganagacttcnagagacggacaccatcatccaccggcgaggcttcnacctccgacnaanccgccccgccngtncngggtccgacaacatgtccatctcgcttgcgcctcgnnatccccantcgtggngccctgcctccgatgccgccgcgggaaggnccggcccgcccgggaatgcggnctgctcccccgcncctgtccgcgnggnaggcctcccatcaggggatgnngccgtctcctg

SEQ ID NO: 97229 - DNA, 467 bp, Triticum aestivum
  unsure (1)..(467): unsure at all n locations
  Clone ID: PAT_TA_97229
ccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagaagtatacttgaataacgagcgtctgatctgatggagtcnancaanggtgcgtgtgcgtgtgatttgcttgctcgctctccgcctaagctcctgcccaagggggtcccttggtgtgtaagtgtgtgcgnaagtctccctgtaantn

SEQ ID NO: 97230 - DNA, 485 bp, Triticum aestivum
  unsure (1)..(485): unsure at all n locations
  Clone ID: PAT_TA_97230
cttccacctgctcccacctgccgccgctgccgctggcctgccgcagtggcggcaggccccattcctctaaggggaggtgggacctccggccagagcgaagggcgaggcggggcgtggatctcggggcggcggcctcggtcttcgtggcgatgacggctgctgccgccgtttgggcggcctggtggtgctgccgcgccgactgctcgtggtggaggtaactcggcccccttgctgcgcggtgttatcttcttcggtgtggcaactccagcgccgtcacggccttctcgcgtcgccggtgtttcttctcctgggggtctangcggggtgggggaccccctggtcctgcctgtgcgaactcgtcnccgcgtgggatctcgtcngtggaagtgcccggctcgccgaatctggccggttctggnttgtcctgtgtccgtgcggctttctgccgcgggttgggaagctcctttcgccngtntgggnggttc

SEQ ID NO: 97231 - DNA, 471 bp, Triticum aestivum
  Clone ID: PAT_TA_97231
gccgcccgagcttgctgctgcacagccatcgccgccgccgccgccgccgccgccggtctcccttgtcctgctcaccgctgctcacgcccctcagttcaaggcacggcgtcattgggtttgaggtatgagtggacctggccgttgggatgcgcaccatggatgattcaatggctccaccatggatactcgattgctggaacatatataatgttgatccctagttatattgcggttaatttgtcgagctgcaccttacggcccttgatccgaagtgactacataatgatataatcatagaactccaatctaactgaaaacatggaaatcctacattgtgcttgtatatacgaagttatcccaagttccattgcctgtttagtcaaagaagtttgaatattggtcctgagaaatgtataaagtaagagtacaacctgttagttagcaacttttgattaataaaccgccagattt

SEQ ID NO: 97232 - DNA, 487 bp, Triticum aestivum
  unsure (1)..(487): unsure at all n locations
  Clone ID: PAT_TA_97232
ccaccattttcacaacancaaccaccattttcgcagcaacaacaacaaccattatcgcagcaacaacaaccaccattttcacaacaacaaccaccattttcgcagcaacaacaaccaccattttcacancaacaaccaccattttcgcagcaacaacaaccagttctaccgcaacaaccatcattttcacagcaacaactaccaccattttcacagcaacanncnccgttttcgcaacaacaacaaatagtactacagcaacacccaccatttttgcancaacaacaaccaagtctaccgcaacacccaccattttcgcagcaacaacancaactagttctaccgcaacaacaaataccatttgttcatccatcnatcttgcagcaagtaancccatgcaaggtattcctccagcangcaatgcaagcccctgggggcaatgccacanagtcttgcctagggtcgccnaatgttggcanccngaggg

SEQ ID NO: 97233 - DNA, 473 bp, Triticum aestivum
  unsure (1)..(473): unsure at all n locations
  Clone ID: PAT_TA_97233
cggaaccaacaaatccccacccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaggacaaggagggcattcccccggaccagcagcgtctcatcttcgctggcaagcagctggaggatggccgtacccttgctgactacaacatccaagaaggagtccaccctccaccttgtcctgcgtctgcgtggtggcatgcaagatcttcgtgaagancctcaccggcaaagaccatcactcttgaggtggagagctccgacaccatcgacaacgtcannggcnaggattcaaggacaaggaggggcattcctccgggaccaacancgtctcatcttccgctggnaaancnagcttggaggg

SEQ ID NO: 97234 - DNA, 472 bp, Triticum aestivum
  unsure (1)..(472): unsure at all n locations
  Clone ID: PAT_TA_97234
gcaaatcaaaccttgtctgatgatcataacaaagagacaaaacagacatcaacttaaaagaatctcctaaccttcatgcatgcatgtcttcctctcattgcacaacatattctttgtctcatcctttcttctgagaaaacacgtttaattggccttctcttcttataagcaccccaccatacacccatctccaaccccacctcctcttctcctgctagctcattgttcaaaactcaaagttcaaacacatattttctgtctctagctcctcattgcccataagctcccgtgaggccgtgaatggcgtgcctgtcctcctcgccgtctggccggcgcctgtcggagctgctggaggagaggcaggagcccttcttcctcgacctccaactcctggagaaaggctgctcggaccgggctcctccgacggctatgaaaccggccctgtgctgggccaaccgccgggncgccgggn

SEQ ID NO: 97235 - DNA, 249 bp, Triticum aestivum
  unsure (1)..(249): unsure at all n locations
  Clone ID: PAT_TA_97235
ngtggacgancgctgaatctgcaacgccacggtntggtctggtcactcanaaatccacgtcggagctgctctgcctaacaaatcttatatattccctcttctgcccttcccacgactccccgtcgacttgattcgccggcgccgacgacgagcccgattcgactccgacgcacancaccacgctgacacaagtccatantccacgcgcacacaagcaannaatcctttcctctcctcccagcgacaata

SEQ ID NO: 97236 - DNA, 231 bp, Triticum aestivum
  unsure (1)..(231): unsure at all n locations
  Clone ID: PAT_TA_97236
ttcagtcctctccncgccgttactacccatcgnngacctcgcagccctcgtnaacagcaccnccgaantcgtctccctccatcccagcacgctctcncaccacgcgcacttcgtggtcctctgatctgcngacgccgaggctgtgnncacncctcgtggccggagccgaggagtccgcncactanttcgtggangacgccgaggccgtgcgccgggtgagggcanggaggc

SEQ ID NO: 97237 - DNA, 469 bp, Triticum aestivum
  unsure (1)..(469): unsure at all n locations
  Clone ID: PAT_TA_97237
tcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggnggngacttcacccggggcaacggcaccggcggggagtccatctacggcgagaagttcgccgacgaaaagttctccacaagcacaccaaagcccgggattctctccatggncaaacggcgggggccaaanaccaancggggtnccagttccttaatctggcaccgttccccttgcaaattgggtcgacgggg

SEQ ID NO: 97238 - DNA, 461 bp, Triticum aestivum
  unsure (1)..(461): unsure at all n locations
  Clone ID: PAT_TA_97238
gtttgcatcaccatatggatagtcgtaacaaatgaagagatttcagagagtttcacaatctgacttgagtcacaagctataggttaactttaattgaatggtagtatgggagtaataatttccgaaatctagaaatgatcttattgatcatatcaatcttcctggtaatctgatccaccctatgttgcattagtggtgttgggttaaaaatcaacagtgatatttaaaaaaggtaaaggtttttgttgtagttaccngggatcctccaagtgaatcataataatgatgagaaaacatacccaaaaaacataagatgggnttaaaggaaacccactttccagggttgtggtttgaaagagagaatggtttgtaggctttgtctcaaaagagattatctgacaaangaatgattantcntcaaccaagttgagacccagncgnacccttcttaacttgccccn

SEQ ID NO: 97239 - DNA, 478 bp, Triticum aestivum
  unsure (1)..(478): unsure at all n locations
  Clone ID: PAT_TA_97239
gcctgcaccgcgtctacaagagccgctccaacccaacctcctccccaacccgcactgccatagacccattccacccaaaagcccccccccangatcgaccccctccccgctcccctcgctaaagccgaaatcccccggcgcacacgcacgcacgcccaccagagttttccccatcccctctcccaagcaaagcgatctccggtgaatcggaaggcgcgagatncggccgcgatggngctggantgggnggtgctggggtacgcngcgggccgcggnggccatcatgctgctgctgctgaccctcccgggcctcgacgncgctccggngnggggaanntctccgtggctgcgggacgcgctcaagncccatgatgttccggtnggtgncccttcttgccctctttctgctcaatgggaccatnttactggggaantacggatatgcgggtccaaccngtcgntcganntagcaacgcct

SEQ ID NO: 97240 - DNA, 543 bp, Triticum aestivum
  unsure (1)..(543): unsure at all n locations
  Clone ID: PAT_TA_97240
ccacggccggcgcaggcaactggcgagcggagaggcggcgcccctgcctccagtagcctctggcgcggccggcccctacccccgtcggccccggcgtggccaagcgcgtcgcccatcgcctccgttgtgtcgacccggcgcggcgtcgccctggcgcggccggcccgtcgcctccgatgcgccgacctgtcgcggcctcctgtcgccacctccccgtcgaagcgtccgtccgcgcccatcgcccgccgaccccgcactcccaacggacggnccaagctcttctccctttcctcgtttctttccctctgacccgaagttctctttgtccctccaacatctgcaggagctggncatggaggtcgtttgaccctaacaacgatngaagctcctgccntcgccgcgcgcnaanctgcggattcggtcgagggtcaaacaaccaacgccggatttgatggctgtgaanccgccgganctcctggctcgcccctncggtgngttcctccgaancctgcctngcccaannattttccgggcctggctttn

SEQ ID NO: 97241 - DNA, 544 bp, Triticum aestivum
  unsure (1)..(544): unsure at all n locations
  Clone ID: PAT_TA_97241
agaaactgtaacttttcaagggtaactctttcctcctccatggggcttctcaaggatatgagggctctcctgttggtggccattgtggtgaccgctatggtcatgtcatcatgccatgctgcacaagatattgctgctgaagggccttcgggttcaggggagtgcaaccagatcctgccgtgcacggacaatacgtgcaaaatcaactgccagaagctggggttcaagaaccccaagactcaatgcaggcctgggaacccgaagaaaggccagttctacgacacctgctgctgtttttagtcagagacgggcatccacgtatgacgacatcttgatcgggattaactccggcgtgcttgctatggcatcgccggagtccgtcgtactggttgttgaaacgcttatccgaagcgtgtcgatcttgcgtgtantaactaaaaataaagggtgaacgaatgatgtttcaagatnnaaaaaaaaaaaaaaaaaangggggcccggtaccaaattcnccccaaantgggtctnttacccncgcccactg

SEQ ID NO: 97242 - DNA, 410 bp, Triticum aestivum
  unsure (1)..(410): unsure at all n locations
  Clone ID: PAT_TA_97242
aaccacaacaaccattcccccagcaatcccaacaatcacaacaaccttttcccgggccccaacaattatttcctgaactccaacaaccaattccccagcaagcacaacaaccattccccctgcaaccgcaacaaccattcccccagcaatcgcaacaaccattcccccagcaaccacaacaaccattccccctgcaaccgcaacaaccattcccccaacaaccacaanaaccattcccccancaaccacaacaacctttccccctacacccacancaaccattccccctacgancgcancaaccattttcccagnanccccaacaatcacaacaagtcatttccccagncccaaccccagcangcccannaaccatccatcntgcanccacaacanccattttgcnnccc

SEQ ID NO: 97243 - DNA, 539 bp, Triticum aestivum
  unsure (1)..(539): unsure at all n locations
  Clone ID: PAT_TA_97243
gncgcctcctcctcctcctctcgggtccttctccttccttccagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaagccgctgagatgaacaagaggtccttcaagtacgcctgggtgcttgacaagctgaangccnagcgcgagaggggtatcaccattgatattgccctgtggaagtttgagaccaccaagtactactgcaccgtcattgatgcccctgggcaccgtgncttcatcaagaacatgatnaccggtacctcccangctgactgtgctgtggtcancaaccaatccaccantggggggggtttnggggtggnntntccaaaggnagggcaaaacccnnggggaaacccnccctggtttcaaaccttgngtgaancaaatgatntgctgccgnaacaaaatngtngcnacccncccaagt

SEQ ID NO: 97244 - DNA, 565 bp, Triticum aestivum
  unsure (1)..(565): unsure at all n locations
  Clone ID: PAT_TA_97244
gcccccgcccgccgccgccgccgcacagccgcaggtanagaaagcaaggaggaagggaagatgccggcggggcacgggctgcggtcgcggacncgcgacctgttcncgcggcccttccgcaagaaggggtanatcccgctcaccacctacctgcgcacctanaaggtcggngagcatgtcnacgtcaaggtgaacggcgccgtccacaanggtatgccgcacaagttctatcacggncgcaccggtcgcgtctggaacgtcaccaancgcgccatcngcgtcgagatnaacaagcaagttggnaacaggatcatcaagaanaggatncatgttcgtgtggagcacgtgcaaccatccangtgcaacgaggagttcctccaaaggaagctcaacaacgacaaactnaaangcgngagggncaaagtgcctggtgagggtcatcaaccaacanaaanggnaggcaacaaggcccnaancctgngttcatggtggggggggnccaccaatccaanaagggtcacccccatccccgttngaangtcgttcaacnnattttcaanggggg

SEQ ID NO: 97245 - DNA, 453 bp, Triticum aestivum
  unsure (1)..(453): unsure at all n locations
  Clone ID: PAT_TA_97245
cttcnccttcctcggagcttcagccatgggtaaagagaatactcacatcaacatcgtggtcattggncatgtcgactctggcaagtcgaccaccactggccatctgatctacangcttggnggtattgncaagcgtgtgatcganaggttcgagaaggaagccgccgatatgaacaanaggtctttcaagtacgcctgggtgcttgacaagctgaaggccgagcgtgagaggggtatcaccattgatattgccctgtggaagttcgaggaccaccaagtactactgcaccgtcattgatgctcctgntcaccgtgacttcancaanaantgattactnggtacctcccanggctgantgttgcngtgctcatcattgactccaccantgggtggtttttgtggcnggtatcctccaaaggatggccagaccccgttannangcccctccttgc

SEQ ID NO: 97246 - DNA, 537 bp, Triticum aestivum
  unsure (1)..(537): unsure at all n locations
  Clone ID: PAT_TA_97246
ccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaagaggccggccggcanaggcgagcaccaggatgaggaggacaaagcaagcaaagcaccatcaacaacagttcaccaacaaccaacgtatcattaacaacccgccgcatgcnctcgcggggcgcgcgcgctgaataaaataaaaacaacgttcgtgttccgtantttgtttgccctgtncgtgtgttcgacaatnctgtcctcctcc

SEQ ID NO: 97247 - DNA, 565 bp, Triticum aestivum
  unsure (1)..(565): unsure at all n locations
  Clone ID: PAT_TA_97247
cagcaacggaaccaacaaatccccacccaatctcgtctccgatcgacccgaggctcgtcgaatccccaccgcctcaagatgcaagatatttgtgaagacactcacgggcaagaccatcacccttgaggtggagtcgtctgacaccatcgacaatgtcaaggccaagatccaggacaaggagggcattccgccggaccagcagcgtctcatcttcgctggcaagcagcttgaggacgggaggacccttgctgactacaacatccagaaggagtccacccttcaccttgtcctgcgtttgcgtggtggcatgcanatcttcgtgaagaccctcaccggcaaagaccatcactttggagggtgagaggctctgacaccatcngacaacgtcaagggcaaagatncaagacaaaggaggggaatcccccgggancaacaagcggccttaatcttttgcttgggaaacaanntggggggntgggcngcaacccntnccgggctnnaaaatncaaaaaaggngttccacccccccaacttggtggtnccccctncggtgggggganncaaa

SEQ ID NO: 97248 - DNA, 551 bp, Triticum aestivum
  unsure (1)..(551): unsure at all n locations
  Clone ID: PAT_TA_97248
gtcaaaaccgaatcagaaatctcaagctcancacancaacaatgggcgagcagaccttcatcatgatcaagcctgacggngtccaaaggggnctcatcggcgaggtcatcaaccgcttcnagaagaanggcttctacctcaaaggtctgaagctccaaaacgtggagaagtcgttcgccgagcancactactccgatntgtcctccaagcccttcttcgctgggctcgtggagtacatcgtctccggcccggtcgtcgctatggtctgggagggcaagagcgtcntcgccactggacgcaagatnattggggccancaancccctggnctctgagcccggnancanccgtggtgactttgccgtcgacatcggnaggaacgtcatcatggnnagcgactcaattntagaantgccangaaangggattccctgtgggtccccnagggcaattcaanagtggggggggaancaacaaaactggtttattanggcnnaaaantgtcatnaatggnttngtcnaggtttaatttgcaactacaaaatantcctt

SEQ ID NO: 97249 - DNA, 265 bp, Triticum aestivum
  unsure (1)..(265): unsure at all n locations
  Clone ID: PAT_TA_97249
gcacgaaacccctccgccgccganctcgcgtcttctcctggcgcatctcgggggggggttcctantttccacgaataaanctgattgctgnctaactccccccccaactnggggggaaantcttncccaaantgncgnctgancgtcaaaaaaaaactgggactcaattntgtggccnanggtgattaaaaaaaaantgaggtccctctggggtgnacccaaaagggnaaagggggaatcaacanaaatgnttnnatcttngcaa

SEQ ID NO: 97250 - DNA, 407 bp, Triticum aestivum
  unsure (1)..(407): unsure at all n locations
  Clone ID: PAT_TA_97250
gccagagtggagagctagctagngtgagacctcaagcctgacgccctctcgtgccacgacnatgccaccgccggnctcctggttctacaggctgcggcgcaagcgaggaggcgacgccggcganatcgcaagaggngatcgtgctccggnggtggtgaccccgccgccgtcgtcggtcgtcgtcncgggaggtgccggtgccgcctccgtgcaccccgaacagggcgtcctactacgtcnccagcggcgagcntggaagctgtcaagggggatttccgattccgcccaangcgccgggaacacgcanttcccgcncagnccgcnagncgagccgacancntcttcgacgtggtcaccntggtcgngggccgcggacgaccnggtttccgnccgggctcanggcgaat

SEQ ID NO: 97251 - DNA, 441 bp, Triticum aestivum
  unsure (1)..(441): unsure at all n locations
  Clone ID: PAT_TA_97251
cctcaatcccccaaacaatccaccaagcaaacccgatggnccgcacgaagcaaacggcgaggaagtccactggcggcaaggcgccgcggaagcanctggccaccaaggcggggcgcaagtcggccccggccaccggcgggcgtgaagaagcgcancgcttccgccccggcaccgtggggctccgggagatncgcaagtaccaaaaaagcaaggagctgctcatccgcaagctgcccttccagcgcctcgtcagggagatngcgcaggacttcaagaccgacctgangttccagtcctccgcngtgtccgngctgcaagaggncnccnaggcatanctggtgggggtgttcnagggacancaaactctgtgccatncacgccaagcgcgttatcatnatgcccaaagngattcaagctnncaaaacncancaagggggaaga

SEQ ID NO: 97252 - DNA, 301 bp, Triticum aestivum
  Clone ID: PAT_TA_97252
aacaacacaacatagcgcatgaaagctcacaagtattgcagcaaagtagttaccaagtgttgcaacaattatgttgtcagcagctgcggcagatccccgagcagtcgcggtgccaagccatcaacaatgtcgttcatgctattattctgcatcaacaacaacaacaacaaggacaacatcaacagtcgagccaggtctcctaccagcagcctcagcaacaatatccatcaggccagggctccttccagccatctcagcaaaatccacaggcccagggctttgtccaacctcaacatctgcc

SEQ ID NO: 97253 - DNA, 545 bp, Triticum aestivum
  unsure (1)..(545): unsure at all n locations
  Clone ID: PAT_TA_97253
ctcgtccactccgccagcagcttcgaattccgacctctgtctcccagatcgccggactcccggacctcctcgcttcgccatgtcggtcgccgcgctaagaagccagctcaacgagcacattagctacatgtacgccacgggaattctggacgagtactaccaacagctgcagtcgccacaggacgaggggttcgtccccgaggtcatcaacatcttcctcggcgacgccgacaggatgctcaacgatatcaccaagccttctgaacctgcccgtcgtcgacttcgaaatggtgtgcgaactggtgcaccagctcaaggcgtgcaactgcagtgttggtgctaagaaagttaacctcgcctgcgaagcactttcgccagttctacaaaggcaaaaagcaaaagaagggtgtctcaacggcaattgaatccttcttaagaaagagttctatgaatgtgcgccggcangctaacaaggcaatttgcaatttngngcaacaaaattgcaanccttgggtcctaaantancaattaatttgaagcccaaa

SEQ ID NO: 97254 - DNA, 554 bp, Triticum aestivum
  unsure (1)..(554): unsure at all n locations
  Clone ID: PAT_TA_97254
cctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggaagctccggcgggttcgagatggccggcggggagaccggcggctgcgactgcaccacctgcaagtgcggcaccgcgtgcggctgctcctgctgcagctgcaactgaaccggcgcacaagaggccggccggcagaagcgagcaccangattgaggaggagaagcaagcaatcatcatcaacaacaccaacaacccangcgtatcagttacactaaccgccgcaattcgctcgcgcgcgcgctaaatnaaataaaaancgtcatgtgttccttaagttctgtaagaacaatggtcctcctcaatgcctncanttntaatgaatatattgngncccaacnttntaaaa

SEQ ID NO: 97255 - DNA, 587 bp, Triticum aestivum
  unsure (1)..(587): unsure at all n locations
  Clone ID: PAT_TA_97255
ttggaatcggatctggtgcgaggaggaagaggaanaggaanangaagaggaanatgaacgtccgcgcatcnntgaaacggctgtgcngcttctgcaaggtggtgaaacnccnggggatngtcttcatccactgcacctccaancagaancacacccagcgccagggcttctccancatcncngcctncctcccanccccgccgccnnccacctccgnctccgccgccngcttcgccgaagcttccaatgtggccaangcangacatgtcaacnnaaattcaactgaccgctggggtctattcttnccatgttcaaaaatnggngacaactaatcacaattatnaantancaacccantccccnggtttttggtactnaaattcganttttccaantttnagngaattcctctcaaccaanaattccacnattaatcctgttnanccgatcnccaatnncttaaanctncttcctttcannggcttaataactngaanacaactattaatctngccccccaaaagttttaatncaacanaacctccttttcttttaaaaacacaaaaaaanaatnccatnaggaggnt

SEQ ID NO: 97256 - DNA, 546 bp, Triticum aestivum
  unsure (1)..(546): unsure at all n locations
  Clone ID: PAT_TA_97256
ggtgaccctagccgccgctccccgctccccgccgcgccaatccccgactccctgccgacccgtgcgcgctcctgggccctccgcggcgccgcccacctcgtcgcactcccgccgccgtcacccctcgccctcggctccctcggacccccgttgcgcctggccgtcgtgctgacctgccgctgctgactccgacgccggcggccgactgcccgatctcctccacctgcagctgctaatcgacatcgatccgtgctccttcatctgcgacccggttttcttgcaatggttttcggtggcggcttcaaatttttagtgggagtgggatgtggtgtctatgtagctcaaaaatacaacgttccaaatgtcaanaaagctgttcaaaaagtatgttttcctggcaaagcangttnaggaaanaaaacgttagcccgccgccgaagaaagacgatgactgattataacncccanggnaaaaagaagtatnatctgacttganaaaaaaaatatcntctgaaaaatggagtagntattaatgataattgcaag

SEQ ID NO: 97257 - DNA, 400 bp, Triticum aestivum
  unsure (1)..(400): unsure at all n locations
  Clone ID: PAT_TA_97257
gtcacgacaaccatttccccagcaaccccaacanccattcccactgcaaccgcaacaaccatttccccagcaatcagcacaaataattcctcagcaaccccaacaaccattccctctacaaccacaacantcattccttcggcaatcacaacaaccgttcctccaacaaccacaacanccatctccccaaccccaacatgtagtacaantaattccccanncaaccccaacaaccattccctctgctggcaanccaacctcangcanccttatccacancagnaaccatcaggnnnaattggtataggcatcgggggccanngaaatcgaagnngccatagntaccagcccggcgncntcatcgttgntttagttccntttgagtgttcnntgtaaccat

SEQ ID NO: 97258 - DNA, 376 bp, Triticum aestivum
  unsure (1)..(376): unsure at all n locations
  Clone ID: PAT_TA_97258
gctatatacctacatancacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgnaggtgtggcccatcgagggcatcaagaagttcgagaccctgtcctacctgccaccgctcaagcatggnggccctcctcaagcaggtcgactacctgatccgctccanatgggtgcccttgcctcgagttcaagcaaggnttgggttcatcntccggtgaagcnnganccgcaatccncctgggntaccaacatggccccgttaatgg

SEQ ID NO: 97259 - DNA, 469 bp, Triticum aestivum
  unsure (1)..(469): unsure at all n locations
  Clone ID: PAT_TA_97259
ccaaccaacaccgtcgtcgccgccgccgaccacctcctccctggaccgcgccctccatcgccgaccacatccacccacgaccgtgctctccacctcccatccctccgccgacccaaccgccccttctccagtgaagaaatgcttgatctcggctagcggctggtagtggcaagtgccttcatgacggacttggtagctcccggatgctccttctccaaagccttgggcagngcaccgccggcacatctcgccaccgttctcgcgcctggtcgttgcctcatcccagnncgctgcaggttgctnncgttctcggtcctcgaccaaggtccgccggccttcctttaccctangtcgctcnggncctttgctcttcccttannccaaggagctcngagggctccncctcaanattcgaccggggtttccaagctcccaagcctnccccttanggtatncnttcccaccgcct

SEQ ID NO: 97260 - DNA, 488 bp, Triticum aestivum
  unsure (1)..(488): unsure at all n locations
  Clone ID: PAT_TA_97260
ccacacctcatctgccccaattcctcccgcgcctccccctcccctgccccgggaaccggccgtcgtgccaccaccggtcccaaatccggtcgccgtgccgctctctccccgggattcgactgccgcgccgncaccgcccccggatccggccgntgcgccacccccgtccatgaatccgaccgccgcgccgccttttcccccggatccaatctcgccgcctgcctcactgcgcgtcgncggagttgaacangctgancgctgccgccacgccaangattnatgctcgaagtccaancacctgttcgagnctgattctcccttngctccctccccccgagnttcttctcntccctctgtcngcctaaagncancccacgntttnagagggcggtcncctccaccaattaaactcttcnccgacntttccccctatcaaatgtctctnttgnacttttcccaanacacttncccaggttngngcgncactg

SEQ ID NO: 97261 - DNA, 480 bp, Triticum aestivum
  unsure (1)..(480): unsure at all n locations
  Clone ID: PAT_TA_97261
aactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgtggccccctccaagggcaccccgtcgttcgaggccgccgccgagaacggagggtgcaagtgcggccccaactgcacctgcaacccgtgcacctgcaagtgatccatgangcctcaatcaaancagatcaaggaagatggcattggatggaccctgatgaangagcgagtagtaagtttgcatgaatcgcaaggcgtggtgtttccgctttaantttccaccccantnttaagacgatattctatcgtatcgcnaccgaccnnattaatncgnnttaccccgtgacccnttgtngggcttgnaccngttgnncttgtgtnaaggnt

SEQ ID NO: 97262 - DNA, 285 bp, Triticum aestivum
  unsure (1)..(285): unsure at all n locations
  Clone ID: PAT_TA_97262
cgccctcccccctcccctggcgacctaccaccgccgcccggccancgccgtgcnntagccccgcctcgccgccggaggcctcgtctccccatgncccctccntccctccgcctctcacgcgtctccgtcgcctcctcnncctctgacgcgcgtccgngtcccgcatcnccgcgaccccgcccgatcccnngcttgnttgntgcatccattcgtacagtatgtcggagangccatctgannatacgactggtnagacnganggcctgaatggagatgtttctgatg

SEQ ID NO: 97263 - DNA, 383 bp, Triticum aestivum
  unsure (1)..(383): unsure at all n locations
  Clone ID: PAT_TA_97263
gccgcagccccaacaaccgcaacaatcattcccccaacaacaacggncattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacagctccagtgcgcagccatccatagcgtcgtgcattccatcatcatgcagcaagcagcagcancaacancaacaacanggcatgcatatctttctgccactatctcaagcaggaacaaggtggggtcaaaggttctctaagtccaaggncaggggcatcatccaa

SEQ ID NO: 97264 - DNA, 383 bp, Triticum aestivum
  unsure (1)..(383): unsure at all n locations
  Clone ID: PAT_TA_97264
cttgaggttgagagctccgacaccatcgacaacgtcaaggccaagatccaggacaaggagggcattcccccggaccagcaccgcctgatctttgctggnaancagctggaggacggccgcaccctcgccgactacaacatccanaaggagtccacccttcacctggtgctccgccnccgtggtggtatgcanattttcgtgaagaccctcatcggnangaccancacccttgaggttgatgagctccgacaccatcnnacatcgtcaaaggtcatngntccanggacaaggagggcattcncccgggaccagnatncgcctgatcttcggtgcgnaaancaagccggnggacggncgcacccttgtangcttcaacanttcag

SEQ ID NO: 97265 - DNA, 269 bp, Triticum aestivum
  unsure (1)..(269): unsure at all n locations
  Clone ID: PAT_TA_97265
attgactccgtcctctcaaaacaaacgcatgcacctatggaggggagaagcgctctctgcttcctcgtcgtgctcacccttctagcagcangccccgctcttgcagcagagagatgcgagcaagagcaattcttctcccggatatgcatggactggttgtgcgcncaggagtgcnccagccagaacccggacatgagggtcaaaggcggnccactgcaccgccaaggnggtcancgcgctattgncacctgcaccatgtgctatacgta

SEQ ID NO: 97266 - DNA, 347 bp, Triticum aestivum
  unsure (1)..(347): unsure at all n locations
  Clone ID: PAT_TA_97266
gagagatccatggnggtgactccggcggncagtggaggaactgagcggcggggccctccagttatcgatctatctaccatctcgtcgtcttcgncagcaagttatcttcagttcctgtgtcacgtcagtctgagtcgtcgtgtgtgtcnttgagtcctgtggagtttttgatcgcgagctcgagngtcgctctgtccggggttaattagagctgggttacccgaggaagaancaaacatgtnttatcnttcaagtcttggncgngtcgggncgtcggtgatgnagcaaatcccttnctgtcatggnttgggangtngtgcttnnaatatccctaggtttcganctcc

SEQ ID NO: 97267 - DNA, 271 bp, Triticum aestivum
  unsure (1)..(271): unsure at all n locations
  Clone ID: PAT_TA_97267
cttaatgtttcatccaatcaaaagtctatgcagagaaccgaaaagacaccctattgtaggatatgtctatagtgcagtccatactaagcatacgtgctctgagaagttaacaacttgacatgtatantgcttcctcatgattcatgatctgtagctcgaactagaatgagancagcaggagtcagcaacccggtgnnagtggnttgcctcggtcattcctgctcggagagcaccccattgtgtcncctacatgacgatgnnttcctcnaga

SEQ ID NO: 97268 - DNA, 504 bp, Triticum aestivum
  unsure (1)..(504): unsure at all n locations
  Clone ID: PAT_TA_97268
tcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaaggggcagcgccttccaccgcgtgatccccgacttcatgtgccagggcggcgacttcacccggggcaacggcaccgggtgcgcagaagtccatctncggngagaagttcgccgacgagnacttcgttccacaagggacacccaagnccngnggaatcctctccatggcacaaacggcgnnggnccaaacaacnaaangggctcccaaattcttcaancttgncaccgtccccttgcnaatntgggcncgncnggcaatnacnttcttcttnct

SEQ ID NO: 97269 - DNA, 222 bp, Triticum aestivum
  unsure (1)..(222): unsure at all n locations
  Clone ID: PAT_TA_97269
cagcaacaatcaccccaacancagcantttccccancancanttcccccaacagcaacaattancgcancaacaattcccccanccacaacaaataccccangcancaagaattcccccagcaacantcaccccactcancagcattttccccaacagcacttctcccaacancagcatgttaccgcaacancacttcccccangccacaacanattcccca

SEQ ID NO: 97270 - DNA, 356 bp, Triticum aestivum
  unsure (1)..(356): unsure at all n locations
  Clone ID: PAT_TA_97270
ccgcctcctctgcgccccaaaccctagctcgcccgcagcgccgcggcctcctccctcccatcctccaccggcagccatggcgacggagctggcctacgcgccgcccatgaagtcgggcaagctcgggttcgagggaacccaggaggtgcagcaccgcatccgcatcaccctctcctccaantccgtcaagaacctcgagaaggtgtgctcggatctggtgaagggccccaaggagaagcagctcatngtcangggcccgtcaggatgaccaccanggtgctcaacatcaccaccagnnangtcccccctgntnggagnaggnttccnaccaccctggngnatccggtttgnagatg

SEQ ID NO: 97271 - DNA, 328 bp, Triticum aestivum
  unsure (1)..(328): unsure at all n locations
  Clone ID: PAT_TA_97271
gattcctcctcgtcgccctcccccctcccctggcganctaccaccgncgcccggtcacngccgtgccctagccccgcctcgccgncggcggactcgctccccagacccctccctcngctccgcctcccangcgnctccgtcttctcntccgcntctgacgcgcgtccgcgtcccgcatcgccggcgaccccgcccgatccccangcttgtttgagcatcnattcggnaaagtatgtcgcagnaancctatctgattgatacganttggcncaaggntgaggccnganaggaagatganttctnatgncanagtggtanactcgtnaaa

SEQ ID NO: 97272 - DNA, 484 bp, Triticum aestivum
  unsure (1)..(484): unsure at all n locations
  Clone ID: PAT_TA_97272
cccatcccccaagccataaacccaagtcggactcgccttcctcctccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaanggctgcatgtcaactggaccacacttcaaccccgctggtcatgtgnatggggcacccgatgatgaaatcccgccatgctgggtggatcttgnaaaatgtgacanctggannggatggtgtttgctaacaatcaaatgtttncctggtctgnccacatnccccccttaactgggaacaaaaatttcaaattggttgggccgtngttcggtt

SEQ ID NO: 97273 - DNA, 450 bp, Triticum aestivum
  unsure (1)..(450): unsure at all n locations
  Clone ID: PAT_TA_97273
ctaggacataaagttgacaatcagtacatgggttcatgctcgtatcacccaggacgacagagccaacgcagtggccaattcctggccacactactagttcagccactagctacggaagcatggatctgaaaccagaaaaaaaaatcgacgatcgatctcatccgcacgcggcgaaacagatcagcagggtggtcgtatgactccaaaggtggtggtgaccggtgactccacctccctcagtttgcagcagcgttcgtttgctgacctgatgctgctgccgcccgccacattcccggtgcccctcttctttctcacgcacgcgctcaccggctgttncanccagcacgaancagtntggcggggcacaanggccaaaaacacctggntngcnttgatgnttttnccccacgggncngtgggggggaactgngggcctcggtccgttgggaa

SEQ ID NO: 97274 - DNA, 481 bp, Triticum aestivum
  unsure (1)..(481): unsure at all n locations
  Clone ID: PAT_TA_97274
gcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtcgacggctacagcccaatctacacgccagaggaatggtctgaatctggtgaccgctacnccgggggaacgaccgggcttcttatctgggccgtcaccctcgccggcctcctcggcggcgggggtcctcctcgtctanaaacaccaagcgcttctcgcccggctnangagagnaatctaccgngttaacanaagggccggggtcnctngctttgatngaacgtntcctggnaacccaaaaataacttacccttcccggtga

SEQ ID NO: 97275 - DNA, 429 bp, Triticum aestivum
  unsure (1)..(429): unsure at all n locations
  Clone ID: PAT_TA_97275
gctgaataaatatcaacagatgccaaacggggatcccaagttcaagcttcatatgatttgtgttgtgaatgatcgggtccgcggccctgctccatggcctcctcatcgccatggccactctcatgtcaacttcgtggctacttccaaaagccctggtggtgaagctcctactttattttttgctgaaattaacgcngacaaccgaagcatgtccttctgttgccctgtggatctgccgccgccatgtgctggnacgctntataaacanccctaaaanagggcaagccnggngcatgtagctcccgcttgcncagggtccggggaagggtccngaccacttttggctctacangtacgnagccnttcccctannaatttcngttaaaatgcctgtttccaanacattgaancccggngncctcangggcc

SEQ ID NO: 97276 - DNA, 305 bp, Triticum aestivum
  unsure (1)..(305): unsure at all n locations
  Clone ID: PAT_TA_97276
ntttttttttttttttttttttcaaaanaagatacttgtacnttatttactaaggagcaanggaagttctgatttacatacnaaatacagnatgaaactagattttcgttcaaacctattanatcgntcgactacantccattcaaacaacctccaatatatatanttcaacgangcactntttccccaagctcaggcgangatgggtttgggcggcaattccttgccggcanggaaggtgagcnaagagccggctggcctgcanagggcngtgacggtncggcacnatatggncggagccgccg

SEQ ID NO: 97277 - DNA, 485 bp, Triticum aestivum
  unsure (1)..(485): unsure at all n locations
  Clone ID: PAT_TA_97277
ctccctttcctgccttctcgaggagcctcgccgactgccgccaccaccaccaccccaggacgggatggntacagaggcggagtggagggattgggcggagctgccacgggatgtgttgctggcggtgctcagcaggctggaccacatcgagatcctcatggggccggacatggtgtgcancccatggcgcagggctggtacggacgaccccgagctgtggcnccgcatcgatatgcgctttcactatgccggntggcttctacctcaactcgaggaaattgcttcagatgggtnaaanctgccatgaagcgtanttgcggggtcggttcgaagccntctgggggcggngagctacntcncangaaaaggatnctctncctgggtcggnaaacngcngacgccatccctttaangagccttcgaattcaatcngantgncggttnacattggtngaacccggaccttnaaaggnnggtggntaacn

SEQ ID NO: 97278 - DNA, 450 bp, Triticum aestivum
  unsure (1)..(450): unsure at all n locations
  Clone ID: PAT_TA_97278
gttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggnttcgacaacatgcgccaggtgcagtgcgtcagcttcatcgccttcaagccaccgggctgcgaggagtccggcaaggcctaaacagctcactcaccacgggccacatataaaagtgccattgcggttttgtcaactctgacattgctttgggttttccttctccatttatctttcttggtttgttcctaagaatacngtgnatgtccatgttcaatgtnccnaacatgtctccgaagaaagnnatgcctcggtatgtggaatggcaatcccgtgggcttatgntantc

SEQ ID NO: 97279 - DNA, 447 bp, Triticum aestivum
  unsure (1)..(447): unsure at all n locations
  Clone ID: PAT_TA_97279
gcgccggtctgcccatgtacccgccggaggtgcagctccagctcgcgatcaccaagcgctgccggtacgccgacttctcgcccccgcagcaatcagcgggaagcaatgtcctggacgccaccgatgcggggtacaccagcgcccgcccgccgccgctcgaccttgccgggcagctcgccatggccaaccggccggtgcagttcctcgcccagacgcccttctccgcgccgtcttccccgtgggtgaagccgtcgttcgcacgcaacgcgcgctacttccagtttccgcattcatcgcccgtgtcgccgacgacgccgggagctctcgttgggccaccgcctgcccggtggcaaaccggganccgggttcactctctctctccgtctccngggggccaagggggggngctcccttcaatgccaaatttgccgcccgggcggtcaccgg

SEQ ID NO: 97280 - DNA, 444 bp, Triticum aestivum
  unsure (1)..(444): unsure at all n locations
  Clone ID: PAT_TA_97280
gccacttccctccctccctccttccccgcccggatcgggctcgccggcaccgcccatggcgtcctcctcggcgctgctcacgggggagcgcctcgtcgtcttcctcttcgccgcgcgcgtcgcgctcgccgccccggcccgcctcgcggccccgctcgcgctccttgcgggagccgccctcgccgtcgagctcgcggtggaccgctccgccgcggccccttcctccccgctccgccggttcaggacaaggccaaggtgcttcatcaggnattcttcttggnggcanctactttgccatgtgtcatgcttgnacggntaatccagnctttcgangatcttaccgacagatcccaatggagcacaagaatttgnatacctcgaaaatgcnagtatttgggcagtaccatcaaggtgngccagtttggntggggtntccntcctttc

SEQ ID NO: 97281 - DNA, 456 bp, Triticum aestivum
  unsure (1)..(456): unsure at all n locations
  Clone ID: PAT_TA_97281
ccccgtcccactgaccgacgcgacacgcgcggaaagcaacgcgcctccaccgcccccgctcccgccctccctcccataccgcctcccgcccactccgaggcaggcagacgcggccaaagcaaacagtgtagaaggagccgtagtaggtatgtaggctcgagacccgtttggccggcggcgatggtgtcgacggcgctggacgcgatggcggngacggcgtgggggcggtggctggggctggtggcggcggtgtgggtgcagtgcatctcgggcaacaactacaccttctccaactactccgactccatcaaagacgctcatgggcctcanccagctgcaggtcaacggggctctccgntcgncaacggatntcggcaagggctttcgggncctncttcgcnggnggctcgccctccgaaccgcctccccnccctgggcttccntcctcagccattc

SEQ ID NO: 97282 - DNA, 444 bp, Triticum aestivum
  unsure (1)..(444): unsure at all n locations
  Clone ID: PAT_TA_97282
ccgaggcggaggtcaggcaggtggcgccggagctgctcctcctcgccggcttccccgtcaaggccgcatccttcttcctccgcgccggccaggggtggctcgacctcggccgcgtcgacctcgccaccgcctgcttcgacaaggccacgccgctcgtctccgcgctcgccacggaggatgagcgacgcatcctgctcggcctcaacctagcgcgggcgcgcgcggcgtccgacgcgggcgatcagtccctcgccgtcgcgctgctcggccgctccaagtccctcgcgtccctcgcgtccgtcgccccgcaagtatacnagatccctcgccgaggggtacctgtacgtcggcgaggncaagctcttcgccgaagccctccgaacccgccggtcggtancgtccatggctcctcaccganggcgctaagatctcttcaagaaagtc

SEQ ID NO: 97283 - DNA, 462 bp, Triticum aestivum
  unsure (1)..(462): unsure at all n locations
  Clone ID: PAT_TA_97283
aaaagactcatcgtcgacccgggcatacccgagccctggtaggtttggctctcctccctcgggcggcggcggcggcggcggcggctgaatctcctgccaccggagtcccttctctttaccggccggtggattggctccaccctccctcccaaatcccccgcccccgatcttcctcctcctccgcgccctacatcgcccccggcgcctgagcacacggncgcngtcctcctcctcgnctatgaagcccgncgnccccctacctccttccctccaacgccgcctaccgccctgcttcacttccgaanacgntgggcccgccctgcttcgcctccgaatcaaatttaggggtcaagtgggcccagcttntgnaaaatgcnttcaaaggncaancgctntcttccnaaccanaaanaaccttggtgntnaagttctaatcctggggcctganngattccaacattc

SEQ ID NO: 97284 - DNA, 270 bp, Triticum aestivum
  unsure (1)..(270): unsure at all n locations
  Clone ID: PAT_TA_97284
gagngagctcccgancagnagcggcggccggcctccctcccccgctcgcgccccagccgctcgcgccggnccggncccccgccgtccctccccctccatcggtttcgggggnaggcattgcgccgagcantaancacagnccaagacaatggttgctcaagtcctttaccgtcganttggtncaaacctcttgtagtttcaaggnttggtnatcgtggganggaacaangtttcatngaactgngntttacccacgccaattgttatcta

SEQ ID NO: 97285 - DNA, 462 bp, Triticum aestivum
  unsure (1)..(462): unsure at all n locations
  Clone ID: PAT_TA_97285
acgacgtggccacgctcgccatcaagggccgcgccgcgcacctcaacttcccggacctcgcgcacctgctgccccgcccggccagcgccgcgcccaaggacgtccaggcggncgccatactcgccgcctccgccgacttcccctgcggcgccagtgccaatgccaagagccccgacagcgcctccgacgccagcgcggtctcgccgccgcccccgcctgcaccgcacgccgagccggtccaagacccggaagacgccctgttcgacctccccgacctgctcctggacctgagatatgaggcctcggcgggcctcccgtngcgcgtcgtcctgggtcgtccacgaaggacatcgtcggcnccgggggtgttccgccctccgaaggnagncaactccttgttggggaagtanctggattcaatcgtccgctggcangcaagaaaggttcccanccgtttccaac

SEQ ID NO: 97286 - DNA, 487 bp, Triticum aestivum
  unsure (1)..(487): unsure at all n locations
  Clone ID: PAT_TA_97286
atcccacctcacatcccatctccccacacgctcgaaccaccagcagcagcagcacccatggcacccaaggcggcggngaagaagcccgcggagaagacgacggnggggaaagaagcccaaggcggagaagcgggcgccggcgtccaaggaggccggcggcgaggggaagacgaggggcaggaagaanggcagcaaggccaagaagagcgtggagacntacaagatctacatcttcatggtgctgaagcaggtgcanccgggacgttgggcatcttctccaaagggccaatnttccatcattgaactccttcatcaagcngacaatcttccgaagaaagctccgcccggggggagtccngcccaatgcttgggccccgctacaaacaaggaatgnccaaccaatcaacggtccccggggnagattccaagttcctccggttccggccctcgttctttcccccggggggagnctctgccaangcaactt

SEQ ID NO: 97287 - DNA, 419 bp, Triticum aestivum
  unsure (1)..(419): unsure at all n locations
  Clone ID: PAT_TA_97287
ccgtcntcctcctcgtcggcgcccgaagaacccgcatttactggcggcaggaacggcagcgccgtggatcgcgtcgatctgacgganaagggcccggngactgccggntctcgagagcccggggtgccggaggcggtctccanaaaggagcacgccganaaggcgccggcgccggccaacacctcggcaccaatgccatctcaggganaaaggaanatcaacagcaccancantgtcgccgcnggtccgatgatnctgcgacnaaaatggcntgnacgaggggtttcccctatgcgcggtcggcggtctgcangctgtctgngcgacatccgcgtnanccccantcanaangacaatgtncctcgtcancccgtccnnnggcgggctngnttctantantaaggggcgaagaagcggct

SEQ ID NO: 97288 - DNA, 434 bp, Triticum aestivum
  unsure (1)..(434): unsure at all n locations
  Clone ID: PAT_TA_97288
acggggagatcatcgtcgccccggcagtggcgcgggacggccgcggtggcgtcggctcgtcgtcctccggcgcggccggcgccagcagcctgtcgcagatcctcagcgccaagctccgcaagtgctgcaagacgccgtccccgtccctcacctgcctccgcctcgacaccgagaagtcccacattggcgtctggcagaagcgcgcgggcgcccgcgccgactccagctgggtcatgaccgtcgagctcaacaaggagccggcgacagcggcggcggcaccaacgcccaagcgacagcacggtgtcggtgactccttgctcgtccacgtccacgtccacaacgggctcgccgccggaggcaatggaggacgaggagaggatcgcgctgcagatgatcgagganctgctgancaggagcancccggcctcgccctn

SEQ ID NO: 97289 - DNA, 483 bp, Triticum aestivum
  unsure (1)..(483): unsure at all n locations
  Clone ID: PAT_TA_97289
caatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccaacttctcaaggggaagtttgtttcaacaacctgattgttgtccgaggcctngcactgggtggtgaaatgttgncggttatngnttgggtgggattcccccaaggaaagggaaggggattgggaaaagggaangggatgtttatgaccaaaaaatngtttnnaatctnacaaaagctnaaagcaatcctgctccttggaancccnangcaacccccaaacctgcnaagggtttttggttggttgccaacccancnaaaaanaccaatncntcccaatccnngnaagg

SEQ ID NO: 97290 - DNA, 447 bp, Triticum aestivum
  unsure (1)..(447): unsure at all n locations
  Clone ID: PAT_TA_97290
tgacaccacatacaacttaggatgaggatttcatctttgacgctactcctaacccttgcctttcttgtgctagcatcaaatgcgaaaacaaaaccaggttgtacggtcgtatacttgaagaagtttggtgggtacttgattggtggttgtgaggacgattgccacaagaagtataaggcgaccattcactgctctgacgatatggcgtgcgcttggcaagccgatattgatggcagcaggtgtaagtgctcaatgtgcatattctcctccaaggctccagcagaggaaactgtgatgttaactagctaaatagtgatcagtgaacattcgctaaaagaacagatatgccataggatgtgggtgtagcaagcatgactatttcgctagaaatccgctatacaacatannttcagtattgcacctttgagtttgtagaatttatcangn

SEQ ID NO: 97291 - DNA, 359 bp, Triticum aestivum
  Clone ID: PAT_TA_97291
atttctccaggctccacactttccccatccccttcctcagccgcggcaccggcgaccaagggcggccggagaccagatcgtgaggcatggattgggatggcgtcagatccagggtgggcgccctcgaggccaccacaccctgcaggcaccatccgccgctaccttgccgtccgcacggcgaagggaggcgggcagcacctgcgacagccgctggccaagagcaccgtcacaccacctcttgaggccgctgcctcggttcgaaagcccccgtgcgcggcagggcggacagattctcgccgccacttttctcgacggccgagcggcgtttcggtgaccccctttgatggcgggcggtggga

SEQ ID NO: 97292 - DNA, 284 bp, Triticum aestivum
  unsure (1)..(284): unsure at all n locations
  Clone ID: PAT_TA_97292
gccgcctccagcctanggtttcctcccgccgcccgtccgccccacccgtcgntatggnccgccgnanctggaggaggaaggtcttcccgcccctgctccacgtgctgctccagtgagaancccaccaagcgtccaagcccgtntaagctcctccaccnggnaccacccacagcancggtggcggttatcattgacgtgggnttgggctccancaattgctcaatggcatgcgctttcnggttngtgggcaagtgccattggcntcacanggcctggtttgcatg

SEQ ID NO: 97293 - DNA, 438 bp, Triticum aestivum
  unsure (1)..(438): unsure at all n locations
  Clone ID: PAT_TA_97293
accacancaaccattcccccaacaaccacaacaacctttccccctacaaccacaacaaccattccccctacgaccgcaacaaccattttcccagcagccccaacaatcacaacantcatttccccaagccccaaaccccagcanccccaacaaccatccatcctgcaaccacancaaccatttctgcagccccaaacaacaattattccagcaactagaacanacaatttcccaagcaaccccaananccattcccccaagcaaaccacaacaannctcaacaatccatntncaaaacaacaaccatnatggggagtaagncttaacagncatccggtgggccaattgnaatgaagacctggttatacaaagncgggttggggttaacngtgnttagnccatgggtggtnaatgttaccgatgnntnaattaagtgaa

SEQ ID NO: 97294 - DNA, 440 bp, Triticum aestivum
  unsure (1)..(440): unsure at all n locations
  Clone ID: PAT_TA_97294
agaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaaagtgtcaacttggttgccaattgacatctttaatgggaagaagcttgagggatatcgttccttcatcccaacaactgtnacntcccccatntttgaccggcaagattatcaacttgattgaaataactgatgatggattttcagcttctaactngagaagtgggaaaca

SEQ ID NO: 97295 - DNA, 436 bp, Triticum aestivum
  unsure (1)..(436): unsure at all n locations
  Clone ID: PAT_TA_97295
gcanncgccncctcctcggatcttccctgccgganagacgcnananagagcgagcaaaccctaacctcngacgatggtgctgcagancnacatcgaccncctgaacccgccggnggagctcgagaagctcangcacangaataatcgcctcgtcnagtcccccaactccttcttcatggacgttnaaggtgccaagggctgcttcacacatcactactgtattcacgccactcccactactgtnntggtgtgcccaggctgctnaattccagtgctcttgcnatccancgnggngtgnacgggtnanggctaatcnagcggtttgnttccttccgccgncanaggggcntaantaangccntccganagtcctatctnnaacaaaacgcancccccgttgngttgnngttttgnagttttntccaagggggtgggt

SEQ ID NO: 97296 - DNA, 288 bp, Triticum aestivum
  unsure (1)..(288): unsure at all n locations
  Clone ID: PAT_TA_97296
gtgacatggcgagtgtaagccaactatgtacctttccccttattatcatccaatacactcatggtccgactacggtaccaaaataaaagatcaaccccaacatgcgacacggtcncgatcgccccaactgggcaccactactgatcatcagggaaagacacatagtaacgacgcgagtcttcgtcgaactcccacttgaggctcaagcgcattatctggaacggaatcatcgggccctgcatcttgtttggaagtaatctgtgagccacggggactcagcaatctcgc

SEQ ID NO: 97297 - DNA, 463 bp, Triticum aestivum
  unsure (1)..(463): unsure at all n locations
  Clone ID: PAT_TA_97297
gccaacaccactcctagagagtcctcgccgccggagaagcagcaagcaagatggccggaaggaaggccggcgacaggaagaaggcggtgacccgctccgtgaaggccgggctccagttccccgtcggccgcatcgggcgttacctcaagaagggccgctacgcccagcgtgtcggctccggngcccccgtctacctcgccgccgtcctcgagtacctcgctgccgaggtcctggagctcgccggcancgcggccaaggtcaacaagaacgacncgcatcatcncgcgccacctgctgcttgccgttccgcaaacgaccaggaagctcggcacgctgctcgnccggcgtcancaatcgcccaacggcgggtgtnnttccccaacatncaanctcccgtnggctgctttcccaagaaantnccccccccggccgncgangaagggagggnaaggtccccccantc

SEQ ID NO: 97298 - DNA, 246 bp, Triticum aestivum
  unsure (1)..(246): unsure at all n locations
  Clone ID: PAT_TA_97298
gttcaggccagtattagtaaaggtaccaaggtgcagccacccgatggcgatggtccatgaggcgaggcagggccggcgagggcgccgggtgcggcacgtccggctggggtcgctgctccggctgcgggtgcggntgttccggctcgccggcctcgtcgtccggttcatggaggagctcaggtgctgccctgggatcaggaggcggcccgcgccgagatcagnggnacggccggcgcnactgcgcgc

SEQ ID NO: 97299 - DNA, 166 bp, Triticum aestivum
  unsure (1)..(166): unsure at all n locations
  Clone ID: PAT_TA_97299
gatanttcanccatggngaccaagaggcagagcaaccatccctctcctcttcctccctgngcacaagccttctcttcgccgcggctgtttcggcctcccatgacgaggangatgacaggcccngtgggcgctcgcttcancggtgcgtgcanccggtgccagcagg

SEQ ID NO: 97300 - DNA, 211 bp, Triticum aestivum
  unsure (1)..(211): unsure at all n locations
  Clone ID: PAT_TA_97300
ctttatttttgttcaatacatctggtaagctgcacactgnctaatatgtgtcacaaatgacaaagttgcacactgtctaatatgtgtcataantgncactangatctcattacactctacatatgcagnatcantanaaacganaccatcagtantatttgggtactctcacacaaatcagtgttaggcgtgcaacgatcccccaccacat

SEQ ID NO: 97301 - DNA, 251 bp, Triticum aestivum
  unsure (1)..(251): unsure at all n locations
  Clone ID: PAT_TA_97301
gtcactgtgtgtctgtgtccatgtctgtaccttgcgcacacactgtgtgtgcatatatatttatgcgacatgtatgcatgcgtccgtatgcgtgagtgaactgtcaactctttgctgtactctagtgtagccgatgtgtacgtgtgatgtgcctgacctacttgttcaggcaattaatgaatagtaattattttcctaaaaaaanaaaaaaaaaaaaaaaaaaaaaaaaaaaaaaaaaaaaaanaaaacaa

SEQ ID NO: 97302 - DNA, 570 bp, Triticum aestivum
  unsure (1)..(570): unsure at all n locations
  Clone ID: PAT_TA_97302
cacgatcctagatctcagcggaggcacctactccactccctccgctctcgcccccgtagccggcgaccttgtctcccaccgccgcccctctcatcccccctccactcatcaacgacggctagatgcgcacactaccggtgaccaacatcatgcaaggtcgccactgccgtcgtcgaaggatagtcttcccacatcgctagccgcagcctccgcctcgccccgatcctcgtcctcctcgaccgccactcgctctccttggcagcaactcaccgcctccctgcccatgccgtgtccgccggacagccctactcatgccgacctcgctaatcatgcggtagcgcttggctgtgctcaacttgtcctccgtcggcgtcgcgggccgcaaggcaagttgaactacaactccgctggcaatggcgaaagantcctttctggtggctcctaataactcgnggtggantcctcctccccccaaanttgacatccaacccttttgtcanncccgncgtggcnacgaaatnaagaaaatggggttaaaccgactctgggtnangncaaacnctnatnggg

SEQ ID NO: 97303 - DNA, 563 bp, Triticum aestivum
  unsure (1)..(563): unsure at all n locations
  Clone ID: PAT_TA_97303
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcaacacggaggccctccttaaagcaggtcgactacctgatncgctccaagtgggtgccttgcctcnagttcaacaaggntgggttcaacttccgtgagcaaaacgcaacccctgggtnctaagatgggcggtactggacaatgttgaaactgcctatgttcggatgcaacgacgccacgcaagttatnaacgaagtngaggangtcaaanaaaggataacctgacncctaagttcgcaacaatcggattcncaanaatgngtcaaggggnaatggntcancttnaaacncctntaaaccaacnggcnttcaaggaatccgg

SEQ ID NO: 97304 - DNA, 595 bp, Triticum aestivum
  unsure (1)..(595): unsure at all n locations
  Clone ID: PAT_TA_97304
gtgcagccctgtggcaatgccacaacgtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcaagcaactcgggcaacaacctcaacaacaacaattggcacaaggtaacctttttgcaagccacaccaaatagctcaactttgaggtgatgacnttccantgcgctccgtttcctgccaaacgatgtgcaagtggttaatgtgncgtttgttcaaaaancaaccaataatggtggcnantccaccgttgggaaccgggagtttggnggcctacnggataaagggaaaggntntcnaagtaatanaanaanttggggncaccgnttgtttaatccaatgggtnatntccaatccaaccggtgacnaaataaaatggtccaacaatgtcnntgnttgaccc

SEQ ID NO: 97305 - DNA, 577 bp, Triticum aestivum
  unsure (1)..(577): unsure at all n locations
  Clone ID: PAT_TA_97305
gggtactacccaacttctccacaacagataggacaagggcagcagccaggncaattgcancanccancacatgggcaacaagggcatgcaaccaggacaagggcaacaaggtcaacagccaggagaagggcaacaaggtcagcagccaggacangggcagcaaccaggacaagggcagccagggtactacccancttctttgcagcagtcaggacangggcaacagccaggacaatggcancanccaaggacaaggacanccagggtantacccaacttcttcgntgcagccagancaagggcaacaagggtactncccaacttctcagcaagcaaccaaggacaanggcccgcaaccaagncaatggnaacaactcaaggacaaggggaacaaagggtactacccaacttctccgcaancaatcaggacaanggnaacaagccaaggacaatgggtngcaaccaaggncnatgggctgccatcaaggtantaccctacttccccgncacaanttaggccaanggcaacaagcannacaattgttgcaacnaagccagggcnacaagggtactcccn

SEQ ID NO: 97306 - DNA, 594 bp, Triticum aestivum
  unsure (1)..(594): unsure at all n locations
  Clone ID: PAT_TA_97306
ccaccccacccacccagtccatcccccgtcgccctcangctcttcntgctcgccgcctcccttcgcgtgntgcctcatggcttccatcgccggatctgccgtgtccttcgccaagcccgtcaaggcaatcaacacgaactcgctctctttctctggtccaaggaggggcaatgcatttcttcgcctgcagccagtgccgatgagatttgctgtttgctgctcagcaaagcangatacaatggataaggtttgtgaaattgttaaagaagcagcttgctgttcctgaaagcactgaantttgcggtaacaacaaagttctctgaactttggngctgattcactgggacaaccggtcgaaaattgtgatggggcctcccaaggaagaatttcaaaattaagtgtgggnggaaacnaatggcgcaaggcaaatttgcaaaaanttgaagaatgctggcaacnctcaaccnacaaaccttttctccngnnaaattatccttgaaagggaanggccgnaaatccctaaaggattgggggcccngtaanccaanaaanccnaaccntggggtgatccntggtggtttnaacaaaaancng

SEQ ID NO: 97307 - DNA, 573 bp, Triticum aestivum
  unsure (1)..(573): unsure at all n locations
  Clone ID: PAT_TA_97307
gccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcaaggcatggcttttcggtactgggaagttgccaatgggcgcaaaanggcttgttngattgctggtgatnggtccccgttccaatttaagcatgaagactggttgtcngtgaggnctgcttgcaatctaatgactccaatggaacaatggctggctggatgacnaatgtggnaaaccttccaagggcttccaaagattggatcaaccaataacgggaacgaatttaacaaagtgccaantccaacntngaaatgcngaaacgantngcccccgttgaggggagcaactcctttaagctacnannttttgcntngattgggggctaaattgggaanaacctggttttcagtcaagnatggtgntg

SEQ ID NO: 97308 - DNA, 580 bp, Triticum aestivum
  unsure (1)..(580): unsure at all n locations
  Clone ID: PAT_TA_97308
aagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcaagcttcatcgccttcaagccaccgggctgcgangagtccggcaagggctaaacagctcactcaacaaggggccanatataaagtggccatttgcnggtttgtcaactcctgacaattgcnttgggggtttnccttcccaattaaccttcctggttgggtcccaaagaaaaatgtgttttgccaatggttcatgttacaaaatgtccccgannaaagcatgctncgtatgtgaattgcaaaaaaaanggggggggcccggtanccaaattn

SEQ ID NO: 97309 - DNA, 592 bp, Triticum aestivum
  unsure (1)..(592): unsure at all n locations
  Clone ID: PAT_TA_97309
ttgccatttatcctctccttactcccactctaattgggagccgccgccgacgacgaggctacagcgccgaccgctcgagcgttgacgcgatctccctcgactggcgtcggagatcgttcgtcgacaaagtgccccacgccgtattttctgactcccgggagtcaacgccagcagccagctctgctccggctaccctgattttcctgtcgccggaatcagtccttaccatataaagccacgatgccttccggctcggcctccgaaccgctgctctcgcgcgccgaaggnaacaacatggaggacgacgaaggcatcgaagtcgcggnggtggaccaacgcgggcgggcccgcccccgcncctccancggggcgctgggcngtccaggggctcntcaataataaccgtgggaaaatngcgggagggggttctcnttctnacggggntttcgggaaacctgattaactaacttaacgggggccctgggcnaaaaacaaaanccaaagggcgngntccggcaatnaaanccttggaaacgggttgggcnaattgtngccctngtccgggcccccctccccgatnctgggtcgggng

SEQ ID NO: 97310 - DNA, 591 bp, Triticum aestivum
  unsure (1)..(591): unsure at all n locations
  Clone ID: PAT_TA_97310
accacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatggatcttgccacgaagtgattggaagggtgatngcgggaacaatngttgccaaacaactagcacaagatttctcaagcaaggtccaagtgcgnaagccatccaatggggtccgtggcattccaatcaatcattgnccgncaaggaccaccacaaccaacaacnaccaaccaccangggnnttagngtttttggggggcnatttttnaactccntccaangggtcnagggaattatcaaacctcaanaacanngtccaattggggggggttnaggcnttnggattg

SEQ ID NO: 97311 - DNA, 533 bp, Triticum aestivum
  unsure (1)..(533): unsure at all n locations
  Clone ID: PAT_TA_97311
cccagatcccccaagagctcgcactcccccaccccaccccagcctctcgtcccgatggcccgcacgaagcagacggcgaggaagtccaccggcggcaaggcgccgcggaagcagctggcgaccaaggcggcgcgcaagtccgcgccggccaccggcggcgtgaagaagccccaccgcttccgccccggcaccgtcgcgctccgcgagatccgcaagtaccagaagagcacggagctgctgatccgcaagctccccttccagcgcctggtgcgggagatcgcgcaggacttcaagaccgacctccgcttccagaagctccgccgtctccgcgctgcaagaggcgggcgaggcctacctcgtcgggctctttgaggacaacaanctctgcgccatccangccaagggcgttacatcatgcccaaggacatccaactcgcccgccgcatccgtggcganaagggctaaaacgcttccaagcntgggttggnggngttaaaggggtaacntctgaatcngtgttgcgtggnggaaat

SEQ ID NO: 97312 - DNA, 329 bp, Triticum aestivum
  unsure (1)..(329): unsure at all n locations
  Clone ID: PAT_TA_97312
gccctgcccagcgctgttgttgcatcgcggaaaaaggtttaggtttggtgcgcagcttcccggttgacctcaccgagggatcttttgtttctttccgtccggtgcccgatcgttccactccaactgattcatccgcctaccaaagctagcgagccagagagctatttgggatcgctcggcggtagtggatatatagccgggcgtttcttttcgggttttgtcgtggatgaacgctgcnttngggcaagannggaagaaaaacattccggccggtnangaaggtggcaaagctggtccctcctccggcnggaaaataaaaacgggcgaat

SEQ ID NO: 97313 - DNA, 593 bp, Triticum aestivum
  unsure (1)..(593): unsure at all n locations
  Clone ID: PAT_TA_97313
tgctctcgtccctcttctccccacaacacgcaaccgccgccgccgtcaccatagatgccctcggccgcgcgctctccggcctccccgcgccctgggaccgcatccgccagcaccaccagcgtctgctacttcctctccgtccacaagttcgagctcggagcccctccaccgtcgggatcgagctcatcccctaccttcggtcgccgccgtcaacctcgacgattcaacaaccctgcaagctcctaagcttccaccgagccatcgtgcgctcctcgatgttggagcccaagagccaagaaaacaactttcgaacgaacgaactgctaactaaaaccgggagggtgcctaactaactaacggtgcangccaattggacgatggaccggggaggtaatttaanggacgattccaagacaaggagggaatgttgcctccttttnatttgtttcccaattttgggcnaaaccntcctaaagggaaaccttggttaacttaagtcgggacctaaaaaatgggtggcntccggcggaaccccccnatgattgaaanacntgttttttnaggccttccagggccctggnnttgttttatng

SEQ ID NO: 97314 - DNA, 339 bp, Triticum aestivum
  unsure (1)..(339): unsure at all n locations
  Clone ID: PAT_TA_97314
gcgggacccagacgcgccgcccaagatcccgcgcccgcgcggccggccgcgcaagaacccgctcccggacggcatggcgccggtcccgcggcccggctccgccgcggccaagccgcgcccgcagttcgccgaggtcggcttcgtgtgagcgaggccgggccggagcgagcgagctaacatttccactttgtgcctggtgtccgtccgttctgttcagcgtgggggtcatttctccgttcgtgttgttctaattggnggtggaagacgagacgatgcagcaagcagcntctgtccancgaagtgtgggtggtgtttcantccggtggcngtggtggttgg

SEQ ID NO: 97315 - DNA, 174 bp, Triticum aestivum
  unsure (1)..(174): unsure at all n locations
  Clone ID: PAT_TA_97315
ctcaanccancgccacncgcaccacagncatncactcngaagctaagctagcggcncagtagctcacttcaatcnagtcggcatggcggctcngaggggngcggcaatggngctggtgatggngctcgctnacatgntggtggcgccnccggcgacggtgcncgnggtcatatc

SEQ ID NO: 97316 - DNA, 428 bp, Triticum aestivum
  unsure (1)..(428): unsure at all n locations
  Clone ID: PAT_TA_97316
gcncnanagagagagacaaaaaaaatcttctcgtcggtagggtttcgggggctgnnatggcgatggaggcgcggangaaggggacggtcaagtggntcancganaccaaggggttcggnttcatctcccccgatgacggcagcgaggacctcttcgtccannagtcctccatnaaggcccatggcttccgctcgccggccgagggcnangtcntcgagttcgccagtctcggagggncatgatcggccgcatcacaggccgtngacnttcaccggccccgacggctcntttcgtgcactggcngncgcgggnggtggcgntgngcgggggtcgtggttcncgantctccnctggcggntggcnggnttctcgcntgnaggnggnggnctttcnagntngcccgnccgccngngaccagacttcgcgcc

SEQ ID NO: 97317 - DNA, 436 bp, Triticum aestivum
  unsure (1)..(436): unsure at all n locations
  Clone ID: PAT_TA_97317
gcaactaaacatcaacatgcccactcctttattcatgatctattacaacaaaatcaagcaatccatgatccatgtggcagttcagtaagtctaacacaacaaaaacgttcgaatgagctaacttagatggaaaccaaaacaacatgataccacaaattcagagcagacatattgaaagtagagttagatatcatagtttactcaggataaataataggacaagagcaaaatcaccaacaattacaaataacagcttatagctgatgaacacacattagtagtcctaacaatttctgggnacatttaaagaatacaatcacaaaaataacatcctatagtactgcagaaattatacttagtaataaaatncagctggncttttggttagttnatttaataacaatagacctgggggtgcacatatagtttggctggg

SEQ ID NO: 97318 - DNA, 455 bp, Triticum aestivum
  unsure (1)..(455): unsure at all n locations
  Clone ID: PAT_TA_97318
gcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagttcgaggccaagcgcgccaagagcaaggcaagcagggagaggaagatttgccagaggggaggaagagattggntcagggcccgagagatcatgcaccagcaccagcggctgcagctcccgctcaggcagcagcgggcaccaaaagaaaggccaagaaagtgaaggtctgacatggaagctttaagctttctggtactattaaggggtttaccctaatttttggaacatcaagaaagntcaanaaactgttttctggtgccantatccttgttttggtgtcangccgtgt

SEQ ID NO: 97319 - DNA, 435 bp, Triticum aestivum
  unsure (1)..(435): unsure at all n locations
  Clone ID: PAT_TA_97319
atgccctctaggattggaggtggataagatacatgcatgccctaatgactgcatcctctaccgcggtgcatacaaggatctgaacgcatgcccggtatgtggtgcattgcggtataagatcagacgagatgaccctggtgatgttgacggcgagccccccaggaagagggtttctgcgaaggtgatgtggtatgctcctataataccacggttgaaacgtctgttcaaaaacgaagagcatgccaagttgatgtgatggcacagtgagaactgaaagaaagatgggaagttgagagcacccgatgacgggtcgcagtggagaaaaatcgagagaaagtactggggatgagttttgcaaaagganccaangaatgtttgggttgctttaagcacggatggcattaatcctttcgggggaagcaagagcancaatca

SEQ ID NO: 97320 - DNA, 434 bp, Triticum aestivum
  unsure (1)..(434): unsure at all n locations
  Clone ID: PAT_TA_97320
atcncatcccccaatncatagacccaagtcggactcgccttcctcctccccaactactcctcctcgcctccgcgcatcgcacngcancgggggtcacctgagatcanatacacaatggnganggctgtggntgtgcttaccggcagtgagggtgtcaagggcaccatcttcttcacccaggagggagatgtcncgaccaccgtgacgggaagtgtcactggnctcaaggaanggntccacggtttccatgtgcacgctcttggngacaccaccantggctgcatgtcaactggaccacacttcaaccccgctggtcatgtgaatggggcacccgaagatgaaatccgccatgctggtggatcttggaaatgtgacagctggancggatggngttgctnaacatcaaatntttctggctggcatatcccccctta

SEQ ID NO: 97321 - DNA, 459 bp, Triticum aestivum
  unsure (1)..(459): unsure at all n locations
  Clone ID: PAT_TA_97321
gccggacggcgggggcgggtcggacggcgcggggacgggggcggggaggatcaaggggtcgtggagccccgaggaggacgagctgctgcgcgacgccgtggcgcgccacggggccaggaactggaccgtcatcagcgccgagatccccggccggacgggcaaatcctgccgcctgcgctggtgcaaccagctcanccccggggtgcaccgccgcgccttcacccccgacgaggaccgcctcatcttcgncctccacagcaagcacggcaacacgtgggccaccatcgcgcgcaaggctccgtcgtgccgcacccgacaaactccgtcaagaaaccactggaactnccaacgcctgcngaaaacgcccgcatggncggccgccgggccgccnncaacngcgtngnaaaccgcangtgggncggggnnccgttcttccccgtccttgacngcctgccnntt

SEQ ID NO: 97322 - DNA, 250 bp, Triticum aestivum
  unsure (1)..(250): unsure at all n locations
  Clone ID: PAT_TA_97322
ggcatcagccgtanttgtgcancacccgtcggagtantgcattggacgaaccacagtggagcagctgctggagaccatgagaatgacgggcagcgccagagggaggagcagccaggcagatttgcccctacccgccggccatgtagcctagctggacatatcatcgtcgaggaccaggccagatgggaccagtggcgacggctcgctggaggaaccctagtgatgcangcaggggattcaaagggaggag

SEQ ID NO: 97323 - DNA, 169 bp, Triticum aestivum
  unsure (1)..(169): unsure at all n locations
  Clone ID: PAT_TA_97323
acaaagtgtagactncaatgtcangcgttgcnacntccttacgctatggttttcattgtagttgtcgccatgtcntatggactccgcgccacccacgccganatnaacttcattgctcgnacatgcagagaanaccanctaactttgcattgctgcatggccgtnctca

SEQ ID NO: 97324 - DNA, 325 bp, Triticum aestivum
  unsure (1)..(325): unsure at all n locations
  Clone ID: PAT_TA_97324
ggtcgcaccgccgcctgaatcctgccaccaccttcttgcatgagatagctctcccttcagtgcttcacagtcagtagtacatatcatctaagctgtggaagagtcaattcagtctagcaaacaagcaatgcatgcctgacagaatgactggattctgttggctaataagtatgttgcgtcccaagtctcaactcctgccctttttaaacctcaaaccgtaactttgctttgcgtctcagcactgaacaagatagactcgaactggatcatactcaaaataatattgtgcaaaagtttctcagaaaaaaaaaanaanaaccaaaca

SEQ ID NO: 97325 - DNA, 437 bp, Triticum aestivum
  unsure (1)..(437): unsure at all n locations
  Clone ID: PAT_TA_97325
gaaaggcgcgcgcaaggtcaaacgagcgcaccagcacactgcgtcactgcccggcgaatgccttgcctatcatttgtgctgttcttgtttggtctcttcctcctccgcctcctcagccgccaacgccatcactctgatctgcccttcctcgccgtacgcccagctgcaccagacgaagtacaccaagttggccacggacagcgccgcgagaaccagatagtagtagtcgtagcggcccctgttgaggttgctggacaaccagctgtcgcgcccgtccctcccggtggcgctgttcatgatccccacgatggcgctccccaagcacggcgccgaagccaatgccgagggcgaagcagcgacacccgatgctggacatgctcttgggggaactcggagtaagtaaaactcgatntgcccaatcaagttcaacggcgtcg

SEQ ID NO: 97326 - DNA, 452 bp, Triticum aestivum
  unsure (1)..(452): unsure at all n locations
  Clone ID: PAT_TA_97326
gcacgcatttgaacccaacanattatccactgccccaatggcgcccctgcctttcttccccaactaccatttccccaacaaccccaacaaccattcccccagcctcagcaaccccaacaaccatttcnccagtcacaacaaccacaacanccttttccccagccccaacaacantttccgcagccccaacaaccacaacaatcattcccccaacaacaacaaccggcnattcagtcatttctacaacancagatgaacccctgcaagaatttcctcttgcagcaatgccaaccatgtgtcattggtgtcatctctcgtgtcaataattttgccacgaagtgattgccaaggtgagtgcagccaacaantgttgccaaacanctangcacaaattccncaaacaagctccagtgngcnagccatcccncagtggtncgcgcaattccatcatt

SEQ ID NO: 97327 - DNA, 441 bp, Triticum aestivum
  unsure (1)..(441): unsure at all n locations
  Clone ID: PAT_TA_97327
attctttgttatcaggaaggaaaagagcaggccctctattttgatgctcatgttcttgaagttgaaaggcgcatacatgatataaggggttgcctctgcagttttcttgttcgttatgatcacgatcactctgaggagcttgttccactgaggaaagtatgtcatcgaccatctgctgttgttaagattaatattgtaattgatcatagcctagctgagcaaaaagctaaaaagtcgcgcaagaggatggatatgaaccctgataaggtcaccatggttcccaagcccaccaaatcaaggagggccgtccgacaagctggctgctcccttacttatcatgcctgatagcacccacagagattcaagtnagcaaatgaagcaagatgggggaataatccaggctgctccaaaaaaggtggaagctaacaagcaaaagcaaca

SEQ ID NO: 97328 - DNA, 459 bp, Triticum aestivum
  unsure (1)..(459): unsure at all n locations
  Clone ID: PAT_TA_97328
ccattaccactacaacaaatattatggtaccaacancancaacccatccancangaaccacaaccatttccacaacagccaccatgttcacagcannaacanccaccattatngcagcaacancnancaccattttcacantaacaaccaccatttttgcagcaacagcaacccgttctaccgcagcanccaccattttcgcagcancaacancaatttccgcagcaacatcatnccacttttaccgcancanccaccattttcgcagcancaaccaccattttctcaccagcagcaacanccaccattttcgcagcaannnacaacacgccaattctancgcagcaancaccattttcacaagaccagcaagcagttctaccgcancaacaanctacnatcttgttacccanctatcttngnaggcagcttacancccatgncaggnagncctccang

SEQ ID NO: 97329 - DNA, 358 bp, Triticum aestivum
  unsure (1)..(358): unsure at all n locations
  Clone ID: PAT_TA_97329
gtggtgttcgaggcaccggngcacttccgcttctacaanagnggcaggatanagcgccttaaccggcctcccatcctccccgccgngcgtcgaggaagggcaccggcgtcacctccaangacntcgtcctcgacgcggagacggnctctccgtgcgcctctaccttcccaaagctccanggaccctccacaaagctccgggtctcgtctacttcacgggggntccttcctcaatcgaatccnggcgactcctccaacgtaacaaaaactaacttgaaacgccctcccccgcggggggcggngtcctcccnggtgttcgtcgaataacgcctggccccggagnancctctcccccgcaa

SEQ ID NO: 97330 - DNA, 327 bp, Triticum aestivum
  unsure (1)..(327): unsure at all n locations
  Clone ID: PAT_TA_97330
ccaaancgtagcaccagnagaanccctccttgccgncnaccccccagncccgatggnccgcacgaagcacgacgtgngcgcaagtcnaacggcggcaaggcaccnangaancagctggcgactaaggcgggcgcgcaagtcagcnncgngccaccgngnggcgtgaaaangccacacggctttctgcccngggaacngtngccctccgtggagattccacatttancaaaaagaggntngtggttgatcattccncaaagcnccccttccaatcaactcgtccggggaagtcccctcancggacttcaangancgtncctccggctt

SEQ ID NO: 97331 - DNA, 245 bp, Triticum aestivum
  unsure (1)..(245): unsure at all n locations
  Clone ID: PAT_TA_97331
cctgagtgctccatcatgagggcaccatttgccagcatagtcgcgggcattggtggccaatgaaaaactgaagagctatactaataggtagatggatcatcgttgcttagctgatgcaccaatcgatgtaacgatgacaaataaagtggagtgcaccatcatgtgtgacaccggccaagtgntagttcaagcttgggaataaaagacaaacaaagttcttgtttgccaaaaaaaaaaaaaaaaaa

SEQ ID NO: 97332 - DNA, 462 bp, Triticum aestivum
  unsure (1)..(462): unsure at all n locations
  Clone ID: PAT_TA_97332
gcatctccatctctctttccctcaccctccttctccacctccggccgtcgccgcggccaggccggcgtggcggcgcgccaccgcgccaccagcacactcaccacacgccaccaaatccatccaccatctccagccacctccacacctcgcgcgcccgaccagacaagagggtcacgggcgtctggtcctccgcgtgagcgcccccgtgctgctgatcttcttctccaactgccgctgctcctcccctcgcgccttctgctgctgctcttccctgcttctgcttcctacgccttgctgctgctcctaacttgctgctcgctgctgcttcttcttcatcctcaaatctgctgttgcacttctctgaaatcngaaatcttgctnggtctcntcncctctctcttctctgtattacanagtggctggctcctttgctanngttcaaggagtccctnacgctttgnt

SEQ ID NO: 97333 - DNA, 462 bp, Triticum aestivum
  unsure (1)..(462): unsure at all n locations
  Clone ID: PAT_TA_97333
agcttgtttgggtaaatggttgtggagtggactggtggtcgctganccangggggtgccttatcctggcaatggcctcggcgccgccgccggccatggcgacngcgacagaggtggnattggtgctgctgttgtcgtccgtggcggtggtgacggtggtggccaaggagtgcacgaacgtgccgacgcagctgtcgtcccacacggtgcgggcgcggttgcaaaagcacnccgggggcggangagtggcggtggngggagctgttccacgaccaactcaaccccaccgacgaatccgcgtggatggacctcctccccctcnccgggaacaacaacggcggcngcggcggcngangaatttcactgggcnattctgtacccggncctcaaagggggggtccggntcctcggcgggcaaagccnggggaaaagccctcctcntcctccnttccctggnggaggg

SEQ ID NO: 97334 - DNA, 478 bp, Triticum aestivum
  unsure (1)..(478): unsure at all n locations
  Clone ID: PAT_TA_97334
gattcctcctcgtcgccctcccctcccctggcgacctaccagcgccgcccagccaccgccgtgccctggcacagcctcgccgccggcggcctcgctccccatacccctccctcccccctcctcccacgcgtatccgtcgcctcctccgcctcccgcatcgccgcgaccccgtccgattcccgagctttgttttgagcatcccgtttcaatacaaatatgtncgggagaaagccaatctggattgaagaacgaatgggtcaagggtgangggctngaanggagatttttnctgaatgttaaaagttgggaaaatngccgaacaaaataaagggaatnnaatngcaanaacaaaacaagangnancaattatcaanaaaaagtttggnngggtaatggccaaaaagtnaacaatcaantncaagggnacaatagcgaacttaattttgattcttngtgnatggggtctgggaaaacaaag

SEQ ID NO: 97335 - DNA, 380 bp, Triticum aestivum
  unsure (1)..(380): unsure at all n locations
  Clone ID: PAT_TA_97335
aagcagcagccgcagcgcgacaccgcgaggaaaccctaccgccgccgacgcagaagcagccatgggtatcgacctcgtcgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaaagaggntcttcatgaagcaagactaaccgcccgccgctctccatgcgccgcctctccaacttnanatnagggaaanggngnaaagaacattgctgtggttgttggtaaaatcacanatgacatgnggntncaagaggtcccaacaatgaaaggtantgctctgaggttca

SEQ ID NO: 97336 - DNA, 463 bp, Triticum aestivum
  unsure (1)..(463): unsure at all n locations
  Clone ID: PAT_TA_97336
ctcccctcctgcccccgagcgccgccgccgccgccgccgccgactgcagccatgtcgctgatcgcgggtgaggagttccagcacatcctgcgtgtgctcaacaccaacgtcgacggtaagcagaagatcatgttcgcgctgacctccatcaagggtgtgggccgccgcttctccaacatcgtctgcaagaaggccgacatcgacatgaacaagagggccggagagctttcctcggaggagatggaccgcctgatggcggtggtgcacaacccgcgccagttcaaggtgccggactggttcctcaacaggaagaaggactacaaggacggcaggttctcccaggtcgtgtccaacgcccgtggacatgaagctcaaggatgacctttgagaggctcaaagaaagatnaggaaaccatcgtggggnctgcgtcactaactggggcgtnncgtgtccgtgggncaa

SEQ ID NO: 97337 - DNA, 465 bp, Triticum aestivum
  unsure (1)..(465): unsure at all n locations
  Clone ID: PAT_TA_97337
gctgcccacccattcccctcaccgccgccgccgccactgcgccgctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcacaagaagggactcctnctncccggcgaagggtaantnaaaccgggcaatttctctaactggcgggacgccgcgccaacctctccgttggggaaagttctnccgctccggctccgttcctgaanggaagggtcaactggaacgttnaanaacaacgttcggggaacgcggtgtcctccccaaagggatcngtgacn

SEQ ID NO: 97338 - DNA, 472 bp, Triticum aestivum
  unsure (1)..(472): unsure at all n locations
  Clone ID: PAT_TA_97338
gccgccgccgcctccccggcagcggccgctcgaggagcccgaggcggagccgctcccgccgcccgtgcagctgggcgaggtcgacgaggaggagctccggcagtacgacgggtcccgancccaaaaaaaccctccttaanggcatcaagggtcaagatntatgacgtcaacgcaagagcaagaatgttctaacgggcctggtggaccttaatgccctattcnctggcaaagacgccaacaagagctctaaccaaaatgtctttccgagccccaagacctgaacggtgatacctctggnctcnggccgtttgagctcnaacgccctgcaagactgggaataaaagtttatgaacaaatatttnaaagtccgnaacatcaanaaaggaactccccgcaaaaaacnggaacaaaaagcaaaatcccaanaaacaaattgaaacaatcaaccgcccgaagggaanagaancgaaaa

SEQ ID NO: 97339 - DNA, 475 bp, Triticum aestivum
  unsure (1)..(475): unsure at all n locations
  Clone ID: PAT_TA_97339
ccaacccagaccaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgaattccgcgaggagttcaagcaagaagaaccccaaagaacaaagtccgtcgccgccgtcgcaaaacggccggtganaaagtggaaaagcttnagngaatcggaaaagggcccctatgttggcaagggcaacaaagctcaaagggcgaattaaacaagggcattgctgcctaaaaacaaagggccaaaancncttgctgctgctgccccaaaaanaaaggntgcggncaaaggaggtaaaagganggaaatttagg

SEQ ID NO: 97340 - DNA, 453 bp, Triticum aestivum
  unsure (1)..(453): unsure at all n locations
  Clone ID: PAT_TA_97340
cccacttacaagagtaccacccattaataacctctggtcctcggtgatgatgaccacgcacatgaggaataatgtgcaaggacttctgctactttcatttcttcttgtggtgtgtttgacttgtcttggatgcacatatggtgaaaccataaagactagcaacatgatggccaaagtaagtcatgtaactagacccccttgttataaagacgagaaagtccttggacaattctgctgtaagatagataagttgtgttggccaaatctcggagaatgcttcgtcaactgtccctgcaagattaattgcaaacgagcagcaacaacaacacagtagttctattaactctcctattttcgatgggataaatctcaaccttgggggtctcaaaataaagatgtgttgatnaaatnaataaattttgctnagaatttgnaatcaagtgtgttccttta

SEQ ID NO: 97341 - DNA, 263 bp, Triticum aestivum
  unsure (1)..(263): unsure at all n locations
  Clone ID: PAT_TA_97341
gctagacgagagagagaganagacggatagacatcgnccgagaaggttccggaaggatgcctcgcgcggggttgtcggcggtgtcnancanggtggacgtggccatcgacctcgggaacccgctcctcaaccgcaccgtcgacggcttcctcaagatcggcgccgtcggcgccttcanggtggcnagccggaggacgccttcnactgcctccaaanntggnatgtgtctcgacccgcaancttgaacaacacactggnaaaaa

SEQ ID NO: 97342 - DNA, 469 bp, Triticum aestivum
  unsure (1)..(469): unsure at all n locations
  Clone ID: PAT_TA_97342
ctcccctgcctcccccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaaggccgtgaaggtggttgacattgttgacaccttccgtcttcaggagcaacctgcttttgacaagaagcaagtttatctctcacatgaagcgcntacatcangaacctcactgccaagctttgaaaggggatgacctaaatgttttcaangaangaatgtttgagtctgcaccaaatatcttcttaacaagctcaagggaccttcanttt

SEQ ID NO: 97343 - DNA, 504 bp, Triticum aestivum
  unsure (1)..(504): unsure at all n locations
  Clone ID: PAT_TA_97343
cttcgagcgcctcctcctgtctcgtcctcgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagattccagctggcattccaggtagccgggcgaacaactattaaccgttgcagatggccagaaacacgggcaacttccnttacggaccgtccnttaaacaaaggttaatgcngctcctggggggtgggtncgtccctggggtaacnttgtttggcgggaaagntgatggttaatgaatgggtggcctgccttaatngaacgaagcgaatgaaattgggcctggtaatccnccngttaanccaaaggtgggtgaaaaaactgggaaagttgnttttggttttgaagcaan

SEQ ID NO: 97344 - DNA, 452 bp, Triticum aestivum
  unsure (1)..(452): unsure at all n locations
  Clone ID: PAT_TA_97344
ccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatganggtngtggatgaacaagctgtgaaggtggttgacattgttgacaccttccgtcttcaagancaacctgcttttgacaaaaancantttaactcncaaatgaagcgctacatcaagaaactctccgccaaacttgaaagggaagacctaaatgcnttcaaaaaaaatgttnaagtccccacaaaatatctcttaacaaactcaagggcttn

SEQ ID NO: 97345 - DNA, 459 bp, Triticum aestivum
  unsure (1)..(459): unsure at all n locations
  Clone ID: PAT_TA_97345
cccgccgaaatggacgtcaatcacatgatgaggtcccagagaatcaacccggattccctcgctgatggcggagtcagcggcgcgagcaggaacccagcggcgccggcgccggcccccaaaccgagcaaggacgagcgcgctccgggacgtcgtcgtcgacacctcacgcctcgcgccttacttcccccgcacctcgctcgagaatcgtccggcgtcctcatccgctgccctcctgagccactatcgctacaacgtcgccatggacacgtcccactcccaaggaacccgacctcggcggcggcggtggcgggcgggatcnccttgtcggactgtcccttggcgctccantggtgggggcaagggaaanggtcccgcaanccgttccgaaaacncggtggcccnaaccnanctgaccccncccaagtgccccntaagaatccctcaaatanaaggaggcgg

SEQ ID NO: 97346 - DNA, 464 bp, Triticum aestivum
  unsure (1)..(464): unsure at all n locations
  Clone ID: PAT_TA_97346
gcatccccgttcccatcaccaccaccacctacctgccgcggnngccgctcccanggcggnnctacngcctcgcccttcctgacggnttgccctcttagcctgcatgtgcctcttcctgctggccgccgcgccgnccctcgcnctcgcccgcgcggcgcccgccgncgactcgatacacaagctactgcnctcgnacggcctccncggcgggctgctcccagngcagngtggagtcctacanccctgggacgagggaaacngactgctcnatngcgccggctatcggnnccgtgctacgcgacgtacnanacccggcgacctggctttcttcggacaccgtggtgcgagggaatcncancttcngnagcgctcagcagctgctgaggggcctggnctcacganggngctcttcatggtngctcccggnttaaggggcatcctcgttcncccnacactggnctccg

SEQ ID NO: 97347 - DNA, 376 bp, Triticum aestivum
  unsure (1)..(376): unsure at all n locations
  Clone ID: PAT_TA_97347
acnactctatcccactctnacncacngtngcngtctcnctcacnctcactctctctctcgctcttctcggcgttcgactcgtggtcggtgttcttccgccgggagtggggccgnacctggaccttcctcgccggcttcgncgtcacgggcgccctcatcaccaagatgaccgccggcttcaccgaggaggacctcaagaactccaaattcgtccaggngcacaagaacangtagtcnccgccccgcccggcccgtccgncgccaggncacangggcaagcanctgaanttaccggtatgtgtccttgatgcggagagccagtcctcaccctcactatngtgatnganctttangctttttttggttcaaannccaa

SEQ ID NO: 97348 - DNA, 473 bp, Triticum aestivum
  unsure (1)..(473): unsure at all n locations
  Clone ID: PAT_TA_97348
gcataggcagatttcaggtggatcatcatccagccaaggcatgctgcagaggcagatttcaggcgggttgctgcctgtgcatggacaagaggtgggtggctcgtggcaccaccagcagctgtctaggccgcagctgcctcctccgcaccatcagcagctccagcagagaccangttggtccaggcagcatgtatgctcccccaaacccagggtcaggtgctgcgggcatcatgtatgctcccccaaatccanggccgggctgacggaatctcgacaccggctgggtccgtatgcatggncgcatcctttgtctcttgaaatccaaaaagttactggtacagggtgtncgggccaattgttttgggaatgggaangggnagccgcccgctggacagtgggtccctgaancaaaccngacttttgcntgtttttggttggtnaagtggtanaataaagaaatattnnttttggca

SEQ ID NO: 97349 - DNA, 464 bp, Triticum aestivum
  unsure (1)..(464): unsure at all n locations
  Clone ID: PAT_TA_97349
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacanctatttcctcaacaaccatcattttcgcagcaacaaccaccattttggcaagcaacaaccaccattttctcaagcaacaaccaattctaccacagnaaccaccattttcgcaagnaacaacaactagttctaccggcaacaaccaccattttcacaacaacaacaaccaagttttncctccacaacaaatcnccttttccacaacaacaacaacnccancagnctgggtgcancaacaaatncccggntggttcaancatccaatttgcattg

SEQ ID NO: 97350 - DNA, 423 bp, Triticum aestivum
  unsure (1)..(423): unsure at all n locations
  Clone ID: PAT_TA_97350
ggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactccgtacgtacgtgtgttggtgtgagaatatacgtgaataacgagcgtctgatctgatggagtcnagcaagggtgctnttcgtgtncgtgtnggttgcttgctcnctcccccaagctctgcccaatggggtccttggtggtgtnagtggtgtgtgcaagtgtccctgtnattgcttnanccaaccccaataaggatggagtnatgaatatgtnanaatgaaaagatttaccttaaa

SEQ ID NO: 97351 - DNA, 172 bp, Triticum aestivum
  unsure (1)..(172): unsure at all n locations
  Clone ID: PAT_TA_97351
tttttttttttttttttttttttttnttttttttttccacacangcgccatttaataccanncncctctagcananatttctantgncacttgancatnatttaacaacgtncacnacngagggatttgttacagtntttctcgcaacgggatacagaatcangcaaattcg

SEQ ID NO: 97352 - DNA, 460 bp, Triticum aestivum
  unsure (1)..(460): unsure at all n locations
  Clone ID: PAT_TA_97352
gctggacgagtcctttggcgccaagctaggagacttcgggctggcgaggttcatcgaccacgccgtcgggacgcagacgatgaccgccgtgtcggggacaccaggctacgtggatccacagtccatgatcactggcagggccagcgccgagtccgacgtttatagcttcggcgtccttctgctggaggtcgcatgcggaaagaaggccaatcagtttgctgcatgatcctgccgagaagaacgggctgttccggctggtcgaagtgggtatgggacctttatggtcggggagcccttcccgacggggccgacgagcggctcaacgtncgaagtacgatagggcggaggtggnagcncgtgatggtcgcccgggctctggtggcgcgcaaccggacncgatcgcccggncgttccatganaacatccaatgggccgtnctcaatcccaagggatgctaaat

SEQ ID NO: 97353 - DNA, 468 bp, Triticum aestivum
  unsure (1)..(468): unsure at all n locations
  Clone ID: PAT_TA_97353
gtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggncgccaccactcccaagtactcaaaggcncgttatgaaagaaattgtcaaggaggtctcttcctacctgaagaaggtcggctacaaccctgacaaggttcccttcgtccccatctctgggtttgagggtgacaacatgattgagaaggtccaccanccttgactgggtacaagggcccaacccttctttgaggcnncttgaccangattaaacgancccaagaggcccctcaagacaaagccccctccgttcttncccctccaaggaccgttttaacaangattgggg

SEQ ID NO: 97354 - DNA, 457 bp, Triticum aestivum
  unsure (1)..(457): unsure at all n locations
  Clone ID: PAT_TA_97354
ccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaangaagcaagtttatctctcacatgaagcgccacatcaagaacctctctgccaagcttgaaacgggatgacctatatgttttcaangaaagaatgttgagtncggcaacaaangtatcttcttagcaann

SEQ ID NO: 97355 - DNA, 451 bp, Triticum aestivum
  unsure (1)..(451): unsure at all n locations
  Clone ID: PAT_TA_97355
tcgcaccacagtcatccactcacaagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggnccggggctgctgcaccggnatccaagaacctgctggcggnggccancaacagccccgaccgccgcaccatttgcgggctgcctcaagaacgtcgncaacggcgcctccggcgggcccctacatcaccccgcggccgncggcgctccccntccaangtgcnaacgtnggcctccctacaagnttaagccccaagngtcngacntgcaatctncgattncanttgaaac

SEQ ID NO: 97356 - DNA, 422 bp, Triticum aestivum
  unsure (1)..(422): unsure at all n locations
  Clone ID: PAT_TA_97356
gcaagttgtggtcaatacaaatccaccatgaagacctttctcatccttgccctccttgctatcgtggcgaccaccgccacaactgcagttagagttccagtgccacaattgcagccacaaaatccatctcagcaacagccacaggagcaagttccagtggtacaacaacaacaatttctagggcagcaacaaccatttccaccacaacaaccatatccacagccgcaaccatttccatcacaacaaccatatctgcaagctgcaaccatttccgcaagccgcaactaccaanttcgcaagccacaaccatttcaaccacaacaaccatatncaaaaccgcaaccaaantattcgcaaccaaaacaaccaatttcaaaanancaacagtaacagcagccaaccangaancacnaacaacaatc

SEQ ID NO: 97357 - DNA, 485 bp, Triticum aestivum
  unsure (1)..(485): unsure at all n locations
  Clone ID: PAT_TA_97357
gctcccccctcctcaacaacctcccggcgcatctccgactccatggcccgcaccaagcagacggcgaggaagtccaccggcggcaaggcgccgaggaagcagctggccaccaaggcggcccgcaagtccgccccggccaccggcggcgtcaagaagccccaccgcttccgccccggcaccgtcgcgctccgggagatccgcaagtaccangaagagcaccgagctgctcatccgcaagctacccttccagcgcctggtgagggagatcgcccaggacttcaagacccgacctccgcttcangtcctccgccgtccccgcccttgcaaggaggccgcccgaagtcctaacttcgtggggggctctttcnnagggacaacaaaccttctgccgccaatccaacgccnaagnggcggtcaaccatccatgccccaaagggacaatncaagccttccgccccgccgcaatccgntggggngangaaagg

SEQ ID NO: 97358 - DNA, 452 bp, Triticum aestivum
  unsure (1)..(452): unsure at all n locations
  Clone ID: PAT_TA_97358
ggatgttgtattgcagcaacacaacatagcgcatggaagatcacaagttttgcaacaaagtacttaccagctattgcaagaattgtgttgtcagcacctatggcagatccctgagcagtcgcagtgccaggccatccaaaatgttgttcatgctattattctgcatcaacaacaaaaacaacaacaacaaccatcgagccaggtctccttccaacagcctctgcaacaatatccattaggccagggctccttccggccatctcaagcaaaacccacaggaccagggctctgtccaacctcaacaactggcccagttccgaggaaataaagggacctnacgctncanacnctacctgcaatggtgcaatgtccacatccctccannattgcnacaatcccgccattttggnaacntccgtnccnactggagnagaaaattaactcntngacnt

SEQ ID NO: 97359 - DNA, 473 bp, Triticum aestivum
  unsure (1)..(473): unsure at all n locations
  Clone ID: PAT_TA_97359
cctcctcctcgccgtcgccgtcgccttcgtctccgcctccaaccgacggcctcgccaccagctcgtctcctccaatggcgggaagacggtcatcgtcaagctgaaatggggcatggagtataaaggatatcttgtttcanntggactcctacatgaatctgcagctaagtggtactgaggaatacattgatgggcaatgctctgggaatttgggagacatactgataagatgcaacaatgtgatgtacctccgaggtgttccaagaggaggacacggacattccaggatgcggcctgnagagcacatggactgttcctgggttgatgcttggtgttcaantgctgaaaaaaagaacttccaaagnttcgtccncaatttgcncctaacntnaactggttattaacgttcaanggcgtttggaacctgaatggtttaactccaaagnttctggcaatccctgaaatgaattgag

SEQ ID NO: 97360 - DNA, 417 bp, Triticum aestivum
  unsure (1)..(417): unsure at all n locations
  Clone ID: PAT_TA_97360
gcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcaacagcccggnncgcangatagcgtgcagggngcctcaagagcctcgccaccagcatcaagtccatcaaacatggggcaaagggtcttccgggngttggcccgggcaaagtggcnggcgtccagcggtncccctttcccaannaaaggaatgtccaaccaacctngcaancaa

SEQ ID NO: 97361 - DNA, 481 bp, Triticum aestivum
  unsure (1)..(481): unsure at all n locations
  Clone ID: PAT_TA_97361
agaacctcctcaacctccccgcgcatcgacgacatggcccgcaccaagcagacggcgaggaagtccaccggcggcaaggcgccgaggaagcagctggcgaccaaggccgcccgcaagtccgccccggccaccggcggcgtgaagaagccccaccgcttccgccccggcaccgtcgcgctccgtgagatccgcaagtaccaagaagagcacggagctgctcatccgcaagctccccttccagcgcctcgtccgggagatcgcccaggacttcaagaccgacctccgcttccagtcctccgccgtcnccggccctggcaaggaggccgcccgaggnctaccctcgtggggcctccttcggagggacaccaaacttctgnggccaatccaacgnccaaaggcggcggtnnaccaattccatgcccaaaggganatccaagcctccccccncccgcaatcccgttgggngaataagggccctatg

SEQ ID NO: 97362 - DNA, 263 bp, Triticum aestivum
  unsure (1)..(263): unsure at all n locations
  Clone ID: PAT_TA_97362
agacgctttgctttattcgaatatatggttcttagtcattagtcatgtagctaaatcaaacttaagaagactatatctgatatattgagcgcagaactcatcaggagatactattttcgtaaccatatgcatgtttgttggatcatgctctcttccgtggtacttgtaagctgacttctattgctactggttctgcaagaattctgcganaaatatgccaagccaagaggatgcggggtatatttctcgcagnaattctgcag

SEQ ID NO: 97363 - DNA, 345 bp, Triticum aestivum
  unsure (1)..(345): unsure at all n locations
  Clone ID: PAT_TA_97363
gtcgcgctcgcaggtgcgctgccgcgagaacccaatgtgccactgcaaccctcagagggaggcgccaagatggatctcctggagccggcagaaccctggcaggaggtactattgctgcgtggatgctatggtgagaatcaattttgccctatttttcttctgtgtaattgaattcttctcgtatttcttctcctctgtgaaatgatttctttttttggaaatgtttttgtgcatcttaaacagcaatggtgggttgtgggatttgtggacgtggcatnaatgatcccttttgccaaaaatttttggacgtgagctgattggggggattctgtttgggaaataatg

SEQ ID NO: 97364 - DNA, 477 bp, Triticum aestivum
  unsure (1)..(477): unsure at all n locations
  Clone ID: PAT_TA_97364
agttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaaaaccactattttcacancaacaacaactatttcctcaacaaccatcattttcgcaagcaacanccaccattttggcagcaacaaccaccattttctcaagcaacaancaaattctaccacagcaaccaccattttcgcagcaacaacaactagttctacccgcaacaacccaccatttttcacagcaacaaccaaccaagttttncctccaacaacaatcaactttttccacaaacaaacancaacaaccaaacaagctgggtgcnaacnancaaaatcccctgttggttccagncaatccaatttttggcaancagcttg

SEQ ID NO: 97365 - DNA, 350 bp, Triticum aestivum
  unsure (1)..(350): unsure at all n locations
  Clone ID: PAT_TA_97365
gaaaatcaaagtacgtagtagttaacgcanatccaccatgaagaccttactcatcctgacantccttgngatggcagtacccatcggcaccgccaatatccaggtcgaccctagcggccaagtacaatggctacaacancaactagtcccccagctccaacagccattatcccagcaaccacaacaancatttccccaacctcaacanacattcccccatcaanccacaanaagcangttccncaagcctcaagcanccaacaancaaaccaatttctccagcccccnacnaaaccaatttcncccaaanaagncaaganncaagccaatttccccccaggancttcaag

SEQ ID NO: 97366 - DNA, 459 bp, Triticum aestivum
  unsure (1)..(459): unsure at all n locations
  Clone ID: PAT_TA_97366
ccgaggtgtanaacatataaaacaggggcttatagctttcattagcacactactgatgccactgtacaaaagtaaaaagatcgacagggaggcatacaagacaatgatgcggaaagctgtcacaaagatcattgatgcatgcaccgaaggagagaanctgatgactgccaatgaatttcttgattttagaaggaaaactaagattcaaacatttgtggntaagctggtcgagaggcattggcatgtggctccagcccccaaatcatagcatgtacatatctaggaagctgttacatgtggagaagcaaatgtcaccttgcagactatgctgtcactcagcaaggcattggctccatgggacctaaaagaagcaagacattgttgattatcacctcccatcatcatcatcatcatcgttcatagattgggacattcatcccttgtattngaagtttgatt

SEQ ID NO: 97367 - DNA, 479 bp, Triticum aestivum
  unsure (1)..(479): unsure at all n locations
  Clone ID: PAT_TA_97367
tatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaangaagttcgagaccctgtcctacctgccaccgctcagcacgggaggncctcctcaagcaggtcgactacctgatccgctccaaatgggtgccttgcctcganttcaacaaaggttgggnttcaaccttccgttgagcaanacgcatcccctngggtatnacgaatggcccggtactggncaatgttgggaagctngcctaatgtttcggggtggnaccggaacgcccaacacaagggtnnatcaaccgncggtggnnangacggtncaagnaanggggntncccntt

SEQ ID NO: 97368 - DNA, 414 bp, Triticum aestivum
  unsure (1)..(414): unsure at all n locations
  Clone ID: PAT_TA_97368
accacagtcatccactcacaagctaagctagcggcgcagtagctcacttcagtccangtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcaagtacgtgcaancaaggcggttcgccggcccggggctgctgcaccggcatccanaacctngctgggnggacgggcaacaatcaagccccngacccgcccgcaccnatctgcgggctgcctcaangaaangtcctccaaacgggngcctcccggggggggncctaanaattaaccccggngncggccggngcctcccctncaaaagtgncaacngtcgccc

SEQ ID NO: 97369 - DNA, 154 bp, Triticum aestivum
  unsure (1)..(154): unsure at all n locations
  Clone ID: PAT_TA_97369
gcaggntgttgncgcggntcctgctcntcccaccctcataaacctggananggacaccaanctggntgtcacattncagtggagaatacctgctccttcttggaggngatggnggagttccttgtgaactcnanacggtcatgtcacnctccat

SEQ ID NO: 97370 - DNA, 471 bp, Triticum aestivum
  unsure (1)..(471): unsure at all n locations
  Clone ID: PAT_TA_97370
cagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgagganaccaaggaggaggcgccggcagcagtttgaggcaaaggaaacgaanggagnccgagncaacagctgcnggccgaaccggganggccgaagnncccccccnttggtcnagacangaanaccaaaggaggnccttggntgaaggcaaaagccnggtgggcnggcccnangaangttaaacggaagaagnngggcccngnttggccgnaggncgaanccccggcgctcnccnctgctggctgnggaa

SEQ ID NO: 97371 - DNA, 372 bp, Triticum aestivum
  unsure (1)..(372): unsure at all n locations
  Clone ID: PAT_TA_97371
cctcagtcctcacagcatcctctcagtccttagcttccttccctcgccgccacccaccaaggaaaggaggatgtcttgctgcggcggcaactgcgggtgcggngccggctgcaagtgcggcaacggctgcggcgggtgcaagatgttccccgacgtggaggncaccgccggcgccgccggccatggtcatgcccaccgcctcccacaagggggaagctccggnggngttcgagacgngacggggaagaccggcgggttgcgactgcaccaccctgcaagttgcggcaccgtgtgcnngntggctcctgctgcagctgcaacctgaagccngcgcccaanganggccggacggcnagagggcgagcangatga

SEQ ID NO: 97372 - DNA, 457 bp, Triticum aestivum
  unsure (1)..(457): unsure at all n locations
  Clone ID: PAT_TA_97372
ctcccccctcaccacttcttcttccaccaccggccgccgccgcagccaggccggcgtggcgacgcgccaccagcaccaccacgcgccatccaccactccatctccaccacgcctccaccaccaccatccgcacctcacatcgccaccaacaccaccatcgcatctccaccacctctgctgcccatcggctgctcctcctctcttctctcgatgaccctgctgcttctcccttctccaacctcctgctgttgcctcctcttccccaagccccgctgttgcttcttccttgttgcgcccctccttcttcttccccctctccttgctgctactccttcctctnacgtcccccctgctggttggtcttcttggaacgattctgaagctgctcctctctccaagggcccttttctgcttcnctcttgctacngcnggctggccccaaccttcctggntgggt

SEQ ID NO: 97373 - DNA, 441 bp, Triticum aestivum
  unsure (1)..(441): unsure at all n locations
  Clone ID: PAT_TA_97373
gcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactggcagctgccgatgtaaccaagcagattccagctggcattccanggtagccgggcgaacaactactaccgtgcagatggccaagaacacggtcaacttccttacggaccgtccttcaaccanggttcaatgctgctcccggcggtgggctcgtccctgggggctacttngttggnggggaantggatctctgtttaaatgctgcctgccnatnaaattnggcctggnaactcctggntaaccaanggttg

SEQ ID NO: 97374 - DNA, 460 bp, Triticum aestivum
  unsure (1)..(460): unsure at all n locations
  Clone ID: PAT_TA_97374
tcagaaccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcaagcaacaaccaccattttggcagcaacanccaccattttctcagcaacaaccaattctaccacaagcaaccaccattttcgcaagcaacaacaactagttctacccgcaacaaccaacattttcaacagcaacaacaancaagttttaccctccacaaacaatcaacttttccacaancaagnacaacaccaanagcnggnggcaacaacnaantccctgttggttcann

SEQ ID NO: 97375 - DNA, 469 bp, Triticum aestivum
  unsure (1)..(469): unsure at all n locations
  Clone ID: PAT_TA_97375
aacctagcgtgctgcccgccgccgacgacagcagcccagctctccactccggcgaccggcggtacacctcggcgttcctctcccccacgtcttcaaccgcggcaggcattcaggaatcaggcaacgcctagttgacgatacaagatggcgccactcgcacgcaagcaccgcaaggcgtcaccttccccttccccctcggaggcttctcccaattcaggcaagcgactctgaactccacctcgatgaccactccgacccagaggacagcttcttctccacaaggagcgctgccgatgacgacgtccaaggattcctccaccagtgacgaggaggaggatgacgatgaggagagcctncatgaggaggaggatgacgattaggagagcctccatgatnatgaggatgatgatgaggaaaacctccatgagggagggttatgatggtggngatggggaagaggtccaancat

SEQ ID NO: 97376 - DNA, 457 bp, Triticum aestivum
  unsure (1)..(457): unsure at all n locations
  Clone ID: PAT_TA_97376
gtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccgggcgagaagggcgtcggcaagagcggcaagccgctgcactacaagggcagcgccttccaccgcgtgatccccgacttcttgtgccagggcggcgacttcaccaagggcaacggcaccggaggggaagtccatctacgggcgaagaagttcgcccgacnagaaagttcgtccacaagcaaaacaagcccggggatcctctccaaggncaacgncgggccccaacaacaangggntcccaattcttcatctgcaccggnccctgnan

SEQ ID NO: 97377 - DNA, 448 bp, Triticum aestivum
  unsure (1)..(448): unsure at all n locations
  Clone ID: PAT_TA_97377
ctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgtcgaggcctgcactggtgggaatgttgcggttaatggttggtggattccccangaaggaaagaatggnaagggaagatgtttattaccaaaaatntttcaatcctacaaagctcaaagcaactgctccctgaaagctcaagcannccccaactgcnagggtttgggntgt

SEQ ID NO: 97378 - DNA, 415 bp, Triticum aestivum
  unsure (1)..(415): unsure at all n locations
  Clone ID: PAT_TA_97378
gagccacctcctgccgtcgctcggagatgacgccccttcgcccgtcctcgccggattgagcagcctccgcgcccctgccaagcccgcctcctgtcaccaagcgctgccgctgccggacgccctgcggcgtcgacctgctctcagcgccgatgcttcctctgcttcgctcgactggatgcangccgctcgccccnttgaccgcgcgagcccgtcagcgcatctctgcctcgctggncaaggcccagcctgctccagctccccaaccggcctgctacctcctccaccgaaacggggncaaggactactggtnttcggnttccgttccgggagttgtgagggatttgttncgacctacattcgatttgnctttcttcaatgggaacaccngttccttcttcctaagccggggatttca

SEQ ID NO: 97379 - DNA, 459 bp, Triticum aestivum
  unsure (1)..(459): unsure at all n locations
  Clone ID: PAT_TA_97379
tccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggnaagaagcttgaggatatcgttccttcaacccaaaactgtgacgtcccccatgttgaccgccaagattatcaactgattgacataactngatgatggntatgtcanncttccaactnagantggcaacaccaaanggtgacctngaagctttccaatggnggttgttctncttggng

SEQ ID NO: 97380 - DNA, 340 bp, Triticum aestivum
  Clone ID: PAT_TA_97380
atttggtggctccgactcatcgcctgcctgtctgtctttacttgtactgcctgcactgcaccaccccaggggcaaaactgccatttttttttacttttgtatgtttcaccttttcttttcttttcttttcttttttttccccttcttcccctgccatccatcctgcatcatgaaatccagcccagccaccaccacccctgctcctctgggtgatatgtgtcaccccatttgcttcttttttctcaaggttaggtgacatgtcacccttgcttgtcattgtgaagatgttatgtgtgccttttgggggtaagaagcaatgtgaggtgcttctgaatggcgc

SEQ ID NO: 97381 - DNA, 467 bp, Triticum aestivum
  unsure (1)..(467): unsure at all n locations
  Clone ID: PAT_TA_97381
gcggataccatttgatttgctggtccattatccatcgatctgtctctgtttaggactacacccaacttgatcaatcactcactttctcgccattcaatcaaatctatgcccacttgacacattgccagtttgccacaactactaacacggctgcacccgcgagcggcagcaagaaaatgagacggcaaatgaaatcagtaaatcaccacggcaaatcgacacacacgcacgcacgcatccatcttgcttccttccgatcgagaacggcggcgccattgctgccccgccgcgttctgcgccctcgacggcattgctaattagcaagcaagcctaccgcccggggcggggngggtccctcaggttcaanntcgccaagggatcggggctggccaacaacgtggtgctcgctgggaccaagacaatccgggccggaaccccgttggtggcccgncnnggtttcccccccg

SEQ ID NO: 97382 - DNA, 450 bp, Triticum aestivum
  unsure (1)..(450): unsure at all n locations
  Clone ID: PAT_TA_97382
ttttcaatctaccccacaacgagccgcctgtccgcctcacctgggataaggccgccgccgccacccactgaccccccgccgccgccgccggcggtggccaggagcattccgctcctcttcctccgctggatccgcccctctgctgttgtactcctcccttgctgtcctctgcttttgtgctcctcccctggatccgcccctctgctgctgtgctcctcctggatctgaaggcgatggcaagcaaggactcctctgctgttgtagcaaaccttctagcaacaagctgaagaagcanaggngagcccaacgggagtatataagctaagcattactccaagaggaaataactcaagtnacttncaacttccaatcaaganaagcatccangantctgaagattggactcaacaatntgnanaaaaaatgccngnaatatgggaaaactcccnn

SEQ ID NO: 97383 - DNA, 467 bp, Triticum aestivum
  unsure (1)..(467): unsure at all n locations
  Clone ID: PAT_TA_97383
ctcctagagagnacncacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttcccccggcgactacggatggggacaaccgcggggctctcggccganccccgaagaccttcgccaaggaaacggggagctgggaggtgatncacttccgggtggggcaatgctggggcggcggctngggctggcgtnttccccgggagcttgctccnccgcaancgggggtcanagttcggctgaaggccgtt

SEQ ID NO: 97384 - DNA, 469 bp, Triticum aestivum
  unsure (1)..(469): unsure at all n locations
  Clone ID: PAT_TA_97384
cctcagcctcccggcgcatctccgacgacatggcccgcaccaagcagacggcgaggaagtccaccggcggcaaggcgccgaggaagcagctggccaccaaggccgcccgcaagtccgccccggccaccggcggggtgaagaagccccaccgcttccgccccggcaccgtcgcgctccgggagatccgcaagtaccagaagagcaccgagctgctcatccgcaagctccccttccagcgcctcgtgagggagatcgcccaggacttcaagaccgacctccgcttccaagtcctccgccgtctccgccctgcaagaggccncccgaggnctaccttggtgggggctgttcgagggacaacaanctttngcggcaatcaaggccaaagcgcgtcaacaatcattncccaagggacaattcaagctcgcccgncgcatncgttggngganaaggggcctnaagctctgtttat

SEQ ID NO: 97385 - DNA, 308 bp, Triticum aestivum
  unsure (1)..(308): unsure at all n locations
  Clone ID: PAT_TA_97385
ctctctctctctctctctctctctctctctctctctctctctctcccccaatcccccacacctctctcgcccgcagcccttcccggagccccagctgcggcgcgcgcacgcgtacggacacacactcgaccccggaggagncggagcgggaggcgccggcggcggagatggtcgacggggagaaggccccggacccggccccgggcccttgctgcggntggagacgctgctgggcggctcgggcttcgaanaagcgcacgggcgaagaacgccnctggtnaatnncaaaggttaacngcaacctnacc

SEQ ID NO: 97386 - DNA, 440 bp, Triticum aestivum
  unsure (1)..(440): unsure at all n locations
  Clone ID: PAT_TA_97386
ccacttcgagcgcctcctcctgtctcgtcctcgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtaagccaagcagattccagctggcattccaggtagccgggcgaacaactattaccgtgcagatggccagaacacgggcaacttccttacgggaccgtccttcaancaagggttcatgctnctccctggcgggnggctccgnccctggggcnacttngttttggcgggaaaagtgaatnttaatgatnggtggcctggctttaatggnacgaagcgnatgaaatttggcctg

SEQ ID NO: 97387 - DNA, 216 bp, Triticum aestivum
  unsure (1)..(216): unsure at all n locations
  Clone ID: PAT_TA_97387
cacactccccccgcccgccgccgccgccgcacagccgcagggagagaaggcaaggaggangaacgaatgggaagatnccnntctgtgcacnggttgcggtcttcttntgcntgagctgttctnctcggtcttcnntattnattggtgtngatnccgttcaccaccttatntgttncancctatttattgtctggggnattnncttcttctctcttg

SEQ ID NO: 97388 - DNA, 359 bp, Triticum aestivum
  unsure (1)..(359): unsure at all n locations
  Clone ID: PAT_TA_97388
ataacagacattatctaacacaaatcaaccatgaagaaattcctcgtccttgccctcattgttgtcgcggcgaccaccacngccgccgaaccctttactgcattccgtacngcttgggagccgcaccatccatcatctccagagcagcaaccaactccacagccacaagaacaaccagttccacatcaaaagttgaacccatgcagggatgccctcctacaacagtgtagcccagtttgctgatatgtcgttcctccggtnacaaggtggtgcaacataccagctgcttggtaaatgtggggagcaattnttgtnatcagcnanaaaggngattncccatntccantccntggatctga

SEQ ID NO: 97389 - DNA, 452 bp, Triticum aestivum
  unsure (1)..(452): unsure at all n locations
  Clone ID: PAT_TA_97389
gctatatacctacatagtacagccatggcccccaccgtgatggcctcgtcggtcacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccancgctcaacacgggangncctccttaagcaggtcgactacctgatncgctccaaagtgggtgccttgcctccgagttcaacaagggttgggttcancttccgtgagcaaaacgcatcccctgggtaatacgaaggggcggtactgggnaatgtgggaagctgcctatgttccggatgcacccgaacccacgcaaggtnatnaaccaaggtgggnggganggcaaagaang

SEQ ID NO: 97390 - DNA, 476 bp, Triticum aestivum
  unsure (1)..(476): unsure at all n locations
  Clone ID: PAT_TA_97390
atggcccgcacgaagcanacggcgcgcaagtccaccggcggcaaggcgccgaggaagcagctggcgaccaaggccgcccgcaagtcggccccggccaccggcggcgtgaagaagccccaccgcttccgccccggcaccgtcgcgctccgggagatccgcaagtaccagaagagcacggagctgctcatccgcaagctccccttccagcgcctcgtgagggagatcgcgcaggacttcaagaccgacctcaggttccaagaagctccgccgtctccgccctgcaggaggccgccgaggcgttacctgggtgggggctgttcgaggacaccaaccttgtgcgccatccaacgcccaatgcgcgttcaacaatcattgcncaaaggaacatccaagctccgccccgnccgcattccggngggggaagcgcngcctatgtttttgggttcgcccgnccgggtgaaaanttgggtantact

SEQ ID NO: 97391 - DNA, 479 bp, Triticum aestivum
  unsure (1)..(479): unsure at all n locations
  Clone ID: PAT_TA_97391
ccgatccccaccgaagaatctccgacagatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccacctgggtgctccgccttcgcggtggtatgcagatcttcgtgaagacctgacggggcaaggaccaatcacgccttgaggtgggagtcctcgggacaccaatcggacaaccgttcaangggccaaannattcaaaggacaaagggagggncntcccccccggggaccaaacaancgccttcaatcttccgcccggnaaaggaagccttgnnggnt

SEQ ID NO: 97392 - DNA, 469 bp, Triticum aestivum
  unsure (1)..(469): unsure at all n locations
  Clone ID: PAT_TA_97392
gtcagtaaaggcaaaacctattttgtgcgatggtatcatccaaagaagcatgaatagtggtgcagggttgtctccaaagttgaagttattgagcagggcagagaactcacatgtgcgtgtggcaatttcgagcacacatgattgctgtgctgccatgcagtgaaggtcctcgatttccttggtatagaccagataccagcaaaacacattcttgaacgttggaaaaaatgcaagggatatattggcagaccacttggcacatcttcaaaaggataaaatttcagtgacctcaataacattcaagacacacaaaatctatacacacatgcccttgaagttgngagatttgggagatgcaagcatactggcaataatgagtgtgcaagtttaatcctctttgaaatcaacaaatgggntaaatttgaagggccnatnancaactggtngccggggaatgggaatnaaggtc

SEQ ID NO: 97393 - DNA, 478 bp, Triticum aestivum
  unsure (1)..(478): unsure at all n locations
  Clone ID: PAT_TA_97393
agagaactantctcgagtttttttttttttttttttttttttttttttttttttttcanataaaagtttgaatcatcaattttgtcaagggatgtaanacagttttgtattgttattatttttgctagacacaacctcancctaaggttcacaaagggatagaaatagaaatatgttctcnccaaagggcaatatatggatctcacaatttcaatagatgttccaacatcttctgcgcgcaagaattctccgcatcctttaccctttgacatcttatcacttaangtttacccaaatacaccttggggcttctacctgaaacgggggtaaaacaaatggtccataacnatggtgncggggncaatcttnccttccncnaacttaaaaagatcgggtttttgggccnaatggcntncctggcnnccantggccaaaanaaanccttcngccttggcatttccntnaagccccccccaag

SEQ ID NO: 97394 - DNA, 387 bp, Triticum aestivum
  unsure (1)..(387): unsure at all n locations
  Clone ID: PAT_TA_97394
atctctctcccgctctcttctccccaccaccacccaagtcgtcgtctccgtcgccggccgccatggctccgggcctctacaccgacatcggcaagaagaccagagatctgctctacagggactactgcacgcaccagaagttcaccctcaccacatgcacccccgagggcgtcgtgagtaccagtgccatcctctccctcgcacttgttccatagcgatttcgcaaatttgtgtccccgtagcaagtgtcccagttacggtcccgccacgcattccccaacttggatngactanttaacgggtnaaaattgcatgtttagaatgatgcccgccngatntcctaatttgtggcctccggtancggccggttncccganacaanatttg

SEQ ID NO: 97395 - DNA, 470 bp, Triticum aestivum
  unsure (1)..(470): unsure at all n locations
  Clone ID: PAT_TA_97395
gcaatgccagccccagctgcagcttgctcgcttcttctgcttctccttctggtggcgccggtggccgccggtgactgcgtcatccatggtgtccgttggtcggcttgggccaacaggggtcacttgacggagggcctcatcatcccggcgcagacgttcagcgccttcaccttcgacctctccgtcggcttgcagaccctctcggtcatcatggacatctccagcgagcttgtctgggtgcagtgcgggccggggctcaggcgcaagcccaacttcctgcccgggctcaangccctccttcgccccgatcgcgccctgcccatcaatccggtgcgcaaacaactcccgaatnctttggggcaaatncantaacgnccgaaccnggacttgccaatccccggcgaaaacggggttgcngcaaccccgctngncgggaacgtnggngcaaaanctacggnggccgggnaaaa

SEQ ID NO: 97396 - DNA, 463 bp, Triticum aestivum
  unsure (1)..(463): unsure at all n locations
  Clone ID: PAT_TA_97396
atttacccctcaggagcttactgaaccaactgaacaaaagggcaagactgcaggcgaagcatgttctcagcatcagagttattcaaaagaacaagggggtgataactcaaaagttatagatctttttagcacaaattgttccggtagtttcaataggcgtagtgaagcttggtgtagacaggtagaggttcctcctgttacagatgctcgaagtgcatgcagatacagaaatgctatgatggattatgccaatgtaactgttccaaaancaaaagtaactcctgaatccaatgatgaaccaaatgggaaggcttaacggcttttgctgaaagnttgatgattttaagtggtcaaacggggaangggncaatggacttcangaccttccancttcccaagtgctnaacaattaatgaagggccaaantgntgattnnggggtttnctggtttcaaaagnggggg

SEQ ID NO: 97397 - DNA, 407 bp, Triticum aestivum
  unsure (1)..(407): unsure at all n locations
  Clone ID: PAT_TA_97397
ctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgaagctacctcacccgggtgaagttccccgggcgaactacgggatggggaacacccgcggggggctnctcnggcggacccccgagaaccnttcccaangaacccgggnagctngggaggtgattcaactngccnggtggggnncnatggcctgggg

SEQ ID NO: 97398 - DNA, 452 bp, Triticum aestivum
  unsure (1)..(452): unsure at all n locations
  Clone ID: PAT_TA_97398
cctccctccctcccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccaagcatcaatgttgagaacgttgaggacaaccgccgtgccctccgtgagctcctcttctgcaaccctggtgccctccaagtacctcaacggtgtgatnctcttcgaggagaacctgtnccanagcaacaagggtgggaaagcccttcntccaaatcctcaaggggggcaatgtnctccccggaatcaangtgggacaagggtaacatcnaacntgctngaaacaacggtgagancaacaaccaagggtttttttanc

SEQ ID NO: 97399 - DNA, 474 bp, Triticum aestivum
  unsure (1)..(474): unsure at all n locations
  Clone ID: PAT_TA_97399
gaacatcctctccatctctctctgcttccaatggcgaagggcgggctgagcagcaagctcaagtgcatgatcaggcggtggnactcgtcgagccggatctcccgcacgccctcggcggtgtcgcacggcggcggcgaggaggaggacccgtggggccgcggcgtcggcgggggcgggggcggcgcggcgtcgttccacggcgccgacggcgtgcccccgggcctccacccggtgtacgtcggcaagtcgcgccgccgctacctcatcgccgccgacctcgtctgccacccgctgttccaaaacctcgtggaccgctcgggcggcggcgtgggcggcacggcgccgggcggcaacaatcatcgggtgcgaggtggtgctgttcgagcaactnctcctggaatctggggaaacgcngaacccgncaaccccgaantcnctggnaccaagctccgtcnaagtnactacncgggtttn

SEQ ID NO: 97400 - DNA, 435 bp, Triticum aestivum
  unsure (1)..(435): unsure at all n locations
  Clone ID: PAT_TA_97400
gtacccacaaagcaaaatggagcagatgggtgcatgtttgagattatgaccccgaaggcccgttcagacgttcatgtgaaccttcctgctctacagaagcttgattccatgctaattgaagttctggactcaatggtggacacggagtattggtacgtggagagtggcagccgatcaggtggccagggcaaaaataatggtgaaagacagaccaaaaagtggtggcttccatccccttgtgtccctgaacangggctatctcagtttcagcgaaaaaggattgtgtttcaaggctaacttgttcaacaantnctcaaagctgccaangnctaatcaacgnaacaagtccctggctcaagnttccctaattcccaatnggctgttnangggccgccccctccaaangtccnggnaagattcancctnggggggaag

SEQ ID NO: 97401 - DNA, 241 bp, Triticum aestivum
  unsure (1)..(241): unsure at all n locations
  Clone ID: PAT_TA_97401
agcagcacagcacacagcggcttcttctccgttggcggtggcggctagggttttaccacctccctccaaanccctaatctttcnacccaatccaatccgtccgtcgtccangccggnggactcctgcctngattcnaatcgcgccngagttgtacttangtttgngtgcttggtttggtgctgtgcggcggcnntgacgnccaaaccagttcgatctcttcgggcganctccnanatgtta

SEQ ID NO: 97402 - DNA, 389 bp, Triticum aestivum
  unsure (1)..(389): unsure at all n locations
  Clone ID: PAT_TA_97402
ggaacctcctgcagtggacgacgaagaaggggagtagtacccctcctcagcggaccaagatgacctaccatgccggaggcgaagtgttcagcggcagcggatttgaaggtggcggcagtagcagatcggcgagttgattgaaaggcttctaatatgtgatattcactcacaatttgcatgaaggaatgcccacatcggctatatatcaagaggatctgggtaattcatgttatctttaatttcattgatacttcagtaatagtatggaatagtactatgcaatccaaattctttctccaaggagccantagcccangntcttacattttcctgtttttatagatgtccctactaatcaagttcctanttgngaaaatgcttccggtcct

SEQ ID NO: 97403 - DNA, 464 bp, Triticum aestivum
  unsure (1)..(464): unsure at all n locations
  Clone ID: PAT_TA_97403
ctagctcccatctaccggaagtcgccgctgctctctcctgtaatcccctcctactcataatcctaaagatggagagtagcatgtcctccgccgtgcatccgcggagagcaggaggggctgctgtagcatgccaacgacagaccagccgccggatcttggccactgccagtccaccgtctgctgtgccgaccaccgggtctaggctgctatctaagtccccgctggtgttcgacaaatcaggcagcgatttccgatcgaaccgagcgaatttgaactctgatctagatcgggagttcaagggcctctcccggcgaatcctggtaactatgggtatgtatttcctgggtagctttgaanaaataactatgcatatgattatgaatgtgnacaagtcaaaacaactgaanacccnnccaaataanttgctggttggggcaacaaatcntaaaatancaaactcaatt

SEQ ID NO: 97404 - DNA, 265 bp, Triticum aestivum
  unsure (1)..(265): unsure at all n locations
  Clone ID: PAT_TA_97404
gggtgtgcgacgagatcaacgcgcgcgcgggggtcacggtgctggtcntcggcgacggcgccatgtccacgctggtgtcggacgccgnggccgacctggncgccatcaagaacncnctccgcctgcacgcgctgctcgactactgggacttcaagaanctcaaggtcctccccnccggngccgacacgctcaccganaccttctancaggcccgcgggnngttgcggccaccatcnccangtggcatgcnttaagnaatggncaa

SEQ ID NO: 97405 - DNA, 346 bp, Triticum aestivum
  unsure (1)..(346): unsure at all n locations
  Clone ID: PAT_TA_97405
ncccgctcccccgctccanccgcctctcctccgctcccctcccctctcacgaaccctagcgccgccacaccccgcgcagcagccacatcccttcccgctctccgctcgccgcgcagncgtcgcatccctgcccgctctccacccacctcggtcgccccctcccacacctctcctctgncncgagggnggcangccacccaacccccaactcccggnggtctcctctccctccaggggccgccgctctacnctctttccgtgaancctcaagnttccntnaactcttcaananggaagggaatgggaaanggaaggggaanggggagntccttttcnttggnncggt

SEQ ID NO: 97406 - DNA, 447 bp, Triticum aestivum
  unsure (1)..(447): unsure at all n locations
  Clone ID: PAT_TA_97406
ctccgatccaccgccgccgccgcgtacaccacacctcgagagtcctcgtcgccggagaagtagcaagcaagatggccggaaggaagggcggtgacaggaagaaggcggtgacccgctccgtcaaggccgggctccagttccccgtaggccgcatcgggcgttacctcaagaagggccgctacgcccagcgcgtcggctccggcgcccccgtctaccttgccgccgtcctcgagtacctggccgccgaggtcctggagcttgccggcaacgcgggcaaggacaacaagaagacccgcatcatcccgcgccaactgcttctcgccgtccgcaaagaacaagaactcggnaagctgctcnccggggtgaacatcgcccangggggggtcatccccaacatcaactctgtggctgctccccaangaagttcccgggccgcccgccgaagaa

SEQ ID NO: 97407 - DNA, 421 bp, Triticum aestivum
  unsure (1)..(421): unsure at all n locations
  Clone ID: PAT_TA_97407
cccagtccatcccccgtcgctctcacgctcttcgtgctcgccgcctcccttcgcgtgctgcctcatggcttccatcgccggatctgccgtgtccttcgccaagcccgtcaaggcaatcaacacgaactcgctctctttctctggtgcaaggaggggcaatgcatttcttcgtctgcagccagtgccgatgagatttgctgtttgctgctcagcaaagcaggatacagtggaaaaggtttgtgaaattgttaagaagcaagcttgctgttcctgaaggcactgaagtttgcggtaacaacaaagttctctgaacttggangctgattcactggacaacgtttcgaagattgtgatggggccccgagganggagtttcaagattaaggcgtgggangaaaaccaantncncaaggcaattngc

SEQ ID NO: 97408 - DNA, 455 bp, Triticum aestivum
  unsure (1)..(455): unsure at all n locations
  Clone ID: PAT_TA_97408
gtcgatctgatctaagcacacgtaggataaactgccaatctctccaccatcggcgcgttacttttcttgctatcttcagcttcttcttccaggtggaggccatgagcgtagtcatcgaagcattcgtcaattgtcctgaagggaatgtcagggtaaagggttgatacttcaacgtctctcgacccgtcgatgccgaagttggtctggcagccgtttataaatatgtcgtgcgtcagcgaagcgactatgctctccgggatgatgtcttctgcagccatggcgagcaagtgctcctcgctaagcgtgncacgcggcagtgtgcggccgatcttgctctcccagaggganggcatctcgttggggctgaagganattgcaatgcgggggcggaagttggncganctttgtttgaatgctccgggggttcgtancgcggnccttggaccggtgaactt

SEQ ID NO: 97409 - DNA, 478 bp, Triticum aestivum
  unsure (1)..(478): unsure at all n locations
  Clone ID: PAT_TA_97409
agagatcgtcagccatgtccggccgcggcaagggaggcaaggggctcggcaagggcggcgctaagcgccacaggaaggtgctgcgcgacaacatccagggcatcaccaagcccgccatccgccgcctggctcggaggggcggcgtgaagcgcatctcggggctcatctacgaggagacccgtggcgtgctcaagatcttcctcgagaacgtcatccgcgacgccgtcacctacaccgaagcacgcccgccgcaagaccgtcaccgccatggacgtcgtctacgcgctcaaagcgccagggcccgcaccctctacgggttcggcggctagggctcttcctccgccccccctgcaaatnccaaaagtttggataacaaccgcnaacntgtgttagttcctcctgtttgcncnggtagttcngaactgtntccgtnggaacnaaagntgggttcncnatgtgtttcctggggaaaaaaaan

SEQ ID NO: 97410 - DNA, 356 bp, Triticum aestivum
  unsure (1)..(356): unsure at all n locations
  Clone ID: PAT_TA_97410
gcgccccgtttattcccctccggcgcanccgcccccgtgtcctgtgcgcancttctcgaagcctcctccctccctcaatggtggaccaactgaccgacgagcatatcgccnagtttaatcgangcccttcaggctcttcgaatanggatggcgaacggtttgcatcaccaccaaggggancntcgggacccgtgttncggtccctncggggnagaacnccaaccgggaggnacggtanctggcanggnaaatngattcaaannaggtncagacgccgngacgggaaacgggaaccaatcnnatttcccggagntccnggaaccctgntggngaaggaaacnatgaaagggacaact

SEQ ID NO: 97411 - DNA, 499 bp, Triticum aestivum
  unsure (1)..(499): unsure at all n locations
  Clone ID: PAT_TA_97411
cgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaccaaccaaagtactactgcaccggtcatttgatgctccctgggcanccngtgacctttcaacangaaacaatgattnactgggtaccctccccaaggcttgnccggngctggngctcaatcaatttgactccaaacaactggggnggntttggagggntggggancctccaaggggattggccaagancccnttgaagcaatgccctccct

SEQ ID NO: 97412 - DNA, 484 bp, Triticum aestivum
  unsure (1)..(484): unsure at all n locations
  Clone ID: PAT_TA_97412
gccactccatgtggtcggcgactgtcgaggaagattccggtcgtccagtcttcacacggttctttgctatgcgcaggtggtgctgacttgaccgtaaactgtccatttttgaaacacttctaatactagtattctataaaaaatatgatggtaaaaacatgagaactgattatattgaaagtatgtatatataatgatcgtcatattagcactactttcaagtcggtcaacgtagatatacttgctcatactagtacgcaaattgcctcctgtacaccgtgcagtgtccgaaatgacataccctatacaagagaccacaaggttaaatttaattttgcaaaaatttgtttattctngcgaattggttaagcaacaacctaactccnattttatcnttgagggaaaatnattcaatgtcnntggtgntgtgaccttcccnagncggtttttttcaacaacccctggncctttagnaagcaaagtg

SEQ ID NO: 97413 - DNA, 201 bp, Triticum aestivum
  unsure (1)..(201): unsure at all n locations
  Clone ID: PAT_TA_97413
tcatcaaatccaagtaacgtnatagttaacataaatccaccatgaagaccttactcatcctgacaatcattgcggtggcactaactaccaccaccgccaatatacaggtcgaccctagtggccaagtacaatggccacaacancaacaaccattcccccagccccaacaaccacaacaantttttcccccaanccccaaca

SEQ ID NO: 97414 - DNA, 194 bp, Triticum aestivum
  unsure (1)..(194): unsure at all n locations
  Clone ID: PAT_TA_97414
gcagcacacaaccctctccacccccagcaatccatccatccaccccacccccacccccctttctcctcccgtntttggtggnttccctccccgaaatnggcaangntaaantcttcatcaggangntgggatccatgatgttgnangctgagtgttcgtgtacctnntngtcgaccgaggatggaccgcnttca

SEQ ID NO: 97415 - DNA, 490 bp, Triticum aestivum
  unsure (1)..(490): unsure at all n locations
  Clone ID: PAT_TA_97415
gcgcctcctcctgtctcgtcctcgtcccccgtcccctcgtcggcgcccgatctaagtcaagatgagtcgtggcgggagtgctggtggtggtcaaagttctctgggttacctggtttggagatggcgagcctgcaaagcctgctgcagcaccanntgcgaagcccgcacctgctgagaaaccagcaccggcagctgctngatgtacacaagcagattcnacctggcattccaggtnacccgggcgaacaactattaccgtgcagatnncnacaaacacgggcaanttcctttaagggncgtnccttcaaacaaaggttnnatgctgnctccctgggcgggtgggctccgnccctggggcttactttntttgggngggnaaagttgattgttaaatnnatgggtgncctgnctttantnaaccaanccgaatgaaattgggcctggtnacctcctgnttaaccaaaggnnggtgaaaaaactgggnantntg

SEQ ID NO: 97416 - DNA, 414 bp, Triticum aestivum
  unsure (1)..(414): unsure at all n locations
  Clone ID: PAT_TA_97416
cacattagctcatcagcagctcgaagaggatcgtcggcgaccatgtccgggcgcggcaagggaggcaaggggctcggcaagggcggcgccaagcgccacaggaaggtgctgcgcgacaacatccagggcatcaccaagccggcgatccggaggctcgctcggaggggcggcgtgaagcgcatctcggggctcatctacgatgagacccgcggcgtgctcaagatcttcctcgagaacgtcatccgcgacgccgtcacctacaccgagcacncncgccgcangaccgtcaccgccatgggacgtcgtctacgcccctcaaagcgcaaggggccgcaccctcctaacggcttcggggggttaagggtcggtcctncgnccccccctcccttgcaagatncccccanagttttggat

SEQ ID NO: 97417 - DNA, 459 bp, Triticum aestivum
  unsure (1)..(459): unsure at all n locations
  Clone ID: PAT_TA_97417
gcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggtttgagggagaacaaaggaggaggcgccggcaagcantttgaggcaagaagganaactaaggaagccccgannncaagcaagctgcggggccgaaaccgganggccgaagggcgccccgcccgttggtccaagacaagaagaccaaaaggangggccgttggnttgaaggnaanaacccggngggctggccccnaagaaggttaaatgaaaaagggngcccct

SEQ ID NO: 97418 - DNA, 443 bp, Triticum aestivum
  unsure (1)..(443): unsure at all n locations
  Clone ID: PAT_TA_97418
attcatcatcccatcccccaagccataaacccaagtcggactcgccttcctcctccccaactactcctcctcgcctccgcgcatcgcaccgcaccgggggtcacctgagatcacatacacaatggtgaaggctgtggctgtgcttaccggcagtgagggtgtcaagggcaccatcttcttcacccaaggagggagatggcccgaccaccgtgacgggaagtgtcactggactcaaggaagggctccacggcttccatgtgcacgctcttggtgacaccaccaatggctgcatgtcaactggaccacactttaaccccgctggtcatgttcatggggcaaccgaagatgaaatcccccatgctggtgatncttgggaaatgttacaacttggagcggatgggtgtttgctaaacaatcaaatgtttactggactggccaatatc

SEQ ID NO: 97419 - DNA, 326 bp, Triticum aestivum
  Clone ID: PAT_TA_97419
gtgacgcgacgcgcttgcccgtacgctgccagtccgcctgagatatttctctctctctctctctctctctctctctctctctctggggtgagggtgagggactgagggtagaccgcgggtgcccgtgatgctgctgcggagcgcgtcctcgccgctgctcaacgcggcgcgcgtgccggcggccgcggcggtggagcatgtactgggccacgggcacctcgcggtggcgtcgccggcggggcatcacgggccgaggcagcagggggcgctgtgccgcgcattgtccgaggccgatctgctggcgccggtgcagctcccggccgcct

SEQ ID NO: 97420 - DNA, 419 bp, Triticum aestivum
  unsure (1)..(419): unsure at all n locations
  Clone ID: PAT_TA_97420
gttctataaagatttattgcgaatatncangctantataccccatganatggnattgttattgttttagcaaacctgcactgatattagcttagctacttaacatcacagtttcctttattggagccttggagtagtatatgcacattgtgcacctgcacctcttgccaacnatatcaagcctccaaattgcattccttgtcctcagggcacgtnaggantcngtgacaatcttcctgananncaccagtcaaatacccaccaaacttcttcaggtatttgaccgtacaagttggntccgtatccgcatttgangctagcacgananangcgagtgttangagtagcgccnnngctgcaatcttcaaccnaacttgtatgtgncgttgatangaaagcggnggggggccngggtcccaa

SEQ ID NO: 97421 - DNA, 262 bp, Triticum aestivum
  unsure (1)..(262): unsure at all n locations
  Clone ID: PAT_TA_97421
gatcttaanaataagcaantactgtatgtttctggnananaaaggatggcnccaatgtgagcggtatgtctgttttgtttggggagttatgtatatggatgaacttgtnatgatggatttatttggcctatattatgtgtgatggatgcatgaacaaaccaagtgcttattattatgcatgcatatacatgccgtgtgacatgtttgtgaactacactgtntnntacaattggtttatcccangccaaaaccaangataaac

SEQ ID NO: 97422 - DNA, 434 bp, Triticum aestivum
  unsure (1)..(434): unsure at all n locations
  Clone ID: PAT_TA_97422
caaacatcggagaagtgcgctattgatcagttggcagctcgaagcaaccaatgcagtaaacatcattgtggacaaccagttgagaattatgaacagtcaaagatatgcagtgattggcccgaggagcagttaccaatggagcatgaaaagcatcatgtactaaataatgagcaccagattgtggacaagaacactgagaattcacaaaacaaacaggtaattctccttccaaacctggtgtaagaaataatatttagtgttcaagtctgtcctggagaaaagggttggttgtgtttgtgccattgatttattggttggttttgagctttgacctcactaagttttaatgtttgttggagtttgtgtcgaatatttctgtagtgccacaagttgggttggtaattgtgggagaagttggnttttggattcaaacn

SEQ ID NO: 97423 - DNA, 440 bp, Triticum aestivum
  Clone ID: PAT_TA_97423
ccgctgttgcctctccctgtttcccctgcaaagcttcccctatgtgtcctcaccctctgcctcatctcagtctcctggggcacgctcttcatgtccttcttccctcgttcttccacctgagaaggcgcctcaccagcgcccggcctcgccgtcgcgcctccccacgcctgcgcacgctccgccccgctggtgcgccgctcgccggagccgagcaccgccgccgccctaccccgcttccccctgctcccctttcctcttgtctctctctaacctctctctctcccatggacgcctggagctccctcgccggccgatgcgccgccttgccccgcggcctacagatgcggccggccaccccgccggagccgagcaccgccgccgccctaggtgagcagcgtcgccgccctgccccgtttccacccacgggctacagattcggg

SEQ ID NO: 97424 - DNA, 428 bp, Triticum aestivum
  unsure (1)..(428): unsure at all n locations
  Clone ID: PAT_TA_97424
gctcccgctactgctaacgtcccgcacaggggcggcgccaagcgcgggttcgcagactcgctcctcgaccgtactgcccctgctgccggggctggcggggaggaggacaagcaagaagggtgaagccgccgccgccgccggagccngagctccaccanntgncaaggcacaagttgttgggtggccncctgttcggaagctaccggaanaacaccctaacccncaatnccacaaagaccaaggcgggggaaacaanggaaaancgaggcaagatnctnctatgtcaaggtcaacaatgatggggccccanatcctnaggaaggtcnatttttnagacctattccaantatganaganttttcctntgggctgnagaaaaattttnaactgcctttnatnactgggaaaaanaatttcttnaaaaanat

SEQ ID NO: 97425 - DNA, 433 bp, Triticum aestivum
  unsure (1)..(433): unsure at all n locations
  Clone ID: PAT_TA_97425
ccaatctcccttccaaccaatccaccaagcaaacccgatggcccgcacgaagcagacggcgaggaagtccaccggcggcaaggcgccgcggaancagctggccaccaaggcggcgcgcaagtcggccccggccacgggcggcgtgaagaagccgcaccgcttccgcccgggcancgtggcgctccgggagatncgcaagtaccaagaagagcacggagctgctcatccgcaagctgcccttccaacgcctcgtccgggagattncgcangacttcaagaccgacctncgcttccaaagctccgccgtctccgcgctgcaaagagggcgccgaggcgtacctnctcgggctcttcgaggaaancaaactctgnnccattcaagccaagcgcgtcaacaatatgccaagggacatcaactcccaaagacgcattc

SEQ ID NO: 97426 - DNA, 315 bp, Triticum aestivum
  unsure (1)..(315): unsure at all n locations
  Clone ID: PAT_TA_97426
ctttgctccttgtacatctcctcctcttgagagagagagacctctcccttggagatcaagacctcctatggagaagatccctagtggatagatcaagacctcctatggagaagatccctagtggatagatccccatcataggatcaccaagacctcattcctcataggattgggatgaactagcaccttgtatctttcctttgttgtctttgaatcattgtatctctctttgtgtgattggatctaagcatatgtgtgattggatctaaaaaaaaaaaaaaaaaaaaaaaananaaaaaaaanaaaaaaaaaaaa

SEQ ID NO: 97427 - DNA, 328 bp, Triticum aestivum
  unsure (1)..(328): unsure at all n locations
  Clone ID: PAT_TA_97427
cacacgttagaaaagtcactgaactccgcaggcacgccacacaccataccactctctccttccttctttaaaaggaaacctagctagtgcagcgagaccagctccttccacttgctgcagcttcctgatttcatccccccctgnacnntgtgtccngttnttgaggncaccnccggngccgccgccatgttcatgcccaccgnctcccatanngggagntccggngggttccanacngccggnggggannccggcngcttngaatgcancanctgaaattggggaacggcctgcnttctgcncccngctggagctgcnactgagccgg

SEQ ID NO: 97428 - DNA, 330 bp, Triticum aestivum
  unsure (1)..(330): unsure at all n locations
  Clone ID: PAT_TA_97428
aaacaccaaagcaagcttatagccagccaccatgaagaccatgttcctcctcgctctcctcgccttcacggggacaagcgctgttgcgcagctgtncactacctgtnnccaggggtacnggcaatgccagcaacaaccgcaaccgcaaccgcaagcacatccgcanaatnaacanatncgctggtttcctgcaacaatggaaccaaacaccaaatntccaagacaaaantgtngcaaggnaaccggttnncaattggagncgcaaaannnttggcaancggctgggccaaaatttccggagcaaggctccgtggccaaagcccgtttggt

SEQ ID NO: 97429 - DNA, 398 bp, Triticum aestivum
  unsure (1)..(398): unsure at all n locations
  Clone ID: PAT_TA_97429
caggaacaaataagagaagagaagaggcttagagatcacaaaaaagacaataaaaaaagtagatcaaagaccaggcaggatcttcttcttcctcacgaaagaaggatctgcccagtttgcaggaccttcatcgccagaacaaaagaacaagagaagagaagagggcttagaaatcagagagaagaccagaaaaagccagatcagaagagaggagggacgaaaaagaaaacctacctctaggatccanaggtgagaagacttgcccatcttcttcgagattctcttttgtatatcttgctccttgtagtgatttccttgcacacatctttgacttgtatatttggttgtcaaaaatcaaatgaatcgtgcatagtgtgtttgaggaaaaaaaaaaaaaa

SEQ ID NO: 97430 - DNA, 436 bp, Triticum aestivum
  unsure (1)..(436): unsure at all n locations
  Clone ID: PAT_TA_97430
cctctctccgcgcccacgcagcaanccctccactcccgatggcccgcacgaagcagacggngaggaagtccaccggcggcaaggcgccgcgcaagcagctggccaccaaggcggctcgcaagtccgccccggccaccggcggcgtgaagaagccgcaccgcttccgccccggcaccgtcgcgctccgggagatccgcaagtnccagaagagcaccgagctgctcatccgcaagctgcccttccagcgcctggtgcgggagatcgcgcangacttcaanaccgacctccgcttccaaagctccgccgtctccncgctgnaggangccgccgacgcctacctcgtcgggctcttcgnggacaacaacctctgngccatccaaagccaagcncgtcacatcatgcccaaaggacatccaagctcgnccgccgcaattcg

SEQ ID NO: 97431 - DNA, 397 bp, Triticum aestivum
  unsure (1)..(397): unsure at all n locations
  Clone ID: PAT_TA_97431
gcggccatcctcgcctccccgacggntacaagagcccccangacgccctcgtcccctggatcgaaccctagcgccattccctccttccccgcgccacttttcttctcccctgcgcacacccgagcacctcgtcgccatggccgtcgtcgattcacgcgcccaccatcgacctcgggcccaaggaccttgtccagaagaaccggcaccgtctgctacatcgcatatgccgaccanggtcgagttgggattccnatcaacggngggcatcatcgtcttcttcntctgcccggtcggcgatctccttcgatccgctgncgttcgtccaacccagngtcnacgangccgtccggcacgaacctcaggatgttggggcccacangngcccanacgcgaccat

SEQ ID NO: 97432 - DNA, 480 bp, Triticum aestivum
  unsure (1)..(480): unsure at all n locations
  Clone ID: PAT_TA_97432
ccaccccaccccaaccgcccaccacgcgagcttctctcagtcgccaccccttacatctcctccatgggagtcttgccatggagctgccgctgcggactcaaccccacccccagcaagaacaaggggcgcgcccgcgcgtcctcctccccctcatcctgagagcaatgcctatgcgcgtgctgacagttggcaagaagaggtctcaggggacacaacttcttgttgaagagtacaaggagaaactcggtcactactgcgatgttgaggacaccctcatcaaatccaacccaaaactcacaagcgatgttaaggtgcaaattgaagcagaagatgcgtctatgatgcagcagctcaaggctgaagattttgttgttgtgttggatgaaaacggggaaagggattcatgtccgagcagattagctgatttgattggggatgctggnaacacgggaatngtcaangntcaacantttggtnatt

SEQ ID NO: 97433 - DNA, 357 bp, Triticum aestivum
  unsure (1)..(357): unsure at all n locations
  Clone ID: PAT_TA_97433
acaatgtanctcttgtgctgacaaggaagaatgcctcagcgcaaagaccttggggctctccttgtacgtgtgtgtgtgtgtttcctgagagtttcttccatgggtgtgtgttcgagagaaaccacgagaggaagagtagtcaagaggaagaagaagaagcggcgctgcgaggaggcggcgccaacaagccacgcaggtggctgcgcccatctgaggacttaggaccatggtcatggtgcaagaggccttttttggtgggtggcaagacttggaccgtggtactttggcgcganagaatctccgggtgaaatctcaaacgcttcggngtcnaccaacggcgatgcctgtggggtgtcc

SEQ ID NO: 97434 - DNA, 394 bp, Triticum aestivum
  unsure (1)..(394): unsure at all n locations
  Clone ID: PAT_TA_97434
aacactanttaacaccaatccaccatgaangaccttcctcgtctttgccctcctcgccgttgcggcgacaagtgcaattgcgcagatggagacnagatgcatccctggtttggagagaccatggnagcancaaccattacnaccacagcaggacatttccacaacaacgactattttcacagcancaacaactatttcctcaacaaccatcattttcgcagcancaaccaccattttgggagcaacaaccaccattttcncaagcaanaancaattctaccanagcaaccancattttcgcaagcancaacanccangttctaccgcaacanccnccnttttcacaagnaagcancaancagtttttacctccaacaacaancancctttttcc

SEQ ID NO: 97435 - DNA, 498 bp, Triticum aestivum
  unsure (1)..(498): unsure at all n locations
  Clone ID: PAT_TA_97435
caaattttgcaacaacaactgattccatgcagggatgttgtattgcaacaacacagcatagcgcatggaagctcacaagttttgcaacaaagtacttaccagctggtgcaacaattgtgttgtcagcagctgtggcagatccccgagcagtcgcggtgccaagccatccacaatgttgttcatgctattatttctgcatcaacaacaacaacaacaacaacaacaacaacaacaacaacaacaacaaccgttgagccaggtctgcttccaacagtctcaacaacaatatccatcaggccagggctccttccagccatctcagcaaaacccacaggcccagggctctgtccaagcctcaacaactgccccaagtttgaggaaataaggaacctagcgctaagagacctacctgcaaatgtgcaatgtctatatcccctccaatattgcaccaattggctccagttggncatccttcnggttactaaactgagaaataag

SEQ ID NO: 97436 - DNA, 488 bp, Triticum aestivum
  unsure (1)..(488): unsure at all n locations
  Clone ID: PAT_TA_97436
atcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactcccaagctcgcgccgtgcgtggcgtacgtgacggggagggcgtcctcgatcagcaaggagtgctgctctggcgtgcaggggctgaacggcatggcccgcancagctcggaccgcaagatagcgtgcaggtgcctcaaaagcctcgccaccagcatcangtccatcaacatgggcaaggtctccggcgtgcccccgcaagtgcgggcgtcagtgtgtccttcccccaatcagcatgtccaccnactngcgacaatgttcaactagttnaattanaataaaccctttccctaaccctcatgcattggncncccctttggtgt

SEQ ID NO: 97437 - DNA, 498 bp, Triticum aestivum
  unsure (1)..(498): unsure at all n locations
  Clone ID: PAT_TA_97437
tatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcaagcacggaggccctcctcaagcaggtcgactacctgatccgctccaaatngggtgcctttgcctcgaagttcancaaagggttgggttcatcttccgtgagcacaacgcatcccctggggtactacgatgggccggtactgggnaatttgggaactgcctatgttcngggtgnaaccgacgncaanacaaggtgattcaacnnaggggggaaaaaggntcaaaaaaagggnttcccctggacgcnntagttccgcaatcaatccggnnttn

SEQ ID NO: 97438 - DNA, 513 bp, Triticum aestivum
  unsure (1)..(513): unsure at all n locations
  Clone ID: PAT_TA_97438
tgccttgaccgtatcaggaagctttcagacaactgcactggtctccagggattccttgtattcaacgctgttggaggtggaactggctctggccttggctcgcttctcctggagcgcctctctgttgactatggaaagaagtccaagcttgggttcacggtgtacccatctccccaggtctccacctctgttgttgagccatacaacagtgtcctgtccacccactcactccttgagcacactgatgtctctatccttcttgacaatgaggccatctatgacatctgccgccgctccccttgaanattgagcgcccaacatacaccaaacctcaaacaaggctttgttttctcaaggtcaattcatcaactggacaagcnttccctggangggtttggatnggtgcttctgaaatggtttgatnttcaatgaatttcaanaaccaaacnttgggggccctaaccccganggtttcaaattnaaaggctttcccncctnangccccanttgatt

SEQ ID NO: 97439 - DNA, 514 bp, Triticum aestivum
  unsure (1)..(514): unsure at all n locations
  Clone ID: PAT_TA_97439
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccggtcgaggttgaggagaccaagggaggaggcgccggcaagcagtttgaggcagagggagaacgaaagggagcccggagccaacaagcttgcgggccgaaaccggganggccganggcccccgccgttggntccnanaacaagagnancaaagggaagggccttgggcttganggaaaaacccnggcgggngggccnaaggaaggtaaaaggaaaaagncggggncctngttgcccaaggccnaacccggccccnncccccttgcttgttgaaggaaacaan

SEQ ID NO: 97440 - DNA, 495 bp, Triticum aestivum
  unsure (1)..(495): unsure at all n locations
  Clone ID: PAT_TA_97440
ctctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaagttgaggagaccaaagaggangncgccgggaagcaatttgagggcaaaagganaacgaaaggagncccgaagccaagcaancttgcngnccgaaaaccggaagggccgaagggngccccgccngtgggtcnaanaacaaaaanaacaaaaggagggccgttgggttnaaggcnaaaaccccggggggnggggcccaaggangggttaaaagggaaaaaaggngggngccctggttngcccanagggcccaaacccgggccgccncccc

SEQ ID NO: 97441 - DNA, 277 bp, Triticum aestivum
  Clone ID: PAT_TA_97441
aggcactgtttaagacctactaggccgatcaacaagtgaagttttctacatataacttcactataggccttgcttctttctagaaagacctggtctgttattatatttagcctactaggttgcctaaattaaatgtgaagctccatgtttatagcttcacctaaggaactgtcttactcttagactactctgttgttgtacatgaacatgaaatatattctgctatctaagaccagtgtaatatatgtatgttctaccttaaaaaaaaaaaaaaaaa

SEQ ID NO: 97442 - DNA, 446 bp, Triticum aestivum
  unsure (1)..(446): unsure at all n locations
  Clone ID: PAT_TA_97442
gaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcaagctgcaaccatttccgcagccgcnagctacatatccggcagccggcaacttaccaatatccgcangcccgcaactaacaatatccgcnagncggcacccaattttcgaccaacaacaaaccnattgtcnncaaattcggcaaccacaagnattncccaacccataacaaccaaanttncgccngggag

SEQ ID NO: 97443 - DNA, 431 bp, Triticum aestivum
  unsure (1)..(431): unsure at all n locations
  Clone ID: PAT_TA_97443
ccaaaggctgctccgcaccccgcgcggcccaccgacgccccatcanccccgccaccaccccggcacgcccggccaaaaccctatcagctacgtccccgccgccgccccgatctccccgcgctccgccgccccgatctccccgcgctccgccgccgccgccgccgccgccatggaggacgacgccatcaccacgctcatggacatcgacgactccccccgcagcgctgccggngccggcttcctcgacgacgacgacgagggggaacctcctccantcccaccgcatgggcggccgngggaaacgagggggcgggggcccctcccccttccgccgggcttcttcaanacctttcgacnggngncggactttcgacgaactccnnttctgggctggatncgaangngtncctccgggtancaaataattgaaa

SEQ ID NO: 97444 - DNA, 353 bp, Triticum aestivum
  unsure (1)..(353): unsure at all n locations
  Clone ID: PAT_TA_97444
ggccccggcgccgagccccgtgtcggccnccggcgcagcgnngncgtccctcgccgcaacgctcgtcncctccggcgccgcnttcctcttcgccnccgtccgccactgaagcggccncctccgtcctcgccgacngtccgtcngttcatcgntggatcctcntctanatctacatattaccgccgcgtagatccgtttagcgccgctgntgtnaccantatcgatttgttggntgttcgagtccgcntggatctgaatttgcctgctacnggtccnttngctcgngggagcgatnatcgangancgatnattacaatccctggggagaagatttgtaccccctngcggctttg

SEQ ID NO: 97445 - DNA, 505 bp, Triticum aestivum
  unsure (1)..(505): unsure at all n locations
  Clone ID: PAT_TA_97445
ttatagggagggacttatgtcaccacaaacagaaactaaagcaggtgttggatttaaagctggtgttaaagattataaattgactttactacaccccatnagtatgaaactaaggatactgatatcttggcagcattccgagtaagtcctcagcctggggttccgcccgaagaagcaggggctgcagtaagctgccgaatcttctactggtacatggncaactgtttggactgatggacttaccaagtcttgatccgntacaacaggacgatgctatcacatcgaagcctgntgctggggaagncagccaatggatcngtttatgtagcttanccnattagacctatttgaaacnagggttccgtttncnaacatntcttaccttccaatctgtaagctaacngtntttggcttcaaancncctnacggtnactcnnacgtttggagngattctacgnnttccccccctccntnttnaaaccacttnccnancgcccctcctcat

SEQ ID NO: 97446 - DNA, 310 bp, Triticum aestivum
  unsure (1)..(310): unsure at all n locations
  Clone ID: PAT_TA_97446
cccannaagaaggagaagagcggcgtctgatctcgtcggcggcgatggcggcgattcggcgtctgatcccgtccttcaaccgggtgctggtggagaaggtggtgcagcccaanaagagcgccggnggcatcctcctcccggagacctccaagcagctgaactctggtaaggtgatanctgttggcccttggcaagnccgtgacaaggaanggaagctgatccctgttgctctcaagggaaggcnaacatngtgctcctgcnctgaattatggnggtcttgaaagtcaatccttgctccctgaagaaaaga

SEQ ID NO: 97447 - DNA, 268 bp, Triticum aestivum
  unsure (1)..(268): unsure at all n locations
  Clone ID: PAT_TA_97447
aacactatttaacaccaatccaccatgaagaccttcctcatctttgccctcntcgccgttgcggcgacaagtgccattgcacaaatgganactatccacatccctagcttggngaaaccattgcaacancanccattaccactacaanaaatattanggtaccaanaacannaacccatccaacnancaaccanaaccatttccacaacaggccacnangttcacagcangancancgaccattatcgcantaatcaacatccaccat

SEQ ID NO: 97448 - DNA, 295 bp, Triticum aestivum
  unsure (1)..(295): unsure at all n locations
  Clone ID: PAT_TA_97448
ggtgaacaattttattcagaacatgagagtgattaacaacccacactaaaaacanacaaggataaaacattgtgatggagaactatcacattattaagcaccatgcatgacacagaggcatccataaagttcatactaccatagtacctagttattgccactgccgctgccgctcgggtagtagcagtaatcagaatccgaacacgtccatctcctcaaactttttccctctcggccttggnaaccctccatagtgagctctctcctcacggncgccggaacgatnttngggcgc

SEQ ID NO: 97449 - DNA, 342 bp, Triticum aestivum
  unsure (1)..(342): unsure at all n locations
  Clone ID: PAT_TA_97449
gcaatccccattcccaaacacncaatcgcgancgccgcgagcatgttnggnccagncncaccgcggnattatggcagcancgccgtcccanccgttcgtctacatcgactcccgaggcgctccacgctgtcctccccttcccngtcccctgatctcccaactccgcgcggggatccccgacttctccggggacatccaatgnccgcaacgcgtctccttctcgggtccnganctcgccctccgggggngctgctcctcatgccctcaatggtgggcccaacccgtcgctcccctacctngccctnaagggccgncaacttnntttcaccggcantctcctcc

SEQ ID NO: 97450 - DNA, 333 bp, Triticum aestivum
  unsure (1)..(333): unsure at all n locations
  Clone ID: PAT_TA_97450
gcancacaggacacgggagtcgagcccagcactgctgctgcacatgcaatgccagacgctgaagagggtgctagcatggaattgggacgcacctttggctttgcttgagttcactgctggatcaagtggncacagtgtactggacagtgtgttggctgatactcctatgggcngccgaggatgccancatgccctgcctccattgccatgggatgcntgaagggatgcccgccacaaccagtttccaactggccaangacccgtcaaggccctaaaaagancgctttcaacacggttcncnngctttggnnctgntcaagntcagacccgcac

SEQ ID NO: 97451 - DNA, 363 bp, Triticum aestivum
  unsure (1)..(363): unsure at all n locations
  Clone ID: PAT_TA_97451
aanctatatacctacatagtanagncatggcccccaccgtgatggcctcgtcggncacctccgtcgctcctttccaggggctcaagtcnancgccggnctccccgtcagccgccgctcnaacggngctagcctcggcagcgtcagcaacggnggaaggatcangtgcatgcaggtgtngcccatcgagggcatcaagnacttcganacnctgtcttacctgccaccgcncancacnggaggccctcttcaagcaaggctcgaatnccctgatctntttccanntgggttgccttttgccttctngttcacgcaaagggtcgtggttcantcntccngtgtagcaannatagngcatcctcctt

SEQ ID NO: 97452 - DNA, 314 bp, Triticum aestivum
  unsure (1)..(314): unsure at all n locations
  Clone ID: PAT_TA_97452
ccccaccccactccactccccccatcccgctactgcgcgtgctccctccccgtcgcctttcgccgccgcccctccgncccctttcccacccccctttcctcgctccatgnctccgtgattcgcgcccgcccgcagggacgccccctgcccgctcctcggaggaggattggttcttggcagagacnanggacagccaggggttcttgtcgcgctccgcctccgaggttgaagttgantctccccgcngactggattcgcctcgccatctttttcntcngcngggaanaacaacctcccgncnttntcgcgcccag

SEQ ID NO: 97453 - DNA, 414 bp, Triticum aestivum
  unsure (1)..(414): unsure at all n locations
  Clone ID: PAT_TA_97453
aaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaaagctcgcgccgtgcgtggcgtacgtgacggggagggcgtcctcnattaacaaggagttgctgctccggngtgcaaagggctgaacgggatggnccccaacaactcnggaccgcaaagataacctgcaagtngctcaaagagcctcnccancaacatnaagttcaatnnaaattggcaaggtntccggngtnccccgggaagnnccggggtcantgtnncctttccca

SEQ ID NO: 97454 - DNA, 380 bp, Triticum aestivum
  unsure (1)..(380): unsure at all n locations
  Clone ID: PAT_TA_97454
ccactgccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccaacaacccgtggtacggctccgaccgcgttgctctaactcggcccgctctccggggaacccccgagctaactcancggngagtttcccggggaataacggtgggaaanccgcngggctctccgccgaaccccaaaacttncccaaaaaacgggaactngggggnattcaattgcnctgggncaatcttngggccct

SEQ ID NO: 97455 - DNA, 225 bp, Triticum aestivum
  unsure (1)..(225): unsure at all n locations
  Clone ID: PAT_TA_97455
gcangaccgnnaagagcggngccgccgagccgggaagagncaccancccatcttcctcgcctccgcttccgaagggtcagagatggcngnccgtgctaaccacccgtcngtcatgcanaantttggtggacanttccaccttgcctccagcttctctgagggngttcgtgcncgcaacatctgcccttctgtnncatcctatgaaaggcgnttcaccacaagctg

SEQ ID NO: 97456 - DNA, 461 bp, Triticum aestivum
  unsure (1)..(461): unsure at all n locations
  Clone ID: PAT_TA_97456
ccgccactagctccacctggtctcctcctttctcgggatcttgcccgatccacccaattgatcctgccaacacctccttgttttccccagccacacaatcagatccaccttctccactccactcctcccctcgatcccaccaagctattgcccgaggccccgagtaggagtgctcggactcgtctccctacgctgccattcgccacgcccggctaccttgcccaagtgctcaagcacnancaangccgccccttcccttcccttccttcccctgccttcttctcgttctcctctgcttccctctcccgctctcatctctctctctcgtttttatcangaagacnnccatggtgccaancccctggcncccgtccaactcgccctgntaagattccaaacnggncgggaactnnccctggggccctcaacaaccgaaccntngcngtcgcccctngcacang

SEQ ID NO: 97457 - DNA, 389 bp, Triticum aestivum
  unsure (1)..(389): unsure at all n locations
  Clone ID: PAT_TA_97457
gcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacgggangaaggtgggcaanaagggcgtgtaccaattcgttgacaaagtacggggccaaacgtcgaagggtacaacccaatctaaaacgccaagaagggaatggnctgaatctgggtgaaccgcttacgccgggngggaacgancggggcttcttnactgggggcgtcnacctcnccggggctcctccnggggggggggtnctcccccgnntnaaaaaacaaaggtttc

SEQ ID NO: 97458 - DNA, 343 bp, Triticum aestivum
  unsure (1)..(343): unsure at all n locations
  Clone ID: PAT_TA_97458
ctcgcgccgccgccccctgcaccaaccagcgccctgccgccgccgccgccgccggagaaggagaggaagcaaccgcaaccatgggtcgcgtccgcaacaaagaccgtgaagaagacctcccgccaagtcatcganaagtactattctcggatgaacctcgacttncaaaccaacaaagaaggtgctcgagggaggtctccaanctncaatccgaagcgcctccngaacaaagggtnggccgggttnaacaaccatctgattgcgccggaatccaancggcgggcccgtngcgcngggaancccctcaaacttcaaggaaggaaggaangtnaacnccccaatg

SEQ ID NO: 97459 - DNA, 321 bp, Triticum aestivum
  unsure (1)..(321): unsure at all n locations
  Clone ID: PAT_TA_97459
gctgttggtgtcatcangggcgccgatgaagaagganccanccggggccaaggtgaccaaggctgccatcaacaagaagtanttcnacattgatatccaaatcactgttcannacaccaagcantttttagnattggctgngttttgttaangggcattgttcgnnccggnatantttacctgtncagctgttaggcgctgccanatcgtgcccttggtggtccgtcctgtcctgtgccttttacatnctgtttncctaatgtnngcttcggtgacacctggatgtttntgaagacncnggnttgtgtcctttttaagacc

SEQ ID NO: 97460 - DNA, 500 bp, Triticum aestivum
  unsure (1)..(500): unsure at all n locations
  Clone ID: PAT_TA_97460
atgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacacccatatctgcagctgcaaccatttccgcagccgcaactaccatattcgcagccacaaccatttcgaccacaacaaccatatccacaaccgcaaccacagtattcgcaancacagtgaaccaatttcacaggangcagcaccaacancaacaacaacaaccagatccttcaacanattttgcaacaacaacctggattccaatgatnggntgttggtattgcaagcaaccacaacnatagcggcatgggaangattacaaagntttncaccnaaagttcttg

SEQ ID NO: 97461 - DNA, 258 bp, Triticum aestivum
  unsure (1)..(258): unsure at all n locations
  Clone ID: PAT_TA_97461
gctgccttcttcttcagttacccctcgccttctcccccgcctgatcggagtctcggccgcggcagccatggggaagacctaccccgtcgtcagcgccgagtaccaanaggccgtcgagaaggcccggcaaaagctccgcgccctcatcgccgagaagaactgctccccgctcatgctacagnctccgcgtggnactcnngctgggaccttcgangatgtcntccaaagaccnggtgggnccgttcggngacgatgaat

SEQ ID NO: 97462 - DNA, 201 bp, Triticum aestivum
  unsure (1)..(201): unsure at all n locations
  Clone ID: PAT_TA_97462
cctcaaccatgctccgcgctgggagtcgcctcctctgccgggggtgttgcgccggagggcgctgcctccctgcagagctgaggncgtgccatggccaccacttcgcgggntgcgcgcctctctgtgagctagcgcgancgtggccgtggtccctgcgctcgtaggggcaaggccgagggccangcgcggngtgtnccggga

SEQ ID NO: 97463 - DNA, 190 bp, Triticum aestivum
  Clone ID: PAT_TA_97463
aatcggatcgggtttagcgagggagggaggctgcctaagctaggcttaggctcaggctccggctcaggattaccgaagaaatgatttgttactcgactcgactagggcgcacgcacaccccgctgctcccttcccctccgtctctcccccccacccccgcccctccctatctcctccctcgacgaaagca

SEQ ID NO: 97464 - DNA, 368 bp, Triticum aestivum
  unsure (1)..(368): unsure at all n locations
  Clone ID: PAT_TA_97464
acccaatccccaccgaagaatctccgaccgatcgaagccagggctctctcgtcctcctccccaagatctttgtgaagaccctcaccggcaagaccatcacccttgaggttgagtcgtcggacaccatcgacaatgtgaaggcgacgatctaggacaaggaggacatctccctgggaccaagcancgcctcatctttgccggcaagcagctcgaggatgggctgtacatttgctgactacaanatccaagaaggnggtccaccccttcaactgntgctccgccttcgntgggcggtatgnaanattcttccggtaaagaccntggacngggcaacnaccatcanaactggnangggtgggagtccctcc

SEQ ID NO: 97465 - DNA, 401 bp, Triticum aestivum
  unsure (1)..(401): unsure at all n locations
  Clone ID: PAT_TA_97465
actctcctcttccgctataagaaacgtgatgaggatgccagttcgtcccatccctcagttcctcgaatctcgccatgaaaccagacaagcagtcgagcacctgcctgcgcgcagatgactgacccagcaaactagcaagaacttccgctgctcggctcggtcgatctactgcttgatccgggccggcgatggagggcatcttccccttcttctgctcggccatcaggaggcggaggccnaggccgccggaaccgctncgggcgnctcgccgtccccggcaggcgcaggcgggntgggtttgnggcggnaagnaccagnagcnttcngcggcaagcgngggcattaccaantacncctcaagagcctnatngtttcccccngtccggacgtnccnggggggg

SEQ ID NO: 97466 - DNA, 159 bp, Triticum aestivum
  unsure (1)..(159): unsure at all n locations
  Clone ID: PAT_TA_97466
attacacatnatanaccctncacntangcggaccattntgccaattatgatactntaactctacaccccacctgagacatgcagcntgggcctccagtgtgnagcccnnaacnactcttcgttcatnactcgncgcaagtacaagaactaacaccctaa

SEQ ID NO: 97467 - DNA, 475 bp, Triticum aestivum
  unsure (1)..(475): unsure at all n locations
  Clone ID: PAT_TA_97467
gtcagaccttgagcacccgtttagctatggaagcaaagggggctctactagtgttgagaaggactacggtggcgtcggcggtggtatcttgtggctgtttgcggatgacctgctaatgaatggtacagtgctcgcagatggtggtgatancaantgataagngcgggggtggttctggtgggagcatctatatcaaggccgagactatgcatggtgctggcaaaatcagtgcttctggaggcaacggtttggctgggggtggtggaggacgggtttccaattaatgttttcagtaggcatgatgatacccaaatatttgttcatggtggaatgagttcgggctgcccaaataatgcangagctgcctgggnactccttatgaatgcannaaccaanaagtccttggtgtttacaacaaataacaatgagttcacaaaactggncacccctcctgttgggncnttccaaaatcaan

SEQ ID NO: 97468 - DNA, 345 bp, Triticum aestivum
  unsure (1)..(345): unsure at all n locations
  Clone ID: PAT_TA_97468
ggcgcacggaggcncgntgcgcgtaggcgtgggtgcgcatggcgcggatctggcgtacngcgcgggatccggcggtgggctgcnaaggtgaagctcctctgctctggtgctgggtgggcggcgagacgaggctggtggtgatcccgttgagctgcgggctgggcgcncggtggccgcgcgggattnggttggggngtgcgccggtngcagcnggacntcngnccgccctgntnccngggcgaancccaaactggnttttgccaaagtncctacccncgnngccggcggtcttggtcaagngcctgccggcggnttttcaanntcatcncgaccctntcaccnccc

SEQ ID NO: 97469 - DNA, 312 bp, Triticum aestivum
  unsure (1)..(312): unsure at all n locations
  Clone ID: PAT_TA_97469
cgccatgccccgcctcccccacagcccgatcccgccccgtctctcccacactcccatcccgccnggcctccccctcctaccctgccttcttccccggcgccgtcctgggacntccgccgccgccaccgcgtggatccaacgancngcccctggtacnngccgacgcctgtgcccaacgccgttgaagacccacncaccccangngctccanccggagacgatacactcctatcancngtcggngatctcccgcactgtcccggtgngnaggantttcanccccngcntggncgtcagnaatcnccgcaaccc

SEQ ID NO: 97470 - DNA, 409 bp, Triticum aestivum
  unsure (1)..(409): unsure at all n locations
  Clone ID: PAT_TA_97470
gtctcgttctcttttcttgcttgtttcccaagaaggagaaggagaanagcggcggcgtctgatctcgtcggcggcggngatggcggcgattcggcgtctgatcccgtccttcaaccgggtgctggnggagaaggtggtgcatcccaagaanagcgccggcgggatcntcctcccgggagacctccaagcagctgaactctgggaaggtcataagctgttgtgccctggcancccgtgacaaagaaagggaagctgatccctgttgctctcaangaaggtgaccantgtgcttcctgccttgaattatggtggggtcttgaangtaaaancttngctcccggaanaaaagnantaccctccctctanaanacgtcnaatnacaaatcntgggcnanccctccanntaagc

SEQ ID NO: 97471 - DNA, 198 bp, Triticum aestivum
  unsure (1)..(198): unsure at all n locations
  Clone ID: PAT_TA_97471
cgcctactgcgggcccatcggcttcgagtacatgcacatccccgaccggcgacaagtgcaactggntccgcgagaagatcgagaccgtcgcgcccagggagtaccccaaggaccgncgcctcgtcatgctcgacaggctcatctggagcacccagttcgagaacttcctcgccaccaagtgggccaccgccangcggt

SEQ ID NO: 97472 - DNA, 296 bp, Triticum aestivum
  unsure (1)..(296): unsure at all n locations
  Clone ID: PAT_TA_97472
aagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtncagcagggcggttcgccggcccggggctgctgcaccggcatccangaacctgcntngcggnggccaacancancccctaacgggggcaccatctgngggntgccncaagaacgtc

SEQ ID NO: 97473 - DNA, 443 bp, Triticum aestivum
  unsure (1)..(443): unsure at all n locations
  Clone ID: PAT_TA_97473
ccaagcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcaggcaacaaccaacattttgggaagcaacaaacaaccattttcctcaagaacaaccaattccaccaacagnaaccaaccaatttnngnagcaaacacaacnnatttcnacngaanaaccaacaatttcnaancaacaacaaccanttttanctccacaacnatcaccttttccacnacaacnacaaccccaacangnggnggaacaacaaatccctggtg

SEQ ID NO: 97474 - DNA, 337 bp, Triticum aestivum
  unsure (1)..(337): unsure at all n locations
  Clone ID: PAT_TA_97474
agcctctcccctcctcccccatccccatcccagtcagccaaacgcccaacaccacctcgtgacttcgtccgcggaccttgcctcgcgcttcgactcncgctccgatctccggccatggccgcgcggcgccncggatcccccgcctccagatngctgcccccctccacgctcntcctcctggccgccgtcctcttcgcggtctccccgtcggcgcgcgncctccggttananntcgagtccggccataccaagngcatctccgacgatatcaaggtcgactccancggtcggtcnggcaantaaagncgtngnccgctncccnactccaanttatccc

SEQ ID NO: 97475 - DNA, 506 bp, Triticum aestivum
  unsure (1)..(506): unsure at all n locations
  Clone ID: PAT_TA_97475
atgccctccttgctttcactcttggagtgaagcagatgatctgctgctgtaacaagatggacgccaccactcccaagtactcaaaggcccgttacgaggaaattgtcaaggaagtctcttcgtacctgaagaaggtcggctacaaccctgacaaggttccctttgttcccatctctgggtttgagggcgacaacatgattgagaggtccaccaaccttgactgggtacaagggccctacccttcttgaggctcttgaccagatcaacgagcccaagaggccctcaagacaagcccctggcgtcttccccttcagggacgtttaacaagattgggnggcattggaactgtgcctgttggggccggtgttgaanactgggtgccatcaaanccctnggtatnggctggtaacnttggncccaatgggtccgacaacttgagggtcacttccgtttganaatgcaancaccgantnccccccttggnaggggccttcccnnngggaaat

SEQ ID NO: 97476 - DNA, 511 bp, Triticum aestivum
  unsure (1)..(511): unsure at all n locations
  Clone ID: PAT_TA_97476
ccaaggtgcataacaggttcaaacatacaaggttcttacaacacaacaggttgtaaaacaaacaccacaaagcaaatgttcaaacagacagataacagataaagccactcgggcagatcataggattgcagcagcatgccttgggaaagcaccaggaggcaggctctagtactcgtcgccctcgtcaccgtcctcaccctcgtcaaactcaagcaccaacttcttcatagtcccttctccaaggggcaagcaaagattcctcacggggcctcaagagaactctcccctcctccaatggcccttcacccaacgttccaagtgggaccgaaagggcgcgcttttgcaattacattaagggtcaaaacntngtnggttccaatgcgggggaagaagaagaagaagaagaacttantnctcngaggggggggggcccgggtnncccaaatttcggcccctaanngtngaggtcntttttaacgngcngtccatngngcggtncnttttanaaacg

SEQ ID NO: 97477 - DNA, 231 bp, Triticum aestivum
  unsure (1)..(231): unsure at all n locations
  Clone ID: PAT_TA_97477
aacaannggtacacattaaangaaaanagggaanttaacaacagagtatgatatttacttggagagctccatanaagtccatctttcccgaggagcatatgactgaaatgnttaatgngtttgtcctttccagaaggcaattcctacgcaagtgctggagggattgttattgatccanangttgtttgnaatctaagacaccgnnncctgcagntaanccagcangactac

SEQ ID NO: 97478 - DNA, 495 bp, Triticum aestivum
  unsure (1)..(495): unsure at all n locations
  Clone ID: PAT_TA_97478
ttggatcagcactcacatattgggcctccaaaagcactgattgtttaacgtaattcaagtctatgtgcatggagaagtacacggaacgtgtgcacctactagtgccactctcgatacttcttctcgtttgcttcgttgctcatgttcaatgtgggagtattgaagacataggtaacanggaagatnantntaccatatggactgtgtggaccacctagaataattccaaaatgcaatgatggctattgttggtgttgttttgcggatcccaaatacttttgctatcgcacgcctgaagattgtgataaggaatgcccgcaaacaattcttcactaaacactgtggcggcagcgcccggccacctccaaccctcccaacaaaactaaaatattttgtcactaaaaaataaaaaaagagtagcgtataatcttggtccttacaagtttgggngnttacatgttggngaacncccatanttaatcnagaaaaacaaaa

SEQ ID NO: 97479 - DNA, 491 bp, Triticum aestivum
  unsure (1)..(491): unsure at all n locations
  Clone ID: PAT_TA_97479
gcgacatttgctggatgctttatgagcttatacatatggtatatccataagtacaactctttggatgggcggcctgatatcttgcagtcattatattctgcacttcaaccatctactacgactttggaagatcgaagatattatgatggccgtctctctgaccagcaagatggcattacttcaataccaaaggggaagaatattcattacctgagtgaggaggtgctgcgcttgcaaagaatgtttggagcaaataccaagaagaactggatgtttgggaaaaacccccaagggttgattctggtcaatcctttancaacccngtggaccaaagaaactttcgagnaatcccccgccggagatgaatcaaagtncactcaaaagcttcaacttgctcngggnttgatttgatgaaaaggnctcnggggattcaacgtnntccttttngcaacannccntatggntgaaaaaaatggntagacccanaggct

SEQ ID NO: 97480 - DNA, 505 bp, Triticum aestivum
  unsure (1)..(505): unsure at all n locations
  Clone ID: PAT_TA_97480
gtgaattacagtgctaatgataaattctttgtatcagacatgaatggacatattcaagatttcctttcacctaggcttggttagttggccacttcaattcccactttctgtcatgtaatcttgatgtcgatatttcgacattacatacagaatatgatgcattatgtagaagttactaatggtcaaaaaaattctggatatgacacttgcttactcctattcacattatgtagaagttgcataaggcagaacaagaataagaacatttgtcagttttttcatgtgctggttcagcaagcggggcantgctcacgacaagagttgggngtacatcatatatnatacatatgttgtcgtgtnctnaataaatnggcgangagatatcctatcccgcctggncatncctttcccaaaaccttgggttttggncaatcctctgtccggnngtccnaccttgccgctttcctncaatggggttggcaatttcctttgaanaccggcngtn

SEQ ID NO: 97481 - DNA, 479 bp, Triticum aestivum
  unsure (1)..(479): unsure at all n locations
  Clone ID: PAT_TA_97481
acaataccttcgcttcttcttttgctaaaattcagtagcatattcaacagcccaaagcacatacatagcaccatcttcagtaggaaaagaaaattcagcaacactccataggagcaacaacatatgcatcaacacaaaaattcactagcaccgcgaccaaagcaacggtagaactccagcctatgctggtcttgcaacacgcatgaagtaggtccctgctagctagtgctttcccttcccttgtaacttccctcctgcgttcagaaatgcgtcaagaacaaaagcaacaagaatccggtgtaatctgtgcgatggtaatcaggtgcatgctaaaccttttctcagttgcttcttatttttgtcttattttatcatcatcaaacaagcaagtgggagggaatgggtttaatcaaggacganggggaatatactcgggcgacatcaagagggaaggagacgnccggccngcatctcgtccg

SEQ ID NO: 97482 - DNA, 440 bp, Triticum aestivum
  unsure (1)..(440): unsure at all n locations
  Clone ID: PAT_TA_97482
gcaacactagttaacaccaatccaccatgaagaccttcctcgtctttgccctcctcgccgttgcggcgacaagtgcaattgcgcagatggagactagatgcatccctggtttggagagaccatggcagcagcanccattaccaccacaacagacatttccacaacaaccactattttcacaacaacaacaactatttcctcaacaaccatcattttcgcagcaacaaccancattttggnaagcaacaaccacattttctcagcaacaaccaattctaccacagcaagccaccatttttcggcagcaagcaagcaaanctagntctaccgcaaacaacccaccattttcacnaggcaagcancnagccaagtttntacctccaanaacaattcaaccctttttcccncgaacaacccaagcaaccnccaagccgggttgg

SEQ ID NO: 97483 - DNA, 374 bp, Triticum aestivum
  unsure (1)..(374): unsure at all n locations
  Clone ID: PAT_TA_97483
cccgctctagctatgatatattagttgctggatttaggaggtttgacttgcatcaaagacttgaggcaaccataaaagatangagggaagctggatttgcatgatgttccaaaaacgtatgtacactggcttcctttgtttggtatttccagaagttataaataaagtgcatcgaactatcagcatcagatctggtgccacttttcctagntctaattagatttaggaacgatcncctcacaggcacaagtancatgttggngtattnatgtattnaagccaagatatcacaangctttnacgtactctgcagaccaatnncgaggtttgtgtanctggggggatgggttttaanccactcctgnanaccaaat

SEQ ID NO: 97484 - DNA, 331 bp, Triticum aestivum
  unsure (1)..(331): unsure at all n locations
  Clone ID: PAT_TA_97484
gcctatcgcgaggcgacggagcggcngcgccagaaatcgancggaaccgcggtgctgccggcgacgcctccgacggtcgcctctctccgttgcagattttgtccaagatcctgctttgcacacgatgctgccttgtcaaggaatanctaacgcnaacggcnaantctcagntatttgggattccctgccgcaaaccgcctatggatatcctgaanagatcaattgggtttcttccaaacaaaggcgtttcttaaanctgcggggcanacgcgcanttcgttgngacaaagaaaatcccccctttnngagnttgtttttcnnttttcccgtc

SEQ ID NO: 97485 - DNA, 220 bp, Triticum aestivum
  unsure (1)..(220): unsure at all n locations
  Clone ID: PAT_TA_97485
ctctctctctctctctctctctctctctctctctctctctctctctctcnctctctctctctntctctctctanngggagnggtataaaactcgctcaatngngatcgntntaaaacgcgntnactgggagnnntctgacantatcgaaattnanaanattgnggcagatacacaatttaatcagatgtgcataatagcaaacaggtcgngaantggtgg

SEQ ID NO: 97486 - DNA, 346 bp, Triticum aestivum
  unsure (1)..(346): unsure at all n locations
  Clone ID: PAT_TA_97486
gccggatccccctcccccctccctccgcaccgcccatggagctggcgacgcgcgatctcgcggcgctgggcgcggcggacctggtccgggtctccgccgcgatnccgcgcgccgcgccgcgcaccttcgcgctgctcaaccgcctgcctcgtcttcccggctctccttncgcgttgctgggggcantccctctttaaccaacccaatcctccgncggaatccgganctncgaataaancggcaactncgggcaatnggtncccctcntngnctaacaattnctccaactcaacttnctctttaacttttcggtnctntncaacggcggcggcgtttttaacggttg

SEQ ID NO: 97487 - DNA, 508 bp, Triticum aestivum
  unsure (1)..(508): unsure at all n locations
  Clone ID: PAT_TA_97487
gnacaccagcctcctcactcctcacagtcgcagcatcctctcagtcctcaccttcctcccctcgccaccacccaccaaggaaaggaggatgtcttgctgcggcggcaactgcggntgcggngccggntgcaagtgcngnaacggntgcggcgggtgcaagatgttccccgacgttgaggccaccgccggcgccgccgncatggtcatgcccaccgcctcccacaagggggaagctccggcggggttcgagncngtcgggcgggngaaaacggnggctgcgactgnaaccanctgcaaagtgcggnaacgggccttgcgggtggctccctgctngcagctngcnaactngagccgggcgccccaagaagggcggnccgggcnaaggncnagnaactaaggantgaaggangggcaantggggnaaangnaaacaacaacaacaacaaacaacaattaatnagccgggggganggggcccggccccggnggggggntnaattnaaataaa

SEQ ID NO: 97488 - DNA, 432 bp, Triticum aestivum
  unsure (1)..(432): unsure at all n locations
  Clone ID: PAT_TA_97488
agcaagcggcagcagcactttccccactcctctcgctcctgtaacccgaaggaggtggcaagccggcgacctactccaattcagaggagctgagctgtgggctgtggcaagggcataatgcggggggccctcggacgcgacgcctccgccggcggtgccgggaggagggaaaggaggagacnacnccgcagacggcatcattcnccacgancggaangtgccanggacctgccgttcctcnccctcntccccngcttctgggtngacaatgattgtcaactccaagatttcgggtttaaacatgggaancccgctcaaggtcgctccaanttccccacctncccttttttttcttcgggaattantttttccaccgcctgccnggttcnanccctaactgcgaattaanttttnccttttggggngattccc

SEQ ID NO: 97489 - DNA, 576 bp, Triticum aestivum
  unsure (1)..(576): unsure at all n locations
  Clone ID: PAT_TA_97489
aagagttatagggagggacttatgtcaccacaaacagaaactaaagcaggtgttggatttaaagctggtgttaaagattataaattgacttactacaccccaagagtatgaaactaaggatactgatatcttggcagcattcgagtaagtcctcagcctggggttccgcccgaagaagcaggggctgcagtagctgccgaatcttctactggtacatggacaactgtttggactgatggacttaccantcttgatcgttacaaaggacgatgctatcacatcgagcctgttgctggggaaaacagccaatggatctgttatgtagcttatccattaaacctatttgaagagggttccgttactaacaagtttacttccaatgtangtnacgtatttggtttcaaagncctacgtgctctacgtttggnggattacgaaattccccnacttantcaaaaactttcaagggccgcctcaaggnatncaaattnaaananaaaaattgaacaatatggncccccnttttgggaagtncattaaacaaaantggngnatccccaannatatggngagcgg

SEQ ID NO: 97490 - DNA, 500 bp, Triticum aestivum
  unsure (1)..(500): unsure at all n locations
  Clone ID: PAT_TA_97490
cgaactaagtggttttgatgcaaagggttttgcatttgcaaataaagccgccgcaagacgtccgcctcgctcttctcccgagcctggncctcatcctctcgcctctctccccccacacatgcttagcaatctancgttagcgcctccgtccatctcntagctgcttcgntggcgatcaagaggaccaaggccgagaagaagatcgcgtacgaccaagaagctctgccaagctgctccacgagtacaccaaggtgctcatccccgtcgccgacaatttcggctccaaacaagctccaaggaagattcggcaagggtctccncgggcgaatccaatccgtgctcaatgggcaaagaacancctcaatccggccgctnnaatcaagggtggactccggagaanaacgggaacaaaggncnttctttnagctcaacaaacctcctcctcggtnaagntggggctcancntcaacaaagggtgacctcaaaggggggtcccggag

SEQ ID NO: 97491 - DNA, 530 bp, Triticum aestivum
  unsure (1)..(530): unsure at all n locations
  Clone ID: PAT_TA_97491
gccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaacattgatattgccctgtggaagttcgagaccaccaaagtactactgcaccgtcattgatgcccctggtcaccgtgacttcaacaagaacatgattactggtaactcccangctgactgtgctgtgctcancaatgactccaccactgggggttttgangctggtatctccaangatgggcanacccgtgagcaccccctccttgctttcactcctggngtgaagcaaaatgatntgctggtggaacaagatggntgccaacactccnaaatactc

SEQ ID NO: 97492 - DNA, 552 bp, Triticum aestivum
  unsure (1)..(552): unsure at all n locations
  Clone ID: PAT_TA_97492
gtctcgagttttttttttttttttttgcaggtccaaatgtccatcatccatagttggacaagtgtctcacaaatagcaataacttagacagagtacgctgtcagcctgctagactttaatcgattgcagcagctgctcgcactcagactctcacacacatacgtgacagaaatcaccgtatcgatcacactatacatcgtataccgtatacttaccgtatacatacgggtacgcctcaaccatcactagaatggaagggcagcgcggcgccaccattgccgctggctcgaactcggagcttcctcatcttatatgtatagataagctagcaagctaacactcggggtagttgggagcggtccttggngctatcctggcaatagtagtanaacaatggncccgctgctgcgcccanctcaaggggggggnccgnngggcgctcaacccgnctccggggnccgncgggaaggggntggnacnacnccgggggcnccgaactcgnanncggggaacctgaaatccttgaccccggcacaaaagggtnggaaccgt

SEQ ID NO: 97493 - DNA, 581 bp, Triticum aestivum
  unsure (1)..(581): unsure at all n locations
  Clone ID: PAT_TA_97493
ctcactcctcacagtcgcagcatcctctcagtcctcaccttcctcccctcgccaccacccaccaaggaaaggaggatgtcttgctgcggcggcaactgcggatgcggcgccggntgcaagtgnggcaacggctgcggngggtgcaagatgttccccgacgttgaggccaccgccggcgccgccgccatggtcatgcccaccgcctcccacaaggggagctccggcgggttcgagacggccggcggggagaccggcggctgcaactgcaccacctgcaagtgnggcacggcctgcggntgctcctgctgcanctgcaactgaaccggcgnccanggaggccggccggcgaggcgagcacnacgatgaggaggacaactgganangcaatcaacannaccaccaccancatcactaaccgctgcatgcgcccgcccgcgcgcgngattaataaaattaaaccgtcctgtgttccntaactctgtactgtacnccgtgttttcacancagtgtccntgctcattcctcnactcctanacanggggccnnctcnacttngnaaaaaaaaaaaaaaacnccagggg

SEQ ID NO: 97494 - DNA, 329 bp, Triticum aestivum
  unsure (1)..(329): unsure at all n locations
  Clone ID: PAT_TA_97494
tcaaaaccaagcaatactagttaacaccaatccaccatgaagaccttcctcatctttgctctccttgccattgcggcgacaagtgccattgcacaaatggagactagccgcgtccctggtttggngaaaccatggcagcaacaaccattaccaccacaacaacaaccaccatgttcacagcaacaacaaccatttccacaagcaacaacaaccaattattatactgcaacaatcaccattttccgcaagcaacaacaaccaagttttggccngaacannaaccaagttnttaatnctggaacaaccaacaatttcggnagnaacaacaa

SEQ ID NO: 97495 - DNA, 516 bp, Triticum aestivum
  unsure (1)..(516): unsure at all n locations
  Clone ID: PAT_TA_97495
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttgggcagcaacaaccaccattttctcaagcancaaccaattctaccacaagcanccaccattttcgcagcaacancaactagttctaacgcaacaagcaccattttcacagcaacaacaaccagttttacctccacaacaatcnccttttccacaacaacaacaacaccaacaggtggggnnacaacaaatccctggtggtcnagccatncattttggagcagntaaacccaaggaagctnttccttcannaagangtgccaccctgggggaatgcacaa

SEQ ID NO: 97496 - DNA, 173 bp, Triticum aestivum
  Clone ID: PAT_TA_97496
gaggaaatagttggactcccagaacatttttctgtattctaaagttttgtcctcgaccattagggatatttttttttttgctgggttacatttgtatcagttgtatgcatgtgttgttgtacctgaaaccctgatgcaatcatcaaataatttgtacgttggattcaagcaaa

SEQ ID NO: 97497 - DNA, 486 bp, Triticum aestivum
  unsure (1)..(486): unsure at all n locations
  Clone ID: PAT_TA_97497
gggcaatgggttcccaacttccattcctcgctgaggccacctcttctgcttaagcgtcacaggcgcgctgctggcttgatactgaaatcgcagaactttgcagcatctctcgcggagttgatctcaacagctgcgaaaagcaaatggtgatnccagcagtgtcttcacaggattcgggcagatttcatgcaagatgtgtgacgatataaagctgaccatgtccgcggcctggcatggaccgtctgcgattcctcggaagaacaaaccgaccgctgggagggtgcgtcgatcttgaactgaaanttgacgaggactcaaaggtccggggcctgggtcnaagngaaaaaaggtcaaaccccaggnanctgaaattgggccgtcancgctgtccgggtaacnncccggagaaacgacctaagntnggggaattaaccctgccggaaaaggntncccaanggggggntgcaaaaaccgggntttaaacnt

SEQ ID NO: 97498 - DNA, 194 bp, Triticum aestivum
  unsure (1)..(194): unsure at all n locations
  Clone ID: PAT_TA_97498
cagnaacanccatttcnatnacancaagcnacaacnanagtcgnaancatttccatcacaacaaccatntctgcagctgcaancatttcccgcagccgcanctaccatattcgcagccacaaccatttcgaccacancaaccatatccacantcgcanccacnatattcgcaaccacaacatccaattttacag

SEQ ID NO: 97499 - DNA, 485 bp, Triticum aestivum
  unsure (1)..(485): unsure at all n locations
  Clone ID: PAT_TA_97499
gtttaaacacagaagaaactgcaactttccaaggctaacccatctactctatggggcttctcaaggatcccatagctctcttcctagcggccatcgttgtgaccgccatggccatgtcatcatgtcatggtgcacaagaggagtgcaaccggatcctgccgtgcacagacagtgcgttgctacatccaantggcaaagctggggtacaaggaccccaagacgcgccgtgagcgtagccctcccactaaaggccagttctacgatacatgctgctgtctaaaatcggagatggacaacaacggggctgccctcggagcgatcgatcttaacttggcccgtcgtagtggttattgaaatgtttatccngagcggtgttgatcttgcggcgtaatattaataantggtgggattgaccgggcctnaatcaaagtttaangaaataangatnntgggngaaaaaaaaaaaaaaaaaagggggggggccc

SEQ ID NO: 97500 - DNA, 513 bp, Triticum aestivum
  unsure (1)..(513): unsure at all n locations
  Clone ID: PAT_TA_97500
ctcgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagattccagctggcattccaggtagccgggcgaacaactattaccgtgcagatggccagaacacgggcaacttccttacggaccgtccttcaaccaaggttcaatgctgctcctggcggtggctcgtccctggggctactttgtttggncgggaaaggtgatgttaatgatggngcctgctttaatgaaacganccgaatgaaattgggccnggttancnctggtaatccaatgttgggggaaaaaattgggaagtggtttgggtttgaagcaantttaacaacctggcgttcnaatgntccnccngtccgggnannggttcat

SEQ ID NO: 97501 - DNA, 437 bp, Triticum aestivum
  unsure (1)..(437): unsure at all n locations
  Clone ID: PAT_TA_97501
cacacaccttccaaccaaactccaccgccgtcgaagcacccatggcacccaaggcggagaagaagccggcgccggagaagaccccggcggggaagaagccggcggcggagaagaggcccgcggccgggaagacggcgtccaaggagggcggcgagaagaaggggaanaagaaggccaagaatagcgtggagacgtacangatctacatcttcanggtgctcaagcaggtgcaccccgacatcggcatctcctccaaggccatgtccatcatgatctccttcatcancgatatcttcnanaagctcccggcgantccngccanngctgggcccgctacaacnagaagcccaccatcacctcccggggagatnaanactncgtccgccntcgttcctccccgggcgaagctcncnaacgaagcccgttctcnnagggga

SEQ ID NO: 97502 - DNA, 402 bp, Triticum aestivum
  unsure (1)..(402): unsure at all n locations
  Clone ID: PAT_TA_97502
attccatccccattcccttccccaanaatttccccaccggtgacgacgccctccccaaatccgatccgccgccgcncgccgttgacgccagccatggcngctgccgcccgccgngccctgctcctcctcctcgccgccgccgccgtggccctcctcgcggtgcccccggnggncgccgcccgnccctgcggccgcgcgcagacgctgntnatctccttcncctccttctcccgccccaaccnggacnccgccgacnccgtccncgctcaccanacccgtcgtcancgttcctcccgcagtccgcccgcctcggctccgnaancggttncacgccaaaggancaaggaccnagccncaagattngcnggcccggccgnagtncttccggggtngttnggaacc

SEQ ID NO: 97503 - DNA, 318 bp, Triticum aestivum
  unsure (1)..(318): unsure at all n locations
  Clone ID: PAT_TA_97503
ggcncatctcctcnaaagntcgnactgatncttgtgtcacccggaaagggagtaagnnaggggactcttgggttcgggactanttcttggntgagatcttctccctctgtcactccctctctctgtttcngctcnctacacaatgggtanacatcgcatcttgagcagtaangacttcgccatcagcaatcagtgtggttagccttntnngagtatgatcncacccgaagcagngcactcgacatnaataacngagaancattnctctctgttcttcgtgnttccgcacgctaatggtgacattccngcncttataaa

SEQ ID NO: 97504 - DNA, 471 bp, Triticum aestivum
  unsure (1)..(471): unsure at all n locations
  Clone ID: PAT_TA_97504
gcgcgacaaccaactccgcctcgacctcccgccgcatctccgacgacatggcccgcaccaagcagacggcgaggaagtccaccggcggcaaggcgccgaggaagcagctggccaccaaggccgcccgcaagtccgccccggccaccggcggcgttaagaagccccaccgcttccgccccggtatcgtcgcgctccgcgagatccgcaagtaccaaaagagcaccgagctgctaatccgcaagctccccttccancgcctcgtccgggaaattgcccaagacttnaaaaacgaactccggtttcaattcttccgcggtctccgccttgaaggaggcnccnaaggctnactcctcngggtggttcaaggaaaacaattcgntggncaatcaanccaaagggcgttaacaataangccaaagggnattcaantccccccccccaatcttgggaaaanggctaaattgtcccccn

SEQ ID NO: 97505 - DNA, 439 bp, Triticum aestivum
  unsure (1)..(439): unsure at all n locations
  Clone ID: PAT_TA_97505
cgcccgcaccccaggaaggtaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaggaacaangctcgatnaatatcaagattctcaaagttccccgcttaaccactgaagtcctgcaatgaangaagatcgaaggacaacaacaacactccgtcttcatcgtcnacctgaagggccgacaaagaagaaaatttaagggcgctgtcaaagaaaaatgttcgaacattcaaggccaaagaaagggtaacaaccctc

SEQ ID NO: 97506 - DNA, 452 bp, Triticum aestivum
  unsure (1)..(452): unsure at all n locations
  Clone ID: PAT_TA_97506
gcgagtccggcgtcatcgcgcagtacgtcgacgaggcctggcccgccgcctccgccgcgcccctgctgcccgaggatccctaccagcgcgcgatgcaccgcttctggaccgcgttcgtcgacgacaggttctggccggcgctggacggcgcctccctggcgcccaccccggaggcccgcgccgaggccgccgccgaggcccgtgccgcgctgcggcacctcgaggaggccttcgccgcgctcagcaacggcggggccttcttctccggcgcggcgccggggctcctcgacatcgcgctcggttgcttcctgccggcgctcaaggcctgcgagcgcctcaacggngccctcctgctggaacgaaggcgccaacgccgctcctcaaaaaatggaaccgaaaagttcccccggggtccaaccaatccgaagngctcctggccggaaaacggacca

SEQ ID NO: 97507 - DNA, 356 bp, Triticum aestivum
  unsure (1)..(356): unsure at all n locations
  Clone ID: PAT_TA_97507
tcagaaccaaaccatacgcggcaacgccctgccatggccatcaccgccaccaccgacggtgccgctgcgcccacccatgccgcgaacggcacgggcaaccaggccggccgcgaccacgtggtcgtgttcccgttcatggccaagggccacaccctcccactgcttcacttcgccacggcgctcaccgagcaacaaaagaactccgcatcaccgtggtcgtcacgcccgccaaacctcgcctttcgcccgcaagcccctcccggngttcggttgccctcccccgttcctnccgttcccgtccgctggccgccggtaacaatcggggtggggttcaagggaaacctgnctnggccggg

SEQ ID NO: 97508 - DNA, 341 bp, Triticum aestivum
  unsure (1)..(341): unsure at all n locations
  Clone ID: PAT_TA_97508
cctcctcgtgccctccgccgccgccgcagcctctgcctcggcctcgaggcctccgcccgccacctccgcgcggncagggntcganaggcgancccggtctgcccgcccccgcttccggaacaccccgcccccgccgcaatgnagagcgcggcggccatcgggctcctccggtcatgcnccgtcgtggcccatcctcaagagccctanncccggggccgcccgcctcccggactcccgcacggacctccgccttctccgccagccgcgcccacacgcggnacctcgtggngncggccggggttcnggccgcatcgggctcnttccnngggtcncctgaagaa

SEQ ID NO: 97509 - DNA, 268 bp, Triticum aestivum
  unsure (1)..(268): unsure at all n locations
  Clone ID: PAT_TA_97509
aacaantcccccagcanccacaacaatttctccaacaacangcanttcccccagcaacaacccccccaanaacatcaatttccccaacagcaattgccccaacaacaacacatcccccancaataananatcccccagcanccacantaaatcccccaacatcaacanatcccccagcacccaaancaattcccccaacannaatttccccaccaagcaattcccggcaaccaggaattcncacaancaaacaancaattcncggcaa

SEQ ID NO: 97510 - DNA, 510 bp, Triticum aestivum
  unsure (1)..(510): unsure at all n locations
  Clone ID: PAT_TA_97510
cacccctcttctccgatggcccgcacgaancanacggcgcgcaagtccactggcggcaaggcgccgaggaagcagctggngaccaangcggcgcgcaagtcggccccggccaccggcggcgtgaagaagccccaccgcttccgcccgggcaccgtgggcgctccgggagatccgcangtaccaagaagagcacggagctgctcatccgcaagctccccttccaagcgcctggtgagggaagatcgcccaggacttcaagactgacctgaggttccagtcctcccgcccgtgtcggcgctgcaggangncgccgagggctacctggttggnctgttcgagggaaacaatctcctgcgccatccangccaagcgcgtcaccaatatgcccaaagacatccaagctcgcangccgnatcgcngggaagcgcggctaagttttcnttcgccgccgttgaccaatctggggtagtactggcccngggtcngggttttcngntgntggcggttgaa

SEQ ID NO: 97511 - DNA, 488 bp, Triticum aestivum
  unsure (1)..(488): unsure at all n locations
  Clone ID: PAT_TA_97511
gctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatgggaaaagaagctttgaggatatcgttccttcatcccaaaactgtgacgtcccccaatgtttgaccggccaaagatttacaagcngaattgacataaactggatgaagggatatngtcaacccntctnactggaaaantggcnacaactaaagggtggaccctgaangcttcccnnctggatgntgnttctggccttgggcaanattaaanantnggattttnctgaa

SEQ ID NO: 97512 - DNA, 505 bp, Triticum aestivum
  unsure (1)..(505): unsure at all n locations
  Clone ID: PAT_TA_97512
gacctatggccgccgccacccgctgactggtctcgcccccgaaaccaccgccgcctcgccttcaacctcctcctgccgccgagcccacggacgcctccccgcaccggaaggcgcccccgagccccggaccaacggcaagccttggcggtgacagaggtgtccccgcagccgctgtccagtacggcattatatatcttgcggctcacgaacctcaaaggaaaccgcggggggcatggccatggccgtggcggaggcgcgtctccggcaggacaaggtgaagaagttcgaagatttcgttgaccggcggctcaagcctgaccttgtgaacgccatagcccaagcgcgataacttgttccaagcagcaaaaagactttcttggntttgaaagaagnacatcaaaactttggaaaaaaatggtntaacgaagcatgcnattcatnggtcaaatcntggntnaaaaaggngtaaatncnaaggaanaaattgnccggacnacaaaggana

SEQ ID NO: 97513 - DNA, 497 bp, Triticum aestivum
  unsure (1)..(497): unsure at all n locations
  Clone ID: PAT_TA_97513
ccgggacgccgtcctcgtcggcatgaagaagacgctcgtcttctacaccggccgcgcccccagcggcgggaagacgccgtgggtgatgcacgagtaccgcctcgagggcgagctgccccatcgccttccccgcaccgccaaggacgattgggctgtttgccgggtgttcaacaaagacttggcggcgaggaatgcgccccagatggcgccggcggccgacggtggcatggaggacccgctcgccttcctcgatgacttgctcatcgacaccgacctgttcgacgacgcggacctgccgatgctcatggactctccgtctggcgctgacgacttcgccggcgcttcgagctccacctgcaagcgcggccctgccgcttgagccggacgcggagctaccggtgctgcatccgcaacaacagcaaagccccaactacttcttcatgccgggngaagggcaacggcaatcttggggggcgccgagtactcaacctaacaag

SEQ ID NO: 97514 - DNA, 507 bp, Triticum aestivum
  unsure (1)..(507): unsure at all n locations
  Clone ID: PAT_TA_97514
cgccaccganaagacgacatctttgattttcccggtcatgcgactttggctggaacatcatcgatgatccctcgctcgacgacctcccccatgagatccagcagcctgcgtggcgcagagaatcgtttcttttttcagtttggacacgaccggagcttgccgcagcccacatctacaggggggcagctcggagcccaccgatgtgcagtttcggcagctcgtcccatgcagctcggtttgcgcaggcaagcggtttggcatctcgcatggtgtaattcgccaggntttgncatctcgtcctgttttgcagtctggttgccctgcaggttcaattcaacancaaaaaaacagcatgcagttggccggaccgtgcggtccagtgctcctaatgaaagtttaanagtttgngggtgttcaaacgtgctcccgattanccaagtatttcantttttcaagttttgcttgttctgcccggggtgggngccgttctcttccaaggggtgtttt

SEQ ID NO: 97515 - DNA, 334 bp, Triticum aestivum
  unsure (1)..(334): unsure at all n locations
  Clone ID: PAT_TA_97515
gttnagtcctgtgcgtgttaatgtaacaggagcagttgatggccttgctggcattgggagaggaaacncanatntgccnggcgctgcttgggcncctacaggttatgtcttctctcgtgttccctangggcttggttcaaggaatggncaacaatcatttgcgantgatnantcanaacctacagttcaccanaatggngatattcnaggatatggtctgacngnattgntcaatcttagccatctanngcaatgcttctcatcagtcaggcananagtntttttgaggcaggcntgtaaanctatatattcnggtgcctgctnttgtttccaa

SEQ ID NO: 97516 - DNA, 473 bp, Triticum aestivum
  unsure (1)..(473): unsure at all n locations
  Clone ID: PAT_TA_97516
gctaggctccccaccaagatcctgtggatgcggaggatgcgcgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgatcagtttgaggcgaagcgcgccaagagcaaggctagcagggagaggaagcatnnccagaggggaggagagattggctcagggccccagagaccatgcaccagcaccagcggctgcagctcnanctccggcagcagcggcaccaangaaggncaaggccaanaagtgaangtctgacatgaagctttagctttctggnanttataanggttanccctgattttggnncatctgaanttcaaaactgttttctgtgcaatatc

SEQ ID NO: 97517 - DNA, 506 bp, Triticum aestivum
  unsure (1)..(506): unsure at all n locations
  Clone ID: PAT_TA_97517
agaagctcaaatggctcccaaagttgctgttgccaagaagggcgatgccaaggcccaggccgccaaggttgccaaggctgtgaagtctgggtcaatcaanaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactcgtcttcatcgtcgacctgaaggccgacaagaagaagattaaggccgctgtcaagaaaatgtacgacattcaagccaagaaggttaacaccctcatcagggcctgatgggcaagaaaaagggcgntacgttaaactgacaccagacctacnatggctcttgatngttggccaacaagatncgggatcatattaagtcangagggganggtcctggcanttt

SEQ ID NO: 97518 - DNA, 443 bp, Triticum aestivum
  unsure (1)..(443): unsure at all n locations
  Clone ID: PAT_TA_97518
gccacactctccagcacnagcaggncggcggcangcagcgcangcacancagcaaatggctaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgaccccgggcgggccgccgtccgcggggccggcgcgtccctgctcgccgcggcgggcgcggtgaccgcgtccgcggggccgggcgctcgctctgggtcnaacgagcgggatgtcnacggaagggnaccgggcttaanccttgggggcttgagcaacaacnctgctggggggtnggattctcctggggcgnccttcgggcctcaatctgggtncgctnctaanaaccggtctnaancctncccgggtcc

SEQ ID NO: 97519 - DNA, 488 bp, Triticum aestivum
  unsure (1)..(488): unsure at all n locations
  Clone ID: PAT_TA_97519
gttaacaccaatccaccatgaagaccttcctcatctttgctctcctcgccattgtggcgacaagtgccattgcacaaatggagaatagccacatccctggtttggagagaccatcgcagcaacaaccattaccaccacaacaaacattatcgcaccaccaacagcaacaacatttaccgcaaaaacaattcccccagccacaacanataccccaacancancanatcccccaagcaaccacancaattcccccaagcancaattcccccaaacaancagcaattttccccaacaancaaagaatttccccccaaacaanaatttcccggcaagcaacaagtttccanccaaacancanttttaccggcnaacaancaantttnccccaaacaaacnaaattccccccaannaaggaaattttccccccaacaaanaaaaaanttcccccccaagaaancaagggattttaacngcaaccnaatntttg

SEQ ID NO: 97520 - DNA, 467 bp, Triticum aestivum
  unsure (1)..(467): unsure at all n locations
  Clone ID: PAT_TA_97520
cggggggccagtctggactaatcgatccccaaatcgaaagcaaaccctaagcgcatacgcgacagatccccaaatcgggagcaaggtacagcagtgcgagaggagatggcagatgcaaatcaaggtggtgatccggcgcccctgccaatcaggacttgcccggaatcacaacgtaagcatctagtttctgcatcgttctcgtcggatccgttgaatatctcttttttcgccggtcaaattcagccgtcccgcaggggatgcaatttctaccggtggcaacacgggtacgccgaccatctcgcttcgcttggccctgccgccccacaattggcgcaaatccaaccaccggaggagcaaggcgggcaangactgggagttcaagatatacagctgcccgcaagcaacaaanggggcgggnggaangccccccctganggcaagcanntcaattcctcaattcnggcgca

SEQ ID NO: 97521 - DNA, 456 bp, Triticum aestivum
  unsure (1)..(456): unsure at all n locations
  Clone ID: PAT_TA_97521
acaacaaccattcccccagcaaccccagagaccacaacaatcattcccccagcaaccagaacaaataattccccagcaaccgcaacaaccattccccctacaaccgcaacaaccattcccccagcaaccagaacaaataatttcccagcaatcccaacaaccattctctctgcagccacaacaaccattttcccagccccaacaaccattatcccagcaaccagggacaaataattccccaagcaatcccaacaanccatgccccctccaaccacatcaaaccattcccccaagcaaccaagaacaaataattcgccagcaacccggcaacaaccattcctcctacaatcgcaacanncattccaccaagcaaccaagaacaaaattatttctcaggancccccaanaaaccattcttctctgcagccccaacaanccattttcccaaggccccan

SEQ ID NO: 97522 - DNA, 451 bp, Triticum aestivum
  unsure (1)..(451): unsure at all n locations
  Clone ID: PAT_TA_97522
ttcctctcctccgccgccaccaccgtgtttctagggtttcccccatccccaattcgtccgcccctacccccagcccggatctagcagcgatggagaccgcagaggcaggcgagaagaagatgatcatgctcaagtcgtccgacggcatggagttcgaggtggaggaggcagtcgccatggagtcgcagaccatccgccatttgatcgaggatgactgcgtcgacaaaggcattctgattcccaacatcaactccaagatcctctccaaggtcatcgagtactgcaacaaacacgtcccgaccatgccaggtgtcgtcgccactagagccacaggtgccgctgcgtctgatatcgtggctcctggcgccctanctgaagacctcaaagatctggggncgcaggaattcancaanggtcaacccgtggnaaccgcttncgagcntcaatccca

SEQ ID NO: 97523 - DNA, 453 bp, Triticum aestivum
  unsure (1)..(453): unsure at all n locations
  Clone ID: PAT_TA_97523
ggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaaagactggtgagaactaaaaggcttctttatgacaccaagggtccgcttccgccttcantctgtcanggattagggatgctaaagttcaagcccctgcaangtcnagtctgtccaattccgggcaa

SEQ ID NO: 97524 - DNA, 470 bp, Triticum aestivum
  unsure (1)..(470): unsure at all n locations
  Clone ID: PAT_TA_97524
gaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcaagcgtcatattatggttgatggaaaggtccgcactgacaagacctaccctgctggtttcatggacatcatttccaattcccaaagactnggtgagaaactacaaggcntctgttatgacaccaaaggggtcngcttccgccttcactcctggtcaangggaccanggattnctaaaggttcaaagctctggcaaggncaagggnc

SEQ ID NO: 97525 - DNA, 468 bp, Triticum aestivum
  unsure (1)..(468): unsure at all n locations
  Clone ID: PAT_TA_97525
agcaacaacaaccattcccgcagcatcancaaccacttctactgcaacaacccccattttcacaacaacgaccaccattttctcagcagcagcaacaaccagttctaccgcancaaccaccattttcgcaacagcaacaacaacaaccaattctaccgcaacaaccacctttttcgcaacaccaacanccggttcttccgcaacancaaataccatatgttcagccatctatcttgcagcagctaaacccatgcaaggtattcctccagcagcactgcatccctgtggcaatgccacaaaagtcttgctnggtcncaatntgttgnggcagngcagttgccatgtgattgcangcatcnatgttgccaagcannttgnccgcgaaatccccgcnancaagcnacgcttatgnagtgccactcccgtggccnatcnatcctaaccncngaattcggtccctaanaactg

SEQ ID NO: 97526 - DNA, 172 bp, Triticum aestivum
  unsure (1)..(172): unsure at all n locations
  Clone ID: PAT_TA_97526
gagctccgagtcggccgacctcgacgccgccgcgctccggttctccggccngggggagatgntcgcgccgctcatggagggcctcgatccggattccggcgacggctacggtcgcgccgccggtggcnccaggagggagggatggggcccgctggtgtgccctnttagactc

SEQ ID NO: 97527 - DNA, 508 bp, Triticum aestivum
  unsure (1)..(508): unsure at all n locations
  Clone ID: PAT_TA_97527
gganaacagagggatcgaataaacctcggggccctgcggttgtgttgccaatcggcgaantgcaccgcggcgccgcggatggggcctctcaaatctcccttcttgtccccctctggccccaggccaacttcccctgcaagcagaaggccaccgccgcccggccatcgtcatcaccgtctgccgccgccccctccgctgccgcctccgcccccgctccctctgccgccgccgccaccccttccctcgtcttccctgccattgccgcctccatgccccccaagccgatgccctccaaatgccgccgtcacctcctctgcccccgccgccgccgctaacccccgtcacctctcatctgtcccgtctctcgtcgtctccgccattgccgcctccacggngtaccctccggaagncggngcgccgtctgactccgccggtggggggaagccttcctcggggcttccgggntccccaaacatnggggtgggcccctccttgtntggccccttcn

SEQ ID NO: 97528 - DNA, 440 bp, Triticum aestivum
  unsure (1)..(440): unsure at all n locations
  Clone ID: PAT_TA_97528
gcctccccatccgaacctacttttcctgatatctgatcctacatggcatgcgaggcatcaccctgaggctatgcattggctatgccctaatgtgattcttaggaagtatcttttttctcgaacacaacaaaatgttgtctgtatttgccttcttaggaaatatcgctgccaatatgtctttgtgtgatgtcccatccttcgtaggtgtggggatcacaagatatagcaaggaactagaagcatttcacgcgctttgttgcgccgcttccgcagatggactgcggcatcctcatatctgtacaccaggacaacctatcacactcaatgcacgaacatgcatcaatcatggcatgcttagataaacatccaangacatgtaaaaaatggtatcgggtgggctctaatatcccttggtgaaactcatccatcaccnaagggca

SEQ ID NO: 97529 - DNA, 455 bp, Triticum aestivum
  unsure (1)..(455): unsure at all n locations
  Clone ID: PAT_TA_97529
ctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtggtgcaacatagcagctgcttggtaatgtgggaagcagtgttgtcaagcaactaaaagcnatccccaaagcagtcaaagatgtgagggncatccacaacgtcgtggcacgccatcgttttgcaacangcaacaaanaattgggtacaaagggtantttcaacccaaacctcaaggaagcaaacaacnaacaaagggtcnaaca

SEQ ID NO: 97530 - DNA, 438 bp, Triticum aestivum
  unsure (1)..(438): unsure at all n locations
  Clone ID: PAT_TA_97530
cggacaccggagagagacaggggtgaagatgcaggttgccgctggttcgcaggcggcgatggagaggggcgaccagcagagcgccaagaagccgaggctgacttgctgagccgctcctccatgccccagtgaagcaggagaagatctccaggacgccgcggagctcgggttcctgcgcctgcccgctgatggaatggccgtggccgcgcgccgaccagtacgttgcccggaccagcgcggggacagcgcgggtacacggccaagggcttgccccccgtgaaccctccggaagtcacgaagccatcgcgtaagattgccgcagccgagttcgatttcagttccaagttcagccggcgacagctgctaatccgcgcccggcaaggattgggagattccggtaaatnaaaagggcngccggcggtgggaacanctggccca

SEQ ID NO: 97531 - DNA, 448 bp, Triticum aestivum
  unsure (1)..(448): unsure at all n locations
  Clone ID: PAT_TA_97531
attgacaccaccgcataccaagcactataaaaagcctcgccccttacccctcgatgcttcctcaaacctagcctctcccctcaagcctcatcacaaaatttcccttctctatgtaatatgtccatctcgtgcctatccatgacatcacctccactgctatcaaagttgtagtgaagtcacttcttcatcgaatttttagtggatccgctctcttagtgaattatgttagtgcaaagtaggtcaacctacaaccatggttgcgagcacagggtggacgaccacatggcagatagtcgcggagatctgattaatgagttcatggaggatcaacttggtgatgattatgtatttgagtctaagatggttaatcccaaggcgcatcagatnaatgatgaacatattaagggagttaaaggacaatgcctctagtctctttaacaaacaaaan

SEQ ID NO: 97532 - DNA, 457 bp, Triticum aestivum
  unsure (1)..(457): unsure at all n locations
  Clone ID: PAT_TA_97532
gatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaaagcatggtcacgcaaagtgtcactttgttgccattggacatcctttaaatgggaaaagaaagctttggagggatatngttccttcatcccaacaactgttgaacgtcccccaatgtttnaccggccaaggattaatcaagcttgattgaaaataancngantggaanggntaatntnaagcccttcttacnngagagtngggnanacacaaaagggg

SEQ ID NO: 97533 - DNA, 391 bp, Triticum aestivum
  unsure (1)..(391): unsure at all n locations
  Clone ID: PAT_TA_97533
cgtcccctttccccttcctgcctactcggatcccccagatcccgatcggggcgtgacaaattggtaatcanagccaccgattcctgccacaatttttttccgctgctccgcaaatcctcttggtcttgatccgtaacacccaccgtcgcggagttggatcgggctncggagaggagcaacggcaccatcgaagccctcgggtgcaagacgccggcagttgctgtccggccatggnacgacaacaccaagcaacgctcaaagggcctggatggganacaagtccttcgcctcgccctcgaacnnagcaagaaagattgaacaacnaanaaatgaactnggnagggtgcaatgcccgcctttcaancgccgcaaggtcncgcnaagnattccg

SEQ ID NO: 97534 - DNA, 417 bp, Triticum aestivum
  unsure (1)..(417): unsure at all n locations
  Clone ID: PAT_TA_97534
gcaacactagttaacaccaatccaccatgaagaccttcctcgtctttgccctcctcgccgttgcggcgacaagtgcaattgcgcagatggagactagatgcatccctggtttggagagaccatggcagcagcanccattaccaccacatcagacatttccacaacatccactatnttcacaacaacaacaactatttcctcaacaaccatcattttcgcagcaacaaccaccattttgngcagcaacaaccaccatttttctcaagcagcagncagnttctaccaacagcannccaccattttccncagcaaacaacanctnngttctacnggcagcaaccaagcaatttttcaacagggangccagcannncagtttttannctccaacaancaactcnaccttttnccnatcaat

SEQ ID NO: 97535 - DNA, 373 bp, Triticum aestivum
  unsure (1)..(373): unsure at all n locations
  Clone ID: PAT_TA_97535
gccgccggcgcagcgtcctccccgcgactccgatggccagcaagtgggtcaggcccgaggtgtacccgctgttcgcggcgacgggcgtggccatcggcatctgcgcctttagcctccttcgcaacatcaccggcaacccangaantcagggtcaacaagatggggagggcagcgggagtgcttgagaaccangaggaggggcaggcgcnacgccgagcacgggcctcaagagcctatgtgcagggacatnacccccnaggattnntgcccagggaatcanacatgttncttcancaagcccaangatggaagnnncttttaagtcgggtctggtnnnctcgccaantntagtaactntctgtnggccnaaggt

SEQ ID NO: 97536 - DNA, 318 bp, Triticum aestivum
  unsure (1)..(318): unsure at all n locations
  Clone ID: PAT_TA_97536
gagaacttggaactctgggaaaagaatagataaagcatctcgaaccgagaatttgatgagcctccggaataaagaattaatcatttgggtgaatcaagaataagaattatgttatgctcgtccttcaccaattaaattgatgacgagcaaatggattgcatacaacttattctcgaagaaaggattaggatagatatagcgtcaacttgagaatgccttcancgaaacaccggtgggaatcggaacaacgaatgaattgatatganaatgaaagaagatgaatcttgcacgaaccaccgtaagaattggaaatcggta

SEQ ID NO: 97537 - DNA, 314 bp, Triticum aestivum
  unsure (1)..(314): unsure at all n locations
  Clone ID: PAT_TA_97537
cttgaaagcgctgctttgggagcaaggtgggaatttggtcttcgccgtgaggtgtgcggtgggtgtcggcggcagcagttatctccagcggtgctgtgctccccctggtggtgggctgctgctccttcgtgcatcctggtagctctcctcttgaatgcccaaagtctctggttttcggtgttgctctgctccaaggtnagaagtcnacnnacaggtcgcgtctgctnaatcccaaccatgtggatgcatccggttgncnctcaaccaaggttctanggtgnacntgtttatttgtccgacggnttcnggngccc

SEQ ID NO: 97538 - DNA, 352 bp, Triticum aestivum
  unsure (1)..(352): unsure at all n locations
  Clone ID: PAT_TA_97538
cactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacancaacaacaactatttcctcaacaaccatcattttcgcaggcaacanccaccattttggcagcaacantcaccattttctcagcancaacccaagttctaccacaagantcaacaatttttcggcagcaancaacaactagttctaccgnagacaanccancaatttttcacagg

SEQ ID NO: 97539 - DNA, 419 bp, Triticum aestivum
  unsure (1)..(419): unsure at all n locations
  Clone ID: PAT_TA_97539
cccagccccaacaaacattcccccancaaccccaactaccatttccccaacanccccaacaaccattcccccagcctcaacaaccccaacaacaatttccccagtcacagcaaccacaacaaccttttccccagccccaacaacaattcctgcagccccaancaaccgcaacantcattcccccagcaacaacaaccgttgattcagctatctctacaacaacaagatgaacccctgcangaattttctcttgcagcaantgcaaccctgtgtcantggtgtcatccctcatatcaatggatcttgccacgaagtgattgccanggtgatgcagcaacaattgttgccaagaancgggcatangattcctcaagcagntccangtgntggnagccatccatagtggccgtgcatttcca

SEQ ID NO: 97540 - DNA, 500 bp, Triticum aestivum
  unsure (1)..(500): unsure at all n locations
  Clone ID: PAT_TA_97540
accagcctcctcagtcctcacagcatcctctcagtccttagcttccttccctcgccgccacccaccanggaaaggaggatgtcttgctgcggcggnaactgcgggtgcggcgccngntgcaagtgcggcaacggctgcggcgggtgcaatatgttccccgacgtggnggccaccgccggcgccgccgccatggtcatgcccaccgcctcccacanggggagctccggcgggttcganacggccggggagaccggnggctgcgactgcancanctgcaagtgcggcaccgcgtgcggctgctccntgctgcagctgcaacnganccggcgncccatgaggncngccnggcacnggcnatcaannatgattaaggaggacaanncaagcangcaccaatcaccaccatttnaancancatccagcgtntcaatcancaattcctcctantgcncttccgcggngntccctgctgcttgaantaaaaataaanncaacttttt

SEQ ID NO: 97541 - DNA, 310 bp, Triticum aestivum
  unsure (1)..(310): unsure at all n locations
  Clone ID: PAT_TA_97541
gaaggatgttatgacgaaaaatgtttcaatctacaaagctcaagcatctgctcttgaagctcatgcagcccccaattgcaaggttctggttgttgccaacccagcaaacaccaatgctctcatcctgaaggagtttgctccatctatccctgagaagaacatcagttgtttgaccccgcctagaccacaacagggcactccggtcagatttctgagagacttggtgtccaaagtttctgacgtgaaggaatgctattnatctgggggtnancactccgncccaagtcaagtaacccttnatnttnaacca

SEQ ID NO: 97542 - DNA, 437 bp, Triticum aestivum
  unsure (1)..(437): unsure at all n locations
  Clone ID: PAT_TA_97542
ccacctctcgccggagccccagcaaggagcaagcaaggaagatggacgccggcaagctgaagaaggtggccgggaagaagttcggcgggccgaggaagaagtcggtgaccaggtccgtcaaggccgggctccagttccccgtcggccgcatcggtcgcttcctcaagaagggccgctacgcccagcgcgtcggctccggcgcccccgtctacctcgccgccgtcctcgagtacctcgcagccgaggtgctggagctggccgggaacgccgccaaggacaacaagaagagccgcatcgtncccaggcacctgctgctgggncatccncaacnaccaggagttcngggaggttgctgtccgggngtcacccantcgcccacgtggggnntcatcccccaaaaagtcanncccnggttcttgtctcccccangganaggc

SEQ ID NO: 97543 - DNA, 221 bp, Triticum aestivum
  unsure (1)..(221): unsure at all n locations
  Clone ID: PAT_TA_97543
ctcacccccacaatctcctcctcctccgccgttctccggctcccccggatcgcccgccgccgcccgctctcctgctcggcctcgccgctcgccgtgttcgccaccatggagtcnccgcccgagggctaccgcaacaangtcggcatctgcctcgccggaccccaccctcaccanngatcttctccgcgtccaaggatcganatccccaagggngtgggcaa

SEQ ID NO: 97544 - DNA, 348 bp, Triticum aestivum
  unsure (1)..(348): unsure at all n locations
  Clone ID: PAT_TA_97544
tcaaaaccangcaatactagttaacaccaatccaccatgaanancttcctcatctttgctctccttgccattgcggcgacaagtgccattgcacaaatgganactanccgcgtccctggtttggngaaaccatggcagcaacagcattancaccacaanancanccaccatgttcacagcaacancanccatttccacagcagcancngccaattattanacngcaacaggtcaccaattttcgcagcagcaacaaccannttctggccgcaanaagcangccangtttattaatnctgcnancanccaccatttttncgcngccaatcancattccagttttaccca

SEQ ID NO: 97545 - DNA, 513 bp, Triticum aestivum
  unsure (1)..(513): unsure at all n locations
  Clone ID: PAT_TA_97545
aatttctcgtctacagacatggacatccaaaatctggtctcgttctgccgcgtactgatttatttggaactagcttcttttgagggcatcaaccatctaaccgttcaagctcctaaactgaaacttctttatgttgttggggatgttgaaagacattaatttcgatgcccctaatttggaggtggccgctctctttcttgatcagaaagctatangcacatcattctgattcaactgcgcttcaaaaggaaaagctatgccaagcaagttagtgggaagcctaagtnacatcaaaaacccttggcaattaccggctttttactggaggnatcnatcaaaaaangttngaaacncaaaaaagctcccctgnncgtntttggctccncntgggangangaattaaacttggggatantgcctttgggggaaccaaccgggtantttcctggggcggnttgngtcantnggttttaaanagtgtcccctaanctaaaaanaaggttnngcnttgtg

SEQ ID NO: 97546 - DNA, 397 bp, Triticum aestivum
  unsure (1)..(397): unsure at all n locations
  Clone ID: PAT_TA_97546
atcatttctctcctttttcctttgagccacgtatgagaagaattagtgagagcaattaatgtaatgacatcccttgattctctcttcctatcttgcgtcaatttgaagaggagattagcaatgcggcaatgcatgtggacccctgtacccggcagaattctagcagacgcaagagaggaaagatttcctggtttactagctagtgtaggtaggactgtaggtgacatctctgtccgatatctctatcttctttttttttgacantcgatatctctatcttctatactctctatctctctctcctctctctcnctctctnctctaangtatatagnaaangtataaaanannataatatcnttaanntgacnattaanggtgaggtgcccatngccgt

SEQ ID NO: 97547 - DNA, 467 bp, Triticum aestivum
  unsure (1)..(467): unsure at all n locations
  Clone ID: PAT_TA_97547
gtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaaagccaccgggctgcgaggagtccggcaagggctaaacagcttactcacgaaaggncaatatataaaagtgcattgcaagttttgtcaactcctgaaattgntttgggttttccctcnccaattaaccttcctaatttggtcctaaaaaanatntgtnt

SEQ ID NO: 97548 - DNA, 477 bp, Triticum aestivum
  unsure (1)..(477): unsure at all n locations
  Clone ID: PAT_TA_97548
gttgatctctccctttgtaagttcagtacaaataagaggaatgaaaatgagaaaagctgcaacgcagtacgcagcacaaaaccacctgagccattgtcttcctctcgccattgtagctgtgagcttgagcttgtaggtctcctggttccaacagaggcccacctggatgaccttgtccttctccgaggccctgagggcgtggatgcgcttgaccatgctcttggctgccgctctgttgagcttcgacgcgatgacggccaagccacgcttgtcggcggtgccgctgcccttgctcgcctcgaaaaactttgatgcaagtagttgtangcccgatgcttttttccttggcggngggcgaatggatttgcaacgcgtncttaataaaaanggaggcnctggggcgannggggaacaaggaaaaggaggnacaaggaacaaggagaaaacttcggtgnanggccccaanggctttttcng

SEQ ID NO: 97549 - DNA, 464 bp, Triticum aestivum
  unsure (1)..(464): unsure at all n locations
  Clone ID: PAT_TA_97549
atctgattggncgaacccacccaaatcccctccaaaccgtcgctaaccctcaccggacctgatttcttcctctctttcgcctcatccatgccgtcccttgcctagctcctttgtcgtccccaccctaatttcgtttgtgtccccaacacgaagcgccgccaccacggcccctaaacccctccaggtcgttcttttcgccccgagcactatcgtcaccccatgcgctgcccctgcaaacgatggatccaccaagatgatgattttgtgcacaaggagcttgatgactacatattcanagagttcattgattccgtctgattcagatatcaacgatgacaangatgttgagggtggacagtggtgatgangcaatccaaggaaagagatgtccgaaaaaaagangangnatgttcccaattttgcaaggggttnaactngaaggggcaaggannaattgntggccc

SEQ ID NO: 97550 - DNA, 437 bp, Triticum aestivum
  unsure (1)..(437): unsure at all n locations
  Clone ID: PAT_TA_97550
gccagcctcagctcacccgaagcaaagctagcgagtagcacgcaatggcgggcgcgaccatggcgctctcctccccggcgatggcgggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgaagttccccggcgactacggctgggacaccgcgggcctctccgccgaccccgagacctttcgccaagaaccgggagctggaggtgatncaactgccggctgggccaatgnctcggcgcggctngggctgcgttttcccgggagntggtccccccgcaaagggcgtccagttcngcgaag

SEQ ID NO: 97551 - DNA, 472 bp, Triticum aestivum
  unsure (1)..(472): unsure at all n locations
  Clone ID: PAT_TA_97551
ggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcaagtctatccttatgcaagcgtcatatcatggttgatggaaaggtccgcactgacaaagacctaccctgctgggtttcatggacatcatttccattcccaaagactggtgagaaactacaggcttctgtatgacaacaaaggggccgcttccngccttcactctgtnagggaatgnaggatnctaagtttaaagctctgcnagggtn

SEQ ID NO: 97552 - DNA, 479 bp, Triticum aestivum
  unsure (1)..(479): unsure at all n locations
  Clone ID: PAT_TA_97552
cctgcgtcctccccctcccgcgacccttcagccgcagcagattcccggagagctcgccgccgtgccgatggcgtcgcaggacggcgggtggggcgacggcggcgactcgctcttcgagggcatggtcctcttcgcccccgcagccgccgaggccgaggcacccgaagcccccaagccgcccacccctcccgccgacgccgccgccacctccgcctccgacgccgagtccancgccgcctcccagcctctggacgaggacctcttctccgatctcaccctgctcgcccctcagactccactagaccaggaccaacacccccagccccaggcccaangatcagaacaaccgccccgcctcgcccngtcgcgggttaangctccccccggcggcgctgctctctcgcgccagncgtcctcctcgttcgctccnggaaaaaagaataggggcngtngcgcaannggntatgggncgntcgcct

SEQ ID NO: 97553 - DNA, 321 bp, Triticum aestivum
  unsure (1)..(321): unsure at all n locations
  Clone ID: PAT_TA_97553
ccaagaccaccataaaagttccaactaccatccggagccgcgcgcgagaccgcattaactccagggcgactatcagctagggttctccgccggcctcgcggggtgttgggtggggtgggggctcgcgatgtcgacgccggcggacggcncggcctactggctgcggtggcaggtgttggtgtgcggcgcggtcatcgccgtgcccacngcgctggnggcggcgctgctgccgcngctgcgnaggtcggcggttccgctccgcnccacggnnctctggntcccctgctgngccnccggntcnatncgggatggntcctcggg

SEQ ID NO: 97554 - DNA, 490 bp, Triticum aestivum
  unsure (1)..(490): unsure at all n locations
  Clone ID: PAT_TA_97554
gttgcacaagaattcctcccacccccaccgtctcgccgccgccaccaccgccgcagctagatgagaagaaaaaaagagagagaagaactcgtcgggagggctcgagatctgttcngggagaaagggaattcttgaaatcggaatcggaacaagcgggcgcgctcgggatnggggttaccatacaatttttcccangaacctttantgaatgtgctaatgggagtcaaagggtgggaaaaagtctaacantangtagttccctgatgtacgaaagcanccctcggntncagcattngaaanagttncaacctgctggagggggccaanaanttccntggctggcataatccaactgcgcnaaaaaaacaacccggatatccgtttttggaatcccccttctccntagtttaaggattttttatggaaatttttatttctgnntcctttctccccaacaaaacccctcntggtttgctggctttaannaana

SEQ ID NO: 97555 - DNA, 488 bp, Triticum aestivum
  unsure (1)..(488): unsure at all n locations
  Clone ID: PAT_TA_97555
ccaaaccctaacacctctccgtcgttgcagccgccggccggttgccaaccctagtctccatcccagccagttccattccccaacctcccctccccacttgattccccacccgggcgcgagtgccccggttccgaacgaggccgccagtggcggctggtgagcgaattttatcgcccaaatcgtccgtctcgccggccgccggccatggaccagcgagaatcccaggccggggacgaccgtagcggcgagcgcgatcagatctccggcgatttcatcagcacgctccctgacgccatcctctgcaccatcatctcgctgctccccaccaaggacggcggncggcacgccggccatctcaccccgatggggctacctgtggcgctccgcgcctctgaaccctcngaggnccgattcccctgccanctcccaantccccctccaccgtccttccctnaagctgtgtccnggataatttcnaatcnangatn

SEQ ID NO: 97556 - DNA, 467 bp, Triticum aestivum
  unsure (1)..(467): unsure at all n locations
  Clone ID: PAT_TA_97556
ggagggctctccgtctggacactggtaacttctcatggggtagtgaggcggtgacccgcaagacccgtctcctggatgtggtttacaattcgtcaaacaatgagcttgtgaggactcagacccttgtcaagaatgccattgtgcaagttgatgctgcccctttcaagcagtggtacctgactcattatggagtggaaatcggtaggaagaagaaagctgctgcagctgccaagaaggatgctgctgagggacaagagtctgaggttgctgctgctgccacaagaggaagcaaagaagagcaacaatgtccaaaaggaagcttgagaagcgccagcagggacgtacactggactctcacattgaggagcanttcaacggtnggaaggnctgctggcctgcatttcgtctcgccctggacaagtgtgggaaaagctgatggtacatcctggaagggnaaggganctggn

SEQ ID NO: 97557 - DNA, 506 bp, Triticum aestivum
  unsure (1)..(506): unsure at all n locations
  Clone ID: PAT_TA_97557
cgagttttttttttttttttttttgcaacagcactagcgaatgagtttattagccacagcaggcacagtaacaagtaccaaaatggacaggcactgtagtgcgcattagacagtagtccacctctatgcaatgtacagacgatcccggcagtggaatagtgcccacttttattactgcatatacaaactcaagagcgagcaaagtaccgtctgtctactcatcagacaaatcacgcacngcactttttcatactcttctccggcatatttccagttcaccaccttccagatgttgggtcangtagtccgggcctcaacgtttcttggtactngcanggtaggtaacgcaatgctccccaagacaatcaaattncccaaacaaaaggattacaagggtttggaccccttttggggcaacaaaagagggggtccttgattanggaggtaagtttnaaacttgaaagggctttttgggccctnctttatcccaaangntagncccaacc

SEQ ID NO: 97558 - DNA, 238 bp, Triticum aestivum
  unsure (1)..(238): unsure at all n locations
  Clone ID: PAT_TA_97558
tccactcctattctaatcaacccctcgccgccgccgccgccgcagatcgcaccaccgaccgaccgaagcgatggccgnctccaccgtcgcgtccagggccgtggccgtcctcgccgtcntgtcggtcgccgccctctccgtcgtcntccgcgcaggaggtcccgganncgagccccgtntnggccgncggctcangcggtatccgtctctcgccnaatcgcgtcgtcgcttcccgggt

SEQ ID NO: 97559 - DNA, 452 bp, Triticum aestivum
  unsure (1)..(452): unsure at all n locations
  Clone ID: PAT_TA_97559
gtgttctaaaatgcttctccacagcttgtagaccagcattcagcagtttatcagtgctgaagagctgcagaagctaattgtggccttcgggaggaggtcgcattcacaataaataagttttgccaccgcaattcccatgatacatgtgtttttgtaactcagggtatgagaaccgtgatccgctgaattttgtttcttgttgatgatttgctcccatgatacattatcaagtgctgaagtgccctgaagctgtactgtcaggcaccaaattccaggaccgtcctggtgctaattcctcagtaaaacgggtctatcaaagcaacaatgcatctttcaagcaattgctccgagaacctaatgttttggtaanctgttttgggncaatngtgccggtggtnctaaaacacctgcaaatgaataaacnncctgaagcaacctgggttcaaagccaa

SEQ ID NO: 97560 - DNA, 499 bp, Triticum aestivum
  unsure (1)..(499): unsure at all n locations
  Clone ID: PAT_TA_97560
caccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgccaacaaagaactgaaggtccttgagcttgctaagaagatacttcgtggcagactcaacattcttcttgaaaacatctaggtcatcccttcaagcttggcagtgagggtcttggatgttancgcttcanngtgaggagatnaaactgctttcttgtcaaaangcanggttgctcccttgaagaanggaagggtggncanaaatggtcaanccacccttcancgggctggntcaatccganaaccctnaattcgntcnaccaaccaaacccttaaggaanangggaattggggtcccaatggtnc

SEQ ID NO: 97561 - DNA, 468 bp, Triticum aestivum
  unsure (1)..(468): unsure at all n locations
  Clone ID: PAT_TA_97561
gcagcactgaggttgcacccactgatggtgtgcttggacttgggagtggatcgatcagcctgctttcacagctcaagcagcatgggatcaccaagaacgtggttggccactgcctcagcatgagaggagggggattcctcttctttggggataatctcgtgccttattcacgtgcaacatgggtaccaatggctaggagtgcattcaggcgagccctatttttgatggttttttttgccacgcaatatattgtagaaagaacaagtgctcattgcctgcttgtaatgatgttaaaaaataggtgtgcgtttcactttctaaacactaatgttaatattgactagtcgctcacaactactccctccgtcctaaaataagtgactcanctttgtaccaacttctagagtattatggaaaggatctaaaatgaattgcaanactgttagacctancgacatttaanatgct

SEQ ID NO: 97562 - DNA, 415 bp, Triticum aestivum
  Clone ID: PAT_TA_97562
agtccatcccccgtcgccctcacgctcttcgtgctcgccgcctcccttcgcgtgctgcctcatggcttccatcgccggatctgccgtgtccttcgccaagcccgtcaaggcaatcaacacgaactcgctctctttctctggtccaaggaggggcaatgcatttcttcgcctgcagccagtgccgatgagatttgctgtttgctgctcagcaaagcaggatacagtggagaaggtttgtgaaattgttaagaagcagcttgctgttcctgaaggcactgaagtttgcggtaccaccaagttctctgaccttggagctgattcactggacacggtcgagattgtgatgggcctcgaggaggagttccaaattagtgtggaggaaacgaatgcgcaagcaattgcgaacagttgaaga

SEQ ID NO: 97563 - DNA, 414 bp, Triticum aestivum
  unsure (1)..(414): unsure at all n locations
  Clone ID: PAT_TA_97563
cctcctcctgaaattccaccggaactcaaccaccgctctccatccaagtctcccaaagtcgtcgccgaagactccaccagcaccagcagcgccgccgagatggggggcggggacgcgggcccggaggcggcggcggccgccgcggcggagcaggaggccaagcgggcggcggcggnggcctacnantacgaggccgacccgngctggnccgactactggtccaacgtcctcgttgtcgccgnanctcgccgcccgtccncgacgtcctcgcccacttccgttncaagttctaccagccgcttcatncnatcgtnaatttggttgntccagcttatgtcaaatcactgggttccacctcantccgngnatggctcaatnctataanngtccttcangcttncattattccacttg

SEQ ID NO: 97564 - DNA, 425 bp, Triticum aestivum
  unsure (1)..(425): unsure at all n locations
  Clone ID: PAT_TA_97564
ggaagctgcgccacgcccgcggcagcagcaacagcaccaccggcggggccggcatccctaaatgcgccgccctctcgccgccgctgccgccctccgcctccgcctcctctcatcctcgtcccgccccctcgtcncctcgccctttccactccaccacctcctccgccgcgacgacnaccgcgaggatcgacacccaacgcccccgcctcccccattctcgccccgcccgctcctcggctccgcatccggtgcccccggcctccttggcctccgcgggtggnggacgttacccccgggaagcgtcaccgccacgaaggcaaccgtcccggacgcgccccctgtccctgctcaacatctcccgcaagttattcttttgcgtgtcgccnagaccaagaagcaanacacacttcgacgattnagcaaaa

SEQ ID NO: 97565 - DNA, 465 bp, Triticum aestivum
  unsure (1)..(465): unsure at all n locations
  Clone ID: PAT_TA_97565
ctcaaatttactttgcctgnagccggttgggaaagatngtatcttggcacaaancaacancngggacgccgtcctcctcgcgggctccccgccggagcgccgcctccgggttcgacctcgagtccggccacaacaagtgcatctccgncgagatcaangncgnctcttangncgttgataaatacancgnnggatcccccaagccnanacttnccccnggnaaaaatctnacgcttttttactctgaattntnancggtgatgtgtgtgtatatatgctacatgcactactcccaaaaaattgcaaatcngggggnaattcnncctttcacnaaggagtgggatggccacgggattncatnntgtgtttggtttcctggggaagtgttntttnaaattaacnaaagntgtttaaaacnaacgttttaacctttnttaaanngggaaaaaaaganaaaaacctccg

SEQ ID NO: 97566 - DNA, 454 bp, Triticum aestivum
  unsure (1)..(454): unsure at all n locations
  Clone ID: PAT_TA_97566
caacaaccattcccccagactcaacaaccacaacaaccatttccccagcaaccacaacaaccattcccccagactcaacaaccacaacaaccatttccccagttccagcaaccacaccaaccttttccccagccccaacaacaattcccacagccccaacaaccgcaacaatcattcccccagcaacaacgaccgttcattcagccatctctacaacaacgtttgaacccatgcaagaatatcctcttgcaacaatgcaaacctgcgtcattggtgtcatccctctggtcgataatctgggccacaaagcgattgccaagtgatgcaagcaacaatgctgccaaggaactangcacaagattcctcaagcaagctcccaggtggcggcaagncntncaatangcngtcgttgcnattnctatcatcggtgcaagcaagcnaggcaaacnaacaa

SEQ ID NO: 97567 - DNA, 461 bp, Triticum aestivum
  unsure (1)..(461): unsure at all n locations
  Clone ID: PAT_TA_97567
ggcacccanagacgaggaagggcgtancaagcgacgaaatgcttcggggagttgaaaataagcatagatncggagattcccaaataggtcaaccttttaaactgcctgctgaatccatgagcangcaagagacaacctggcgaactgaaacatcttaatagccagaggaaaagaaagcaaaagcgattcccgtagtaacgggcgaacgaaatgggaacaancctaaaaccgttgaaaaacggggtttgtgggaagagcaaatacaagcgnttttgcttgctaaggcgaaaccggtttgagttgnccccaaccctaanattggcttaaagtccaaattacccgaaaagcaatcaactaagcntaacnctcctgaaccccaagttacnaaggggggcaacgttggaaatccccgttttgaaatcaagcaaggggncnaccnttgccaanggnttaaattacnc

SEQ ID NO: 97568 - DNA, 452 bp, Triticum aestivum
  unsure (1)..(452): unsure at all n locations
  Clone ID: PAT_TA_97568
gcaacaacaactgattccatgcagggatgttgtnttggaaaaacacaagnaataacgttatgggaagctcaacaaagtttttgcaacaaaaggtacttaccaaacttggtngcaaacaaattgtgtttgtcaagcaaagcttgttggcaaaantccccgaggcaaattcgcgggtggccaagccatccaaaaatgtttgttcaaggctattattctgcatcaacagcancaacaacaacaacaacaacaacaacaaccgttgagccaggtctccttccaacagcctcaacancantatccatcangccagggctccttccagccatctcagcaaaacccacangcccanggctctgtccagcctcaacaactgccccagtttgaggaaataaggganctatcgctagagacgcttcctgcaaatgtgcaatgtctaaattcctccatattgn

SEQ ID NO: 97569 - DNA, 418 bp, Triticum aestivum
  unsure (1)..(418): unsure at all n locations
  Clone ID: PAT_TA_97569
catatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattaagataaaaggctgacgcgggctctgctcgctgatccgattattcatgataactcgacggatcgcacggccttcgtgccggcgacgcaacattcaaatttctgccctatcaactttcgatgggaggataagggcctaccaagggggtnacgggtgacggaaaattaaggttccattccggggaaggaacctgagaaacggntaacaaatccaaaggaaaggaacaaggcgccg

SEQ ID NO: 97570 - DNA, 430 bp, Triticum aestivum
  unsure (1)..(430): unsure at all n locations
  Clone ID: PAT_TA_97570
aaaccctcgccccctcccccgccgccgccgccgccgccaagcaaccagcccccagcacccatcaccggccggcgaagatgaagacgatcctggcgtcggagacgatggagatcccggaggaggtgacggtgaaggtgtcggcgaagatgatctcggtgacgggtccccggggcacgctgacccgcaacttcaagcacctcaacctcgacttccaagctgcaggagggcgggcggaggctcaaggtggacgcctggttcggcacccgcaagaacatgggcgccatcgcaacgccatctcccaacgtccaaaaacctcatcaagggggtcaacaaaggggttcccgctacaaagatgcgcttccgtntaatgctcaatttcccatnaaacgcctccaatnaaccgcccccaaaacggcgggaattcnaaatt

SEQ ID NO: 97571 - DNA, 209 bp, Triticum aestivum
  Clone ID: PAT_TA_97571
catactccataggatagcagcatgtgccagttttcttcctaatttggcaaccctcataatactagtatcatctccagcacgtcactagctagcatcacaggttttctttccaagtcctaacacttccccaccttagcagcaatacgacactgcaaatcaagcatacagagtaacaataacatattacactgacatgacattctatacaa

SEQ ID NO: 97572 - DNA, 508 bp, Triticum aestivum
  unsure (1)..(508): unsure at all n locations
  Clone ID: PAT_TA_97572
ggtcaatacaaatccaccatgaagacctttctcatccttgccctccttgctatcgtggcgaccaccgccacaactgcagttagagttccagtgccacaattgcagccacaacatccatctcagcaacagccacaagagcaagttccattggtacaacaacaacaatttctagggcagcaacaaccatttccaccacaacaaccatatccacagccgcaaccatttccatcacaacaaccatatctgcaactacaaccatttccgcagccgcaactaccatattcgcagccacaaccatttcgaccaacancaaccaatatccaacaaccgcaaccacattattccgcaaccacaaacaaccaatttcaacaagcaagcaagcaagcaaggcaagcaaacaaacaancaaccaaccaaacaaccaaccaaccaaaatccccttcaacnaaatttttggcaacnaacaaactnggattccaattgcnatnggatttttggtanttgcagc

SEQ ID NO: 97573 - DNA, 489 bp, Triticum aestivum
  unsure (1)..(489): unsure at all n locations
  Clone ID: PAT_TA_97573
aaccattctaccagcaaccacaacaaacatttccccaaccccaacaagcattcccccatcaaccacaacaacaatttccccagccccagcaaccacaacaacaatttccgcagcctcaacaaccccaacaaccatttccccagtcacagcaaccacaacaaccttttccccagccccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaaggtgatgcagcaacaatgttgccaacaactagcaaaagantcctcgccaagctncagtggtgcagccatccaatagcggtcgtgcatttcattcgtcatggcagcnanggaacaaacaacaagggnattacagattcttccgggccacntg

SEQ ID NO: 97574 - DNA, 494 bp, Triticum aestivum
  unsure (1)..(494): unsure at all n locations
  Clone ID: PAT_TA_97574
aaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttgctgactacaacatccagatggagtccacccttcaccttgtcctccgccttcgtggagggcatgcaagattcttcgtcaagacgttgactggcaaagaccatcaaccttgaaggtgggagtccgtctgacaaccaatcnacaacgtcaagggccaagatncaangacaaaggaggggcattcctncgggaacaacaacgcctcaatctttnnccgggcaaagcaaacttgganggatgggccgcaacccttgcttn

SEQ ID NO: 97575 - DNA, 486 bp, Triticum aestivum
  unsure (1)..(486): unsure at all n locations
  Clone ID: PAT_TA_97575
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgnacttcatgtgccagggcggcgacttcacccggggcaacggcaccggcggcgaagtccatctacgggcgagaaagttcgccgacgagaaagtttcgtcccacaaggcacancaaagccccgggattcctctccatgggcaaangcngggcccaaaaaccaacggntccagttcttcatcctgnaccgtcccctgcaaatttggttcgaccggca

SEQ ID NO: 97576 - DNA, 471 bp, Triticum aestivum
  unsure (1)..(471): unsure at all n locations
  Clone ID: PAT_TA_97576
gcgccatcgagttcggcgacgaaatcgccgccgccggcgagtggcaccacacgctggaggccatcaagtggggcaccgactacttcatcaaggcgcacaccgagcccttcgtctactgggccgaggtgggggacggcgacacggaccactactgctggcagcggccggaggacatgacgacgtcgcggaaggcgtaccgcgtggacaaagacaaccccggctccgacctcgtcgccgagaccgccgcggcgctcgccgccgcctccatcgtcttccgcgcctcccaacccgcattactcccacatcctcctccaacaacgcaacaacaagcttgtttccaatttcgggggaacaagattacaggggggcaaacttacnaacaatgaagcaatcaacnggggggttgcgggggcnttctaacnccgtccggttaagncgggtttaccggggaacnaacctggcttgttgggg

SEQ ID NO: 97577 - DNA, 369 bp, Triticum aestivum
  unsure (1)..(369): unsure at all n locations
  Clone ID: PAT_TA_97577
ctcagtcctcacagcatcctctcagtccttagcttccttccctcgccgccacccaccaaggaaaggaggatgtcttgctgcggcggcaactgcgggtgcggcgccggctgcaattgcggcaacggctgcggcgggtgcaanatgttccccgacgtnggaggncancgccggggccgcccgccatggtcatgcccancgcctcccaaaatgggagctccggntggttcnaaacnggccgggngaagaaccggngggtggcgactgnaacaaccttgcaaantgnnggcaaccccgttgccggnttgctccctgcttgcaaacttgcaaacttgaagcccgggcccccnaangaaaggccgggcccggnca

SEQ ID NO: 97578 - DNA, 369 bp, Triticum aestivum
  unsure (1)..(369): unsure at all n locations
  Clone ID: PAT_TA_97578
gtcgcttctcctacatcaacaagcagtatatggggcaaaacggtttcatcactcttgactgcgttactgagagggtcgaggaggaaggtgaggatgaagctgttgacgatctcttctgaaacttcgacagctctggacttggattgaggcaaaaaggaagtcgaagtctgatgcagtacctcttactataatattagctataaatattttgagcccgctcaaaactctgtattttgataaggntctttggcaacttgggatnaattacccctgtgggcgttatgttttggattggntaccttattactcngatgatgcaatgttttggnacggngagtgaattatctggntnatatggccnatttatag

SEQ ID NO: 97579 - DNA, 473 bp, Triticum aestivum
  unsure (1)..(473): unsure at all n locations
  Clone ID: PAT_TA_97579
ccgcaccgctcgcccgcatcctccctcccgtccgccaccgcattaattcgctcccaccgcttcccaacaaacccgccgcccgnccttgaccgccgcaggncgcanccatggngctcgcancgacgccacgccagcggtcggngccggncgtgctggtcncggggggggctgctctcgctttcaatctnaatctcaagcgcgcangngcanggcgccgcaagtgggggtggcaacctcggntcccccgaagggcgggggggccgggcccgggcgcgggggttaacccgggcgtgcctcaaatcgcttgctcaaacatgacgggactggcctgccgttacgttgcaaaggcccgggaagcaaaggcncggggcgcccnggaaaaagccngtgcctggcccgggnngctgggcgggaattggtggggctccaaaccccgtttgccttttgngaggctcctctcccggggggccgcc

SEQ ID NO: 97580 - DNA, 431 bp, Triticum aestivum
  unsure (1)..(431): unsure at all n locations
  Clone ID: PAT_TA_97580
ccaaacttttctcaccttcgaagaagaagcagcagcatccatggcccccaaggctgctgagaagaagccagtggagaagacccccgcgggcaagaagcccaaggcggagaagaaggtgccggcgtccaaggagggcggcgacaagaaaggggaagaagaaggccaagaaaagcgtggagacgtacaagatctacatcttcaaggtgctcaagcaggtgcacccccgacatcggcatctcctccaanggncaatgtccatcatgaactccttcatcaaacgacatcttttgnnaagctcnccccggttgagtccgcccaagctccgccgngcttacaaacaaagaaagccccaacaatcaacgttccccgcgaagattcnannaccttccggttccggcctcgttccttcccctgggngaagctccgccaaa

SEQ ID NO: 97581 - DNA, 468 bp, Triticum aestivum
  unsure (1)..(468): unsure at all n locations
  Clone ID: PAT_TA_97581
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaacgctcagcaaggaggccctcctcaaagcaggtcgactaccttatncgctcaagtgggtgccttgcctccagttcaacaangttggggttcatcttccgtngaggcaaaaacgcaaccncctggggtnctaacaatggcccgggttnttgggacaaatgttgggnagcttgcctnatgttccngggtgcanctggacccccccanaaaggtttttaaacgnanggtnggggggggggccaaa

SEQ ID NO: 97582 - DNA, 369 bp, Triticum aestivum
  unsure (1)..(369): unsure at all n locations
  Clone ID: PAT_TA_97582
cgaggacggcgtcaagggccgctgcgtcgccggcgccatcaacaactacacctcccagctcctcacctacggatnatcatcgctgtcgccatcttctaaatcttcctcttccggccaatataaccttacaagaagcgctcctgttcctctcacacttcatgggagacatccaccanncactgcattgtgggttttgcttctgacaagaggngggaacancatcnaacgtccaactgggtnacaangagggaagaccgtccctccaacaatgttttggggaatnttgaggcatcaatccaanaacgggcgggggaaaaggnctanctaccaacnaaaaggngccggggggnaanttcctcccacccccct

SEQ ID NO: 97583 - DNA, 449 bp, Triticum aestivum
  unsure (1)..(449): unsure at all n locations
  Clone ID: PAT_TA_97583
ccacaacagacatttccacaacaaccactattttcacaacaacaacaactatttcctcaacaaccatcattttcgcagcaacaaccaccattttggcagcaacaaccaccattttctcagcaacaaccaattctaccacagcaaccaccattttcgcaagcaacaacaactaagttctaccgcaacaaccaccattttcacaagcaacaacaaccagttttacctnccacaacaatcaccttttccacaacaacaacaacaccaacagctggggcaacaacaaatccctgttgttcaagccatncattttgcagcaacttaacccaagcaaggtnttcccccancaagaagtggaaccctgttgnnatnccaaaacgtcctgctagggnccaaatgttgcaacaaaagcaattnccaangtgatgccaaaaanaatttttnccagnaat

SEQ ID NO: 97584 - DNA, 296 bp, Triticum aestivum
  unsure (1)..(296): unsure at all n locations
  Clone ID: PAT_TA_97584
aagaagagaagagagaagcaaagcttgagatggcgcaaaccatggcgtccatgaccggcctgtcgcagggcgtgcgtctcccaggcccgaccggcaggcgcgccaacaggttcaccgtgagggcgtcgtcngcggaggcggagggcgccggncgccgcgcggtccttggtctcatgggcaanngantcctcgggaagcgcgttcgctcaagtggtgcannccgggancgtnccgggcatcaaggttnggccaacgccgncgctttncggttggactcccccnggcaagggacaaat

SEQ ID NO: 97585 - DNA, 453 bp, Triticum aestivum
  unsure (1)..(453): unsure at all n locations
  Clone ID: PAT_TA_97585
atagattcttcctcctcgtcactcctccagaagcctacctaccatccaccacctcctccaccctccaacaagatggacgccgccgtggagcgcctcaagaccgggttcgagaagttcaagaccgaggtctacgacaagaagccgatttcttcgagcccctcaanggcgggcaaggcgcccaagtacatggtgttcgcgtgcgccgaccccgtgtgttgnccatcggtcaccctggggcctggagcccggggaaggcttnaacaatcgcaaaatcgcccaaaattggcccctcctaatngaaaaaaaaatttgccccggtttttgntttgggcaatccaaataaaccctntgtgctctcaaagggtgagggncaaacctgggngattgggcaaaaaaccccttcggttggaatcaaagggtctgctctncaaatcaaaggntggngcaaaaacn

SEQ ID NO: 97586 - DNA, 478 bp, Triticum aestivum
  unsure (1)..(478): unsure at all n locations
  Clone ID: PAT_TA_97586
tgaagcaacacgccggagtccagttcactccgctgtacgatcccatcccccgcatcgggcaaggcaccgcgccgacgccgacgccgatcgctccccacccaagggcggccgggcgagcatgaaagncctcggcgcgcacgcctccgaactgctccgcggnccgcaactcgtccgcgccgccgtgctcttcctcgcctgcgccgcctccttcctcgtcggntaacggctggnccgaagcctccgcgaagccccctcttcttctcgtncgtcttctcccccgggggtnccccctncttcccggaatnntncttttggttcccctttcgttnggccatnctcgcccaaaactccaaaaaatctcccttttnanacccaanncccttaatccccccgccccccggaanttngttnccgncccggtttcgttccaaatcccaaaanggctncnccggccccccttcaangggnccaaattnct

SEQ ID NO: 97587 - DNA, 381 bp, Triticum aestivum
  unsure (1)..(381): unsure at all n locations
  Clone ID: PAT_TA_97587
gtcacctcgggccgccggcgaccgccgcgagagcgagaccctagccaaggtctccctctcgtcggtctcggccgccgcggcggaggtctccaccttccccctcgacgccctcaagacgcgcctccagctccaccgcagcaccggtgttggtggcggcggcggtggcgtcgtacgcgtcgcgggggaagctcgtccgcgaacggggggctctaccggggcctctcccccgctgtcctccgggnaactcttctacaccccgctcgcatcngtcggntaacnagcaactccggtccctccccttncccgggcggggggcccngggaggntgggcctccctccnaagaaaggccgggttggctggggggnangcctcccggncgt

SEQ ID NO: 97588 - DNA, 447 bp, Triticum aestivum
  unsure (1)..(447): unsure at all n locations
  Clone ID: PAT_TA_97588
ctctcctctcctcactccacgctccttccctcacacctctctcccccactcgcactttccgctctcgtctccccctcttcctcctcccgtcagacccttcttccccggngttgatccgattaacgtcctccttcctccccggcgttgatncgacgcgccgtaaagttnatangcgaacgaacgaggtggtgatngtccangggggccccctgcgangattgngcccgggggggggnaacggcnaaggtggagctctccggtgggggtccgcngcngaaggcngcngcccccccccgccgggggggancgccccggccgtnggncaataancctcggggaagggttcaatccttcnccgggaatnggtncccccggcgggggttnnaaatnacgggnttggggggctncnaaantttttccntggttnaaacccccttaagntccaaa

SEQ ID NO: 97589 - DNA, 363 bp, Triticum aestivum
  unsure (1)..(363): unsure at all n locations
  Clone ID: PAT_TA_97589
gcctcccccagagctcgttagggttttctcttttttcgggggagaaatctcaagaggcggcaccatgctcgtgtaccaagacaagctttccggcgacgagcttctgtcggnttcgttcccttananggaagctnggagaacgggctgctctgggaantccaatgncattgggtcnttcaaggagcaattnatgtggacattggagccaatccctcttcttanggtggtggtgaagaatanggtggttatnaacaaancngtnaaagggggttgncatttttanaaacctccgtctcaagagcaaactgcttttgacaaaaaacaatttntnccccaacatgaagccgctncatcaaaaaaacc

SEQ ID NO: 97590 - DNA, 413 bp, Triticum aestivum
  unsure (1)..(413): unsure at all n locations
  Clone ID: PAT_TA_97590
gcggctcgaaccaagaagagatcttcagccatgtcggggcgcggcaagggaggcaaggggctcggcaagggcggcgccaagcgccacaggaaggtgctgcgcgacaacatccagggcatcaccaagcccgccatccggcgcctggcgaggaggggcggcgtgaagcgcatctccggcctcatctaaaangaaaaccgcggcgtgctcaaaattttcctcnanaacgtcatccgcgacgccgtcanctanaacgaagcacgcccgccgcaaaactgtcaccgccaatggacgtcgtctaagccctcaagcgccaagggtcgcaacctctanggntttcggggggtnaaggcttttccntttccccccttgcnanatttccaaaaagntttngttnaatancccnnaacttgtgg

SEQ ID NO: 97591 - DNA, 315 bp, Triticum aestivum
  unsure (1)..(315): unsure at all n locations
  Clone ID: PAT_TA_97591
ccccttcgacgacgccgaggacgacgccaccgatgccgcggccgccgacggcggcgcgggagggtacgcctccttcgcggacgcagggtactcctccttcgccgacgccggccccgaggaggaggtggacgaggagatcgccgtggactccgacggcggagccgtcccggtccgccacgtttccggcgggtacgcccccgcggccttcttccccgactcggacttcgggggcggggacgacgacggccccgtcctgccgccgccggccgagatgggggcgggaagganngggtccncctccnccgantggcggaa

SEQ ID NO: 97592 - DNA, 452 bp, Triticum aestivum
  unsure (1)..(452): unsure at all n locations
  Clone ID: PAT_TA_97592
gccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaaagaagcggcaaagcccgcttgcaactacaagggcancgccttccaacggcgttgatnccccgacttnatgtggccaagggngggngaattcancaaggggcaaacggnaccgggaggcgagtccatctacgggganaaagtttncccgacnagaaattcgtccaanaagcaacaacaaagcccggggaattctctccattgggcaaaagcccnggggccaaaancnaaacgggt

SEQ ID NO: 97593 - DNA, 469 bp, Triticum aestivum
  unsure (1)..(469): unsure at all n locations
  Clone ID: PAT_TA_97593
ctcccaatcccccaaatctcctcagcctccctgccggcgcatctccgactccatggcccgcaccaagcagacggcgaggaagtccaccggcggcaaggcgccgaggaagcagctggccaccaaggncgcccgcaagtccgccccggncancggcggngtcaagaagcccancgcttccgccccgggaacgtcccgctccgcgagattcgcaagtnccaaaanaacaagggggctnctcatcccgcaagctcccctttcannggctccttccgttgagatngcccaaagaattnaaanaacggacctcccggctttcaaatcctcccgcccgtctcccgccccttcaaggaaggccncccaaggcctaacctgggnggggcctcccttcgaagggaaaacaaaacttcttgnggcnattcaaaggccaanaggnggtttaccaattaattgccccaaangggnatttaaa

SEQ ID NO: 97594 - DNA, 461 bp, Triticum aestivum
  unsure (1)..(461): unsure at all n locations
  Clone ID: PAT_TA_97594
gccgccgcctcctcctctccgctccttctccttccttcgagtttcagccatgggtaaggagaagactcacatcaacatcgtggtcattggccatgtcgactctggcaagtccaccaccactggccatctgatctacaagcttggaggtattgacaagcgtgtgatcnaaaagggttcgaaaaaggaagccgcttaagataaaaaaganggtctttcaagtacgccctggggtgctttgacaaagcttaaaggcccancgtgagangggtatcaacaattgatattgccctgtgggaaagttcgaagancaacaaagtactactggcancgtccttgaatgcccctggtcaaccgtgacntcatcaaagaacatgattactggtacctcccaagctgactggtgctgtgctcaacaattactccnacanttggggggtttganggctgggtatccnccaagg

SEQ ID NO: 97595 - DNA, 461 bp, Triticum aestivum
  unsure (1)..(461): unsure at all n locations
  Clone ID: PAT_TA_97595
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcagcaacaaccaccattttctcaagcaacaancaattctaccacagcaaccaacattttcgcagcaacaacaactagtttctaccgcaacaaccaccattttcacagcaacaaacaaccaagtttttacctccacaacaaatcaacnttttccacaacaaacaaacaacncccaacagcttgggtggcaacaaacaaaatccccttgtttgtttcannccat

SEQ ID NO: 97596 - DNA, 270 bp, Triticum aestivum
  unsure (1)..(270): unsure at all n locations
  Clone ID: PAT_TA_97596
accgtggagggcgacggcaagtccgccggcaccgtccgcctcatcaagtacaccgagggggttccgatggtgacgttcgccaagganaaggtggaggtggcggacgaananaaaaangtggtgtcntacancgtggtggacggcgagctggtnaacttctacaaaaactttangggtacgggtcaagttaacgaaaanggcgcccaacggcgcccggcgccggtggttaaatggaccaanggacttccncaaagggcaancgaacaaggt

SEQ ID NO: 97597 - DNA, 451 bp, Triticum aestivum
  unsure (1)..(451): unsure at all n locations
  Clone ID: PAT_TA_97597
gtcaaaccctagtatcagatccccttcccctctctctctcaaatcccgtcggctgtggagccacggatcccgtcgatggctagcgggggaggccaatggcggtcccgtcggtggtggagccatcgatcccaacgggtttgcgcttgagcgcctgtaggaggacaatcaccccgatcctcctcgtctccacgccccagatccacctcgtctcggccctgatctacctcgtctccgcccccgatncgtcnaggccgagctagtanggagcagcaccaatgccaccatggccgccgcccatagaagtccacctctcgattcgttagccgcccgaagttcgcgtgggagcctcgtccacgccaacgtggggcaancaaaaaccgattcccccccgtttgggccaagattcaaaagcgcccccgttttaaccctcccccgggggccttccctttca

SEQ ID NO: 97598 - DNA, 174 bp, Triticum aestivum
  unsure (1)..(174): unsure at all n locations
  Clone ID: PAT_TA_97598
gttaaatctcantgtaaaacncgtcnancacggttccactagcttcagctanccatcctcttcctctccgggcatcttcttgcatcaaccacggcaatggccaccgctgacgtcnanaacccatccnccgcgcttntttngtcctngcntcccttcagtntanangtttttttt

SEQ ID NO: 97599 - DNA, 461 bp, Triticum aestivum
  unsure (1)..(461): unsure at all n locations
  Clone ID: PAT_TA_97599
gcgaccccccgagctacctcaccggtgagttccccggcgactacgggtgggacaccgcggggctgtcggccgaccccgagaccttcgccaagaaccgggagctggaggtgatccactgccggnggggcatgctgggcgctctcggntgcgtcttccccgagctgctcgcccgcaacggngtcaagttcggcgangccgtntggttnaaagncggctcccaaattttcancgagggnggnctccaatacctngggaaacccancctcgtccaangcccaanagcannctttccatcttgggcctggcaaagtccgtgctcaatgggccccnntcnaagggtaaccgcgtcccccggnggggccccctccgggannattntttaaaccgcttctaacccggggggganctttcaaaccccctggggccttcncccnattaccccccnanggaatttcccgggg

SEQ ID NO: 97600 - DNA, 424 bp, Triticum aestivum
  unsure (1)..(424): unsure at all n locations
  Clone ID: PAT_TA_97600
gaggaaccgttgattcacacaattggtcatcgcgcttggttgaaaagccagtggcgcgaagctaccgtgtgccggattatgactgaacgcctctaaagtcaaaatccaagctaagcaatgcgaacncctggcgcccgcccgcccggccccgaaccaatgtttaggggcgctttgcgccccccaaggggcccgttgccaatttggctaaaccggtcccgggccgacgtgcccgcggccggggccgcctccaaacttcctttccaaacngggcgggtgggctgaatcctttgcanacgaacttaaaatacgcgacngggcaattttaagttgcaaantgggcttnctgccaacattcantnanattcaaaccccaatntccaanggggggggcccngtnaccnaattcnccctanangtgangtcc

SEQ ID NO: 97601 - DNA, 481 bp, Triticum aestivum
  unsure (1)..(481): unsure at all n locations
  Clone ID: PAT_TA_97601
ntnnnntcggccatgtcgaaacaataaaattgccatttgtcatgcatacagcaaaatgttaagttgccatcacacaaagattttagaaaaattagtgcctcggtcagaacagatcaggcaatgaaaaagacatagagctatctagttncaaaccaanagcatgagaacaaacgtactactagcaagaacagcaacncaccatcngaatcattgccggggccaaggaactccatgcgcatctggtggatncccgacttcaccggtgcatccaggcgtgcgcattggccgggctcnccatggggatnctgctcancaatnggctgggnccggatgctccccnaacgaaaaatgctanacaaagctgctncnccaacaattggnaatccncaaaaaattttcccaagngcgtttccaaanggggtcccngaancaaaatctgncgctggcctanaaaacnccgggncccccctgcncaaagggg

SEQ ID NO: 97602 - DNA, 477 bp, Triticum aestivum
  unsure (1)..(477): unsure at all n locations
  Clone ID: PAT_TA_97602
gttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactattcctcaacaaccatcattttcgcaagcaacaaccaccatttnggcagcaacaacacatttctcaagcaacaacaattctaccacaacaaccacatttttgcaagaacacaactgttttaccgcaacacacatttttacaagaacaaacattttactccaaaatcacttttccacaacaacacacacaacagcgggggaananaanccgttgttaacatcanttngancaagtnaccaagcagtntccccaacaacattnacctgtggaatgcanaantctgcnagnccnaa

SEQ ID NO: 97603 - DNA, 478 bp, Triticum aestivum
  unsure (1)..(478): unsure at all n locations
  Clone ID: PAT_TA_97603
ttcgagcgcctcctcctgtctcgtcctcgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaaagcccgcacctgctggagaaaccagcaccggcagctgctgatgtagccaagcagatccaactggaatccaangttacccgggggaacaactataccggtcaaaattgcaaaacacgggaantccttaacggacgtcttcaacaaggttaatctgctccctggcggtggtcctccctgggtacttttttngcggaattatgttnataatgggccgcttaattaacaacgataattgccgnaccccgttatcangtggtgaaantgaattttggttgacatttacacgctcaattaccgncgtaggtcatttcaan

SEQ ID NO: 97604 - DNA, 455 bp, Triticum aestivum
  unsure (1)..(455): unsure at all n locations
  Clone ID: PAT_TA_97604
acaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccaagcattttcgcagcaacaacaaacagttctaccacaacaaccagcattttcgcaagcaacaacaccaacagcttctgcaacaacaatccctaatggtcatccatccattttgcagcagctaaacccgtgcaaggatccccccagaagcatngtaccctgtgggatgccacaaaacttgcnaggcnccaaatttgggaacaanncattncaagttntgcaccaaaagttgccaaaattnccaanaaccccgnaaancccctttngggaaccgtgaaaannttccanaaacccnaaaaaaaaaaaa

SEQ ID NO: 97605 - DNA, 493 bp, Triticum aestivum
  unsure (1)..(493): unsure at all n locations
  Clone ID: PAT_TA_97605
gcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaacnntttcctcaaaaaacaataattttcgcaagcaacaaccaccatttttggcagcaacaaccacatttttcaacaacaaccaattctaccaacaagcaaccacattttcgcagcaacaacaactagtttaccgcaacaaccacatttttacagcaacaacaacantttacctcccacaacatcactttttccacaacaacaacaacaccaacanttggtgcaacaacaatcctggtgntcaaccaccattttggaagcagtaaaccaagcaantttcctccancaagatgcacctgngggaa

SEQ ID NO: 97606 - DNA, 489 bp, Triticum aestivum
  unsure (1)..(489): unsure at all n locations
  Clone ID: PAT_TA_97606
cacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtntgaggcaacgcccggcgccgccgccatggtcattcccancgcctcccacaaagggagtccggcggntncagaacggcgggggaaaacggcggtgcgatgcacancttcaatttcggaacgccttncgctgtccctggtgcanctcaacnagcccgngcccaaanaggccggcgggaaaagcacacnaagattaggnggncaagcaagcaanacatcacacantttacaacaaccancgtntcattacaaccgcgcatcgtcccgggcgcccccctgataaataaacacttcgtttccttatctgtanccctgtccgttgtt

SEQ ID NO: 97607 - DNA, 365 bp, Triticum aestivum
  unsure (1)..(365): unsure at all n locations
  Clone ID: PAT_TA_97607
attatctaacacaaatcaaccatgaagaaattcctcgtccttgccctcattgttgtcgcggngaccaccacggncgccgaaccctttactgcattccgtactgcttgggagccgcaccatccatcatctccagagcagcanccaactccacagccacaataacaaccagttccacatcaaaagttgaacccatgcacggatgcctcctacaacagtgtagccagttgctgataagtcgttctcccgtcacaagtngtgcaacatacaactgcttggtaagttggaacatgtttntancaactaaaaggatttnccaagantnnaattttnggcaccaaaaatttntggaaaccananttttncaa

SEQ ID NO: 97608 - DNA, 508 bp, Triticum aestivum
  unsure (1)..(508): unsure at all n locations
  Clone ID: PAT_TA_97608
tttttttttgcatcggaaaaactcagtcaaactgaacttcacggcaattctgaagacacaaaaaactgcaaactgcactgcatatctgaatctgaaatttctggaaactccaacaatgatacagagccagcggaggccaccagcgatggcgtcaacaaccctccttgccgcaccgccatcagctgctctgctcccgtacctacgcgtcgcgagacacgcaagcgagctgcaacaattttcaatgggaagaagccngcggactgaataactaacctttttcccaaaacctggctngttgggntcncccnttggggaaaaaaaacaagggaacccgttnnccaaaancaagaactgaacgaanncccataaacccaatttaacggaacggtcnccnaacggtagaaatggaggcgncgtccccnccccaaatgccttnaaggggaaagttccccacggggaaccgtngnggnccgtttgggcggtatccccttaaacaagacaanattan

SEQ ID NO: 97609 - DNA, 460 bp, Triticum aestivum
  unsure (1)..(460): unsure at all n locations
  Clone ID: PAT_TA_97609
gcgcatcatttaagccaagcaagctgtggtcaatacaaatccaccatgaagacatttctcatccttgccctccttgctatcgtggcgaccaccgccacaactgcagttagagttccagtgccacaattgcagccacaaaatccatctcagcaacagtcacaagagcaagttccattggtacaacaacaacatttctagggcagcaacaaccatttccaaccacaacagccataccgcatcaagcaaccattccatcaaaaaaaccnataccgnaagcgnaaccatttccgccanaattccaatntcggcaanccgcaactttnccacaanaanaacatttcaaaacggaacaaattttcggcaacaanaaaantnttttggaacaacaggccaacaacacaacaanaaaacatctttaanantngggaaaaaaacnntccaggaggattntttgcaaaaa

SEQ ID NO: 97610 - DNA, 289 bp, Triticum aestivum
  unsure (1)..(289): unsure at all n locations
  Clone ID: PAT_TA_97610
gttnnactgaancggtgacanacttcaccaaacccaacgacgaccaatccaatccacgtctccatctccanacacaccantgnccgcccgcncgcgcacgcgggccatttcanctcncccgccccgcngatgcgcnccgncgatcccgcgcagcagccgccgccgccgcngatcgatccgcgctccgcggtggactatccatgtccccccacacgtcatgnagcnccccnctcccgggcntcntaacgctnaactgcacngncagcgcnttacnactgntntcgctcag

SEQ ID NO: 97611 - DNA, 490 bp, Triticum aestivum
  unsure (1)..(490): unsure at all n locations
  Clone ID: PAT_TA_97611
ccaatctcgtctccgatcgactccacgctcgtcgaatactcctcccccaccgcctcaagatgcagatctttgtgaagaccctcactggcaagaccatcaccctagaggttgagagctccgacaccatagacaacgtcaaggccaagatccaaggacaaggagggcattcccccggaccanncagcgtctcatcttcgctgngcaagcanctgtgaggatggccgtacccttgctgactacaacatccaagaagganccaacctccaacttgtcctgcgtctgcgttngtggcatgcaaatctttcgtgaaaacctcaccgggaaagacatcatcttgaggtgganantcccgacacatcgacaagtnnaaggcaaattcaagacaaggaggattctcccggacaacacnctnactttctgggnaacactttaggtngcgtacctcccgatnaanatcaananggtcancttnactggngncccncctggg

SEQ ID NO: 97612 - DNA, 505 bp, Triticum aestivum
  unsure (1)..(505): unsure at all n locations
  Clone ID: PAT_TA_97612
agaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttcatcacaacaaccatatttgnagctgnaacatttcgcaagccgcaactacatattcgcagccgcaactaccatattcgnangcgnaactaccatattcgnagccgcnacattttgancaaaacaaccatattcacnatcccaaccacagtatcgcaaccacaacaacaatttngcagcaacagcagcaacaacaacaacaacaacaanacacaacacaacaacaacaacacantcttcaacaaatttgcacaacaacgatcaagcanggn

SEQ ID NO: 97613 - DNA, 403 bp, Triticum aestivum
  unsure (1)..(403): unsure at all n locations
  Clone ID: PAT_TA_97613
ggacgacggggtgtggatgaaggagatacncangggcgagcggtgccanccgctgnanttctccggggccatctacnacgacgccnagggtcnccgcctcggggccccgcccacgccgcgcacgcccatgcgcatcccgctgccggcctccctcaagctcgccgccaangcntattngccccancccncacaccngccgccgtcgtcgcagnggtcgncctgcgacttnggnaanatcnatccatncntctccctcagnctcactgctgtactgtncatggntctaatgccgctctgtttttccttnnctcatctcctctccnaaaaactctgtttttggcgtgcctatgacaacttttgncaacnttgtaccttttaaannacttttanggacattttacag

SEQ ID NO: 97614 - DNA, 471 bp, Triticum aestivum
  unsure (1)..(471): unsure at all n locations
  Clone ID: PAT_TA_97614
caatctccaaactcctcagcgcagcagcagccagatccttccccatccatcccaatggcccgcacgaagcagacggcgcgcaagtccaccggcggcaaggcgccgaggaagcagctggccaccaaggctgctcgcaagtcggccccggccaccggcggcgtgaagaagcccaccgcttccgcccggcacgtcgcctccgcgaaatccgcaaagtacagaagaacacggagttgtnaatcgnaagttcccttnnanggcttcttccggaaatttccccaganttttaaaacgacttcgcttcantcttccnngtnttcgcgtccanaaagggccccccaggtactcctncggtgtttntagggaanaactntggccaatcaacccanggnttttcantaagnccaaggattnatttcccccccncngtgggaaaggcacagtttngggcccccngggaanaanntcttccaa

SEQ ID NO: 97615 - DNA, 332 bp, Triticum aestivum
  unsure (1)..(332): unsure at all n locations
  Clone ID: PAT_TA_97615
gagcaatcctctctccgcgcccacgcagcaagccctccactcccgatggcccgcacgaagcagacggcgaggaagtccaccggcggcaaggcgccgcgcaagcagctggccaccaaggcggctcgcaagtccgccccggccaccggcggcgtgaagaagccgcaccgcttccgccccggaacnttcgcnntccggaaatttcnncaagttcaaaaaaacaaccanttttantcgnaaatngcctttcaaagccctgtgnggngaaatttcccnagagntttaaaacgactcngcttttnaantcnccttttcnccttagaaggngcccccag

SEQ ID NO: 97616 - DNA, 493 bp, Triticum aestivum
  unsure (1)..(493): unsure at all n locations
  Clone ID: PAT_TA_97616
gagaagcctcgaanatgtccggccgcggcaagggagggaaggggctgagcaagggcggcgcaaancgccaccggaacgtnctncgcgacaacatccagtgcatcaccaanccggncatccgtcgtctggctcgcangggcggcntgaatcgcatctcggngctcatctacnaggatacccncggcntgctcaagatcttcctgnagaacgtcatctntgacgccgtcacctacaccgancacnccctccgcaagacantcaccgncatggacntcgtctacgcnctcaacnccaangccgcanctctactgttctgaggctagaccgccgtcantcnaatccactcnctnccgtagcnaattcnttcatatatactacttgnnttcacgtnaatgcctcattgtaaagccganttcccgccctttaattttaatattgagtcatcattgtaacngatggaatgaacatttacctccangaaaaataaaanant

SEQ ID NO: 97617 - DNA, 507 bp, Triticum aestivum
  unsure (1)..(507): unsure at all n locations
  Clone ID: PAT_TA_97617
acaacaaaaagagacatttccacaacaaccaccatcttcacaacaacaacaaccatttcctcaacaaccaccatttttgcagcaacaaccttcattttcgcagcaaccactattttcacagaaacaacaaccagttctaccacaacaaccagcattttcgcagcaacaacaaacagttctaccacaacaaccagcattttcgcagcaacaacaccaacagttctgcaacaacaatccctattggtcatccatccattttgcagcagctaaacccgtgcaangtatcctccagcagcagtgtagccctgtggcaatgccacaacatcttggctaggccncagatgtnggcagcagagcanttgcaatgtgatgcagcaacaantttgccaacaattgccacgaacccccgnanaccccgctanaagnatccgtgctacacttctcancatcctacaagacaacacanggtttgtccaactcaagaanaacaacccaacatcngtnaag

SEQ ID NO: 97618 - DNA, 508 bp, Triticum aestivum
  unsure (1)..(508): unsure at all n locations
  Clone ID: PAT_TA_97618
ggcaaccagggtactacctaacttctccgttgcagctaggacaagggcaacaagggtactacccaacttctctgcaacaaccaggacaagggcagcaaccaggacaatggcaacaatcgggacaagggcaacattggtactacccaacttctccgcagctgtcaggacaagggcaacggccaggacaatggctgcaaccaaggacaagggcaacaagggtactacccaacttctcccgcaacaaccaaggacaagggcaacaactaaggacaatggctgcaaccaagacaagggcaacaagggtactaccaacttctcttgcaacaagacaagacnanggcaacatccaggcaanggcaacaagntactacactcataccatttaaccntggacaccaagcggcaacctaaagtggnaaaggccaacaactccccggaaactgcccggaatttccgctggaaggcgggaccattttccgcaaccanttataaattcncaatcccatgg

SEQ ID NO: 97619 - DNA, 487 bp, Triticum aestivum
  unsure (1)..(487): unsure at all n locations
  Clone ID: PAT_TA_97619
attggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacaatattcgcaaccacaacatccaattcacagcaagcaagcagcagcaacaacaacaacaacaacaagaacaacaaatacttcaacaaattttgcaacaacaactgattccatgcatggtgtgtattgcagcaacacaacatacgcatggagtttacaagttttgcaacaaagtcttaccagcggttgcnanattgtgttgtcagacctatggaattcctgagcatccattgccaagcatccacaagttgtcaagcatatccggcntaacaacaaaacaacaacaacaacatcgagccag

SEQ ID NO: 97620 - DNA, 479 bp, Triticum aestivum
  unsure (1)..(479): unsure at all n locations
  Clone ID: PAT_TA_97620
ctagaaccctatccctctcgctccgttgtcgccgcttcgccgccgccgccgcccccctccccctccaagcgttgctgagcagatcttccgctgtggtgctcgtcttcaagctaggcgatcacagccttctcaggcccgatatgaagcaattcctttctgatagccttgataatactagtcaggaatgtgaggcaagcggattgtgccacaagaaaatcagtccaaaccgagtggttccatttgtttggagaagaatggncntctgtctctgaatctcaaaatgacattntaanggatacnctattcncggtaccgcatggaatccaaacttttttacgaaacagcanaattncagtgcaccagcanaantcaaaaccagaagaagataactacaatgtaaatcccggaaaattgcgtancantcnccatttaaaganctatcnttaacccacgggganaaccacaagttggnngaccat

SEQ ID NO: 97621 - DNA, 488 bp, Triticum aestivum
  unsure (1)..(488): unsure at all n locations
  Clone ID: PAT_TA_97621
ccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagtccggcgggttcgagacngccggggagaccggcggctgcgactgcacaactgcaagtgccgnacgcctnccgctgtcctgctgcaactgcaactgagccggcgcccaggagccggccggcanaggcgacacgaggatgaggangacaagcaagcaanacatcacacattcacacaccagcgtacatcacagccgcgcatcgctcgcggcgcgcgcgctgaataaaataaaacacgttctttccgtagtcttatccctgtccgttgttc

SEQ ID NO: 97622 - DNA, 393 bp, Triticum aestivum
  unsure (1)..(393): unsure at all n locations
  Clone ID: PAT_TA_97622
ccaacaaccgcaacaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccangtgatgcagcaacaatgttgccaacaactagacagtcctcgccagtccagtgtgcagcatccatacggcctgattcaacgtcatgcagcaagaacaacaacaaggataaatttcccngcanngtttaacccttccaaggcaaggnatcatccaactcaaaaaacagtccatatnagggntttagggnattggattttgnacctttccaaaaatntaactgtttgttccag

SEQ ID NO: 97623 - DNA, 405 bp, Triticum aestivum
  unsure (1)..(405): unsure at all n locations
  Clone ID: PAT_TA_97623
actagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactatttttcacaacaacaacaactatttcctcaacaaccatcatttncgcagcaacaaccaccatttttngcagcaacaacaccanttntcaagcaacaaccaatnctaccaacagcaaccaacattttncgcannaacaacaactagttntaaccgnaacaancaccantttnacaaggaacacaacattttntctccanaacancaccttttncncnacaacaacaacacccanagct

SEQ ID NO: 97624 - DNA, 359 bp, Triticum aestivum
  unsure (1)..(359): unsure at all n locations
  Clone ID: PAT_TA_97624
cccccatccgatctcgccgggaaacctccgatctaagcgaagccaaggctctctcgtcctcctcctcaaggtatgcgatgcgagcctccgatttcttcccctccttcccgccacgtgcgtgcgtgcactgggatcgttgctaggactaccatggtcggttcttgttggttcccctgggattcctcgtttgggagtagatctgtgggtgggaggcgtcagtgctgtcgatcgattgcagcacgttcgattaccgtggntggttaagcttcgttccnagtcaaatttcccttgattaatgcaatatttccgagtagatnctgccattccgatgcaacgctgttgggtccgttcgtcctaac

SEQ ID NO: 97625 - DNA, 339 bp, Triticum aestivum
  unsure (1)..(339): unsure at all n locations
  Clone ID: PAT_TA_97625
cgaccgttcattcagccatctctacaacaacgtttgaacccatgcaagaatatcctcttgcaacaatgcaaacctgcgtcattggtgtcatccctctggtcgataatctggccacaaagcgattgccaagtgatgcagcaacaatgctgccaagaactagcacagattcctcagcagtccaagtgcgcagccatccatagcgtccgtgcattctatcatccgtgcagcagcagcaacaacancaacaacaacaacaacaacaacaacaacaanggantcantcccggtngcaantntctcaacaacaacagttggtcaaggacccncnttcaanggcaa

SEQ ID NO: 97626 - DNA, 382 bp, Triticum aestivum
  unsure (1)..(382): unsure at all n locations
  Clone ID: PAT_TA_97626
ccacactctccagcaccagcaggccggcggcaagcagcgcaagcacagcagcaaatggctaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgaccccggcggccgccgtccgcggggccggcgcgtccctgctcgccgcggtcgggcgccgttgaccgcgtccngcgggggcccgggntcnctctggtncancaancggntttccaaccggangggnaaccgggctcaaccctngggncttacnaaaaaactngttgggnngtttcnccctgggggttt

SEQ ID NO: 97627 - DNA, 368 bp, Triticum aestivum
  unsure (1)..(368): unsure at all n locations
  Clone ID: PAT_TA_97627
gcgagcctcacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgangaggtcgcnaagaacggaggaagccccgcgccggttggaggccgaagtncnaggngcctnnccccgttcnaagtttaggaaccaaaggagggangcgccccgcagcattttagcaaaggagacgaaggagcccagccagcanctgccggccaaccggangccnangcgccgccngttgtncnagacaagagacaaagg

SEQ ID NO: 97628 - DNA, 482 bp, Triticum aestivum
  unsure (1)..(482): unsure at all n locations
  Clone ID: PAT_TA_97628
ccccctccagccccctcgcgccccagccgacgccgccgccgccgtcgccgccgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaaganggccggagagctttccgcggaggagatggaccgcctgatggcggtggtgcacaacccgcgccaatttcaaggtgccggactggttcctcaacagaaagaaggactacaaggacgggaggttctcccaagtcctgtcaaacgccgtggacatgaantcaaggattaccttnaaanggtcaagaagttaggaacatcgtgtctgctcacnacngggtgtnctntccgcggtcagacacaanataccggaaggatn

SEQ ID NO: 97629 - DNA, 469 bp, Triticum aestivum
  unsure (1)..(469): unsure at all n locations
  Clone ID: PAT_TA_97629
gaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcanaaggncaaggantgcctgcctctgatnctnanccttgaggaacanactgaaatatgctctcaactnccntttaatncaaacccatnccttttcancgtcntatttnggtttatggnaaaaggtccgcactnncaaagactacccngctggttcaangggcatcaatttncnattnccaanacngggttaaaaactncaagnttctgttttacaccaaagggtcncttccgncttnatctntnaaggaacnaggatnctnaattnaagccttcaaagggtcaagtctntccantttt

SEQ ID NO: 97630 - DNA, 395 bp, Triticum aestivum
  unsure (1)..(395): unsure at all n locations
  Clone ID: PAT_TA_97630
gcgagcctcacactctctgatcagagtagcactagcttcagctagccagcctctgccactccggtcattttcttgcatccacgacggcaatggccaccgctgatgtccagaacccatcggccgcgctgacggaggaaggcgcccgcggtggagaagccggtcgccgccgaggaggtcgcgaagaccggaggaagcccccgcgcccgttggaggcnaagtcnaagngctgccccgttcaaggtttaagaacnaaaggangaagccccggaacaatttttaggaaangaaaacaaaaggagccccaaccaacaactngcggcnnaacccggaggccccaaggggcccccnttggttccaaaaaaaagaccnaagggggcctttnttnggaaaacccc

SEQ ID NO: 97631 - DNA, 460 bp, Triticum aestivum
  unsure (1)..(460): unsure at all n locations
  Clone ID: PAT_TA_97631
ggagcgagagcgccaagaagacgatgacctcgccggcgccgccggtggccgctctcggcgatgatctcctgggcgagatcttcctccgcctccccgacatggcgtcgcttgccaacgccgccctcgcctgcaagagctgggccgagtagcccgcgtcccagccatctaccgccgcttccagtcccttcgcaggcccccactcgtcggcttcatcctcaccgaccgcagcgacatgcccgttccccaccactgccctaaantccgcttcgtccccgccgatcccgtatcccgacttggctccgcngcggttgncgggnattcttcttcnanaactcccnatcataanttcggccaacaacggcaaaggggactatacaacaattgngcctcngagggttcnaaggnggctctcctcctttccgcggccgctatgctttggttttcccccntatnacccctc

SEQ ID NO: 97632 - DNA, 449 bp, Triticum aestivum
  unsure (1)..(449): unsure at all n locations
  Clone ID: PAT_TA_97632
tttcccctccctcctcctgaccacccacccacctaccaaccaccgaggcggccgatctcccctccccacccgcgccgcgccaccgccaccgccgccgccgccgccgccgccggnagccgttcntctcgagattgacctttggngactgttagaaaccacaggcggtgaanatggcgcatcctgctgagctttcccgtgagganaatgtgtacatggctaatcttgcaaagcaagctgagaggtacganagagatggtcgagttcatggagaangtggccaacacaattgactctnangagctcaccgtcgangagcgcaaccttctatcagttgcntacaanaatnttattggngccngcntttccncgtggngcatcatttcctccatcgagcaacaaggaanngagccgtngcaatgaagacntttcacactcatcaaggataccgt

SEQ ID NO: 97633 - DNA, 486 bp, Triticum aestivum
  unsure (1)..(486): unsure at all n locations
  Clone ID: PAT_TA_97633
actacaccagcgaaccagacttggctagaataccatggcgtgcaagtccagctgcaacctcctcctcttggccgccgtcctgctctccgtcgtcgccgctgcttccgcctccggcagctgcgtcccaggggtggcttttcggaccgatcttctgccacactgccgcgactatgtgttacaacaaacttgtggcaccttcacccccgggtcgaagttacccgaatggatgacatccgcgtcaatatctcccccatgaagcatacctcgcaagttgtattgctgccaaggagctcccanaaatcctcancaatgccggtgcnangcgcttcgctactttatancgttncccggtaccgtntcaanccgttgacccnaagtccggnaatgtccgtnaanaacggctcantnacctgccccggngcccaagcaaattcaatgggacttntcaaataatntttncccccggggaattnnaantggggacat

SEQ ID NO: 97634 - DNA, 510 bp, Triticum aestivum
  unsure (1)..(510): unsure at all n locations
  Clone ID: PAT_TA_97634
angnagtgctcaanacanatccaccatgaagacctttctcatccttgccctccttgctattgtggngaccaccgccacaactgcagttagagttccagtgccacaattgcagctacaaaatccatctcagcaacagccacaagagcaagttccattggtacaagaacaacaatttccanggcagcaacaaccatttccaccacaacagccatatccgcagccgcaaccatttccatcacaacaaccatatctgcagctgcaaccatttccacagncgcaactatcatatccgcagncgcaaccatttcgancacaacaancatatcacagccgcaacaanagnattctcgnagacacaanaanganttccancagcagcagcagcagcagcaacancancaacaacaacancaaancctacaacaaatttgcaacaacaactgatccatgcaaggatgttgtattgcaacaacacaacataacgcangggagccacaaattttncaagga

SEQ ID NO: 97635 - DNA, 320 bp, Triticum aestivum
  unsure (1)..(320): unsure at all n locations
  Clone ID: PAT_TA_97635
cttcactgggtactancatggtgtgaggctgggtctccagctantgggaaagcngtcagctcgatcctatggngctggaagctgtggngttcccgcatgagcacctcgcgtgcagcacggacaaggtggccgcggcgatgtccatntacgcnccgtcactgggccgcngcatcagcattgtcgangattctnngatgaanggcggcgtgagtnctccaagaagangtgcccggcgccaccgcctgngccncggccttcgaggggaactnggaggagaatcactgccggcctgcgcncgtgtcgccgccggatgctgtcgc

SEQ ID NO: 97636 - DNA, 482 bp, Triticum aestivum
  unsure (1)..(482): unsure at all n locations
  Clone ID: PAT_TA_97636
gcctcctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacctgcaagtgcggcaccgcgttgcggctgctccctgctgcagctgcaacttagccggccacaaggaggcccggccggcaaaggcgacacaagatnangaaggagaagcaagcaatcatcatcagcaccacaacaccagggttcantncactagcgccgangnctcgcgcgcccgctaaataaaataaaactcanttttccttaattcngtncan

SEQ ID NO: 97637 - DNA, 229 bp, Triticum aestivum
  unsure (1)..(229): unsure at all n locations
  Clone ID: PAT_TA_97637
agcacagancggcttcttctccgttggcggcggcggctanggttttaccacctcctcacctccctccaaaaccctaatctttccatccaatccgtcncccatgccggcggcctcctgctagattcnaatcgcnccggagttgtactttgtttgagtgcntggttggtgctgtgcgncggagatnacntccanccagttcgatctcctcntgcgacgtcnacaatgacga

SEQ ID NO: 97638 - DNA, 453 bp, Triticum aestivum
  unsure (1)..(453): unsure at all n locations
  Clone ID: PAT_TA_97638
cacaccagcctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtgggaggccaccgccggcgccgccgccatggtcatgcccaccgcctcccacaaggggagctccggcgggtttcgagaacgccggggaagaccggcggcttcgactgcaccacctgcaagtngcggcaccgcgtncggctgctcctgctgcaactgcaacttagcccggngcccannaaggcggccggnaaaggcaacacnaggattaaggagggcaagcaancnaagcacatcacaacnagttaacaacaccaanngttataacaaccgccgaatgccccccgggng

SEQ ID NO: 97639 - DNA, 439 bp, Triticum aestivum
  unsure (1)..(439): unsure at all n locations
  Clone ID: PAT_TA_97639
gagaggtcgcgctctgccccgtgcggtgcttccgccccgaccccgtctgcggcgccgacggcgtcacctactggtgcggctgcccggaggccgcctgcgccggcgcgcgggtggcgcggcgcggctactgcgaggtcggcgccggctccgcgcccgtctccggccaggcgctcctgctcgtccacatcgtctggctcttcgtgctcggcgccgccgtcctcctcggcttcctctgacgcgcgcgcgcgcctccgtcgccccccttcctgtaattgacgtcctccccatccccacaattggtacaactactcatttcaanattctttgttggatttcggtgcgctcttganagccnagggggtgtggtgctggaacggaatgtttcgttgcnanggatgtcacacaantctttcatagatgatgagattggtggcttnng

SEQ ID NO: 97640 - DNA, 367 bp, Triticum aestivum
  unsure (1)..(367): unsure at all n locations
  Clone ID: PAT_TA_97640
agaacatatnanaagtgnctangtngtggacttgattttancaaanatnatgaaaacgtaanctcacaaccatttatgcnctggaganaccgttttgtcttttgtgccgaanctatttataaatcanaggccgaaaccggtgaaatcaacgggcattacttgaatgcgactgcgggtacatgtgaanaaatgattaagatganctgtatttgcaacataattaagggttcctattgtaatgcangactacttaactgggggattcaccgcanatacnacatttggctcaatattgccgccacaatggnctanntcttcacattcacccgntcaatgcattcanttnattgatngncancaaaatcat

SEQ ID NO: 97641 - DNA, 439 bp, Triticum aestivum
  unsure (1)..(439): unsure at all n locations
  Clone ID: PAT_TA_97641
gctgggcgagacgcacgagatccgatccgatccgatccaccccggagccggaaccctagccaggcccaccgccatggcgacgacgcgcccgctcctcctctgcgccgccctcctcctcgccgccctctcctgcaccttcgccgccgacgcgcccttcctcgtcgcgcacaagaaggtggccctctcccgccccaagcccggcgtcgagcgcctcgccgtctccctcgacctctacaaccagggatccgcaactgcatatgatgtggccattaatgatgactcgtgggccaaggaagcatttgaacttgtctctggagaggtctcgaagactttggaaaggcttgaacctgggtgccactgcctcgcacgcgtttgtattgganagcaaaacacaaggcaagttcaaaagcttcacccgctgttatcaagtacgtgttng

SEQ ID NO: 97642 - DNA, 285 bp, Triticum aestivum
  unsure (1)..(285): unsure at all n locations
  Clone ID: PAT_TA_97642
gcccgcccccgccccgtcaatggacacgcccaccacccccgccggcgccgccggcaccgtccaccccgccgctgcgtgggtcgccaccgccgccgtggncgccgccgccgccttctactgagagatccgcanatcggctgcgatttaatttatccgaggggccccgctccctctccttttgtggtggtgttcttcgagctgttcatcttccttctttttgntgctttgatgatgattacattcngcattcnattcngttancaaaaanacaancaaaactaaaac

SEQ ID NO: 97643 - DNA, 428 bp, Triticum aestivum
  unsure (1)..(428): unsure at all n locations
  Clone ID: PAT_TA_97643
gcaacaancatttccctggcaaccacaacaaccatttccccagacccaacaatctttccctctgcaaccacaacaaccattcccccagcaaccccaacaaccattttcccagccccaactacaattcccccagcaaccagaacaaataattccccagcaaccccaacanccattcctcctggaatcncaacaaccattcccccagcaaccccaacaaccattttcccagccccaacaactgatccccatgcaaccacaacaaccattcccncagcaatcccaacaatcacaanaaccttttcccggggccncaacaattatttccngaactccaacaaccaattcnccagnanccacatcaacatttcccctgcaaccntaacaagcattcnccaagnatcgcaacaacaattccccaacagccacaa

SEQ ID NO: 97644 - DNA, 431 bp, Triticum aestivum
  unsure (1)..(431): unsure at all n locations
  Clone ID: PAT_TA_97644
ccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgaagggctgcagctgcggcgacaactgcaagtgcaacccctgcaactgttaagctgcatgcactcgtacgtacgtacgtgtgatggtgtganagtatacttgaataacgagcgtctgatctgatggagtccaacaanggtgcntgtcctgtgattgcntgctcgctctccgcctaagctccggccaaggggtccttgngtg

SEQ ID NO: 97645 - DNA, 468 bp, Triticum aestivum
  unsure (1)..(468): unsure at all n locations
  Clone ID: PAT_TA_97645
cgtaggcaggaagtttccgctgcgcaagcggccactgccagtcgatgcgtactagccacggccagggcagcagtacactgaatgccgctggagcttgccaaaaaaacggtgcgtcgccaggctgtgagccgcggtgcaaaagtggcggcttgcgaggcccaggcgagctcaccaaaggcaagcaaacgggccgggcgggcgagcgatcgaacacgcgcaccgcgcacgcacgagccaccggcaccgtccaacggacggcgattaaaggcctccttaaaagcgcgtcgtctccaacgctcccaacctcgcgattcgattcatcaacaacgtctcgacaagcacnaccattccgccgccgggcgctgcttgcttngactactacaanggnggactccccggngccaacnggcaggtancatggagcccattggcaaggcccacangtgcacaacttcnacaagcgggtct

SEQ ID NO: 97646 - DNA, 479 bp, Triticum aestivum
  unsure (1)..(479): unsure at all n locations
  Clone ID: PAT_TA_97646
acgaacgaacgtagcagagcagacacacacgcgcgcctggagagacagaggcaggtgacagatcgagagatggtttgtgcctggacggccagtgctcctctgctcgcggcagcagtagtagcggcgctggcaatggtctgctcgctggggtctgggtcttatgcggcggcagagcaagaggctgccggcgccggcgggagcgacttgangttgaggaacctccgattaagcgcgggctgtccttcgacttctaaaagcngagctgccccaaggcggantcaatcgtgcgccantttgtccgggaaccccttcgcaaaggaattcggctcgccgccgggctcttcggctcaanttcaacaacggctcctcaaaggttgcaaccttcggtgctgctcnanngttccggcaangggaaccggggaaananaaggnccccaaacttaaagngggcccntcnncttaaaggcaataaaaaaatt

SEQ ID NO: 97647 - DNA, 497 bp, Triticum aestivum
  unsure (1)..(497): unsure at all n locations
  Clone ID: PAT_TA_97647
gccatggaaacacatgaaatttggattgcacatatatatgttatcctaccatgtgcacatactacatccacttggttagccatttgacctctccatagtaagcaaacaagtgaaaattatgctcacagagccgcactagccatgcgtggccggaggtagcaggtgcgacacaggggattagccagaatatcaccttgtactcccaagagaaaatgggatcagcaagctcttctcccagcttgggagttcaaagccagcagttggagttcaagagccagcacctgagcatgcangacacacacccagccatgaagatctccagtggttggaggccctgctgtcgctgaccccgcgcccccttctacaaccgcagcgaggttctgaacgcagctcccgtcaatggncaactcctgctgcagctcctccccgagcaacgctgctctgggccaagctccgcgcttgcggggtcctgtnngtaagcaaacaacaaggcaant

SEQ ID NO: 97648 - DNA, 426 bp, Triticum aestivum
  unsure (1)..(426): unsure at all n locations
  Clone ID: PAT_TA_97648
caacaatttccccagtcacagcaaccacaacaaccttttccccagccccaacaacaattcctgcagccccaacaaccgcaacaatcattcccccagcaacaacaaccgttgattcagctatctctacaacaacagatgaacccctgcaagaattttctcttgcagcaatgcaaccctgtgtcattggtgtcatccctcatatcaatgatcttgccacgaaagttgattgccaggtgatgcagcaacaatgttgccaacaactgggcacagttcctcaagcagtccaattgttgcaaccatccataatgtccgtgcattccatcatcatgcaagcaaagaacaacgacaagggtgcaaattccggnggcatgtttaactccttnaaggnccaaggatcatccaacctcaacaacaactcaatttgag

SEQ ID NO: 97649 - DNA, 556 bp, Triticum aestivum
  unsure (1)..(556): unsure at all n locations
  Clone ID: PAT_TA_97649
cttctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccaagagcgacgatgtcgagctcgtcgccgtcaacgaccccttcatcaccaccgagtacatgacctacatgttcaagtacgacaccgttaacggcactgggaacacantgacatcaactcaaaggacaacaaaatccggccctttggnnaaaaacaattnacgtttttcggggttangaaacctaagggattcccttngggnaaggccggngcccataactttntgggtccaaccggntnttcactgaaaaggngaaggggctgtcccatttaagggggggncaaaaaggnggcaatctttgccccaaanaaaatncccaantttgggttggggtcaacaaggaaattnactcaaacnttaaattctnaatgcaactgacaanaaaggcctngnncctactnanaatatan

SEQ ID NO: 97650 - DNA, 193 bp, Triticum aestivum
  unsure (1)..(193): unsure at all n locations
  Clone ID: PAT_TA_97650
cccttccggttcgggttctggttcggttctggtccgagagtanctaccctagtctagggtttccgtagagaggaanggagagggagatccatccatggcggagacagagtancgctgcttcgtgngcggnctcgcctgggccaccnacgacaacaatctccanaaggccttcagccaatacggngacatcctc

SEQ ID NO: 97651 - DNA, 225 bp, Triticum aestivum
  unsure (1)..(225): unsure at all n locations
  Clone ID: PAT_TA_97651
gagcgagcgagagagggggcggcggggaggccgatgcgggagatcccacggggggtcgccgagccggnaggangaggaacgtcagcnataaattnacacncccnataagcancgcacctgcgccgccgcnggnttcnaggactcaccgtcntcatttttatcaataatctatctccnatccaantcctanncctcaggatacatcacataaantgnactattcaa

SEQ ID NO: 97652 - DNA, 438 bp, Triticum aestivum
  unsure (1)..(438): unsure at all n locations
  Clone ID: PAT_TA_97652
cgacgagggcttcctcctatcagttaaatcaaagtcatggagcacaaggagaccggctgccantctcgtgagggccccatcctttgcgtcaataactgcggcttcttcggcagtgcggcgaccatgaacatgtgctccaagtgccacaaggagatggcgatgaagcaagagcangccaagctggccgctcctctttttgacagatcgtcaacgtggtgatgccgcnaaagacatcttgctgctggaacacggnggtggaattcccacgttnaagggaananncttattaccgnaaacctgctaattcccggtccaagcaaggcggaatggnaaacccaaagggccaaaccggttnannactttaaaaaaaggttnggcttaccggttnaaaggcggtnnggaaccttaagggnnaaccacgttncncggaaaanatnt

SEQ ID NO: 97653 - DNA, 534 bp, Triticum aestivum
  unsure (1)..(534): unsure at all n locations
  Clone ID: PAT_TA_97653
gcctggnatctccatctctctccccctcaccacttcttctcccacctccggncgccgccgcggccaggccatcgtggnggcgcgcttccgcnacctcgttgctccactatcacccgngccatccaccacccacaccatcatccatacatcacagcgccagccagcagtgcccacctcgcgcgacctctccctccagccggcgcgcccggtnaagacacaccgtcgttgcttcttcttcccttcttccccgcttctctgaatccctgtctgctgctccttctnncccgcgcccctgctgctgctctctacaantctccctngctgctatccttctcnaannttgactcctctctgatccctaacngcngctgtcttctctttccctaacaaaacggngttcgttccttncaatctcnaaactcaaantnttgctgtantcanctcctttnncccgccgtcttntcctctttcaatgcccccggctatgctctcntctcaactccgccgttgctctncncncacccnaaatatgta

SEQ ID NO: 97654 - DNA, 521 bp, Triticum aestivum
  unsure (1)..(521): unsure at all n locations
  Clone ID: PAT_TA_97654
gaggagggccaaagtaaaaaaagagagatcagggaggggaggggatcaaaatccctancgctgctccattcccaaatcgggcctggaatctccatctctccccccctcaccacttcttccaccaccggccgccgccncggccangccggcntggnggagcgccancanctccactgtccatctgtgccatccaccactccatctccaccaccgcnccatcactccaccgccgcacctcggcgccccgaccagacgggcgcctggntcctccgcgtgaaccccccatgctgctgctctttctttcttcctcccctgctgctttttgctgctccttcttcanctatctccnctgctgntcctccaactctcttcttccctcgcctctanctgntgctctaatctctcttaatcccccgctgctgcttcttctttctcaacccctcntgctgaagcctctctcaanaccgctgctgctcttcccttgtccnangcgctcctctntccctgatccctaatnctct

SEQ ID NO: 97655 - DNA, 391 bp, Triticum aestivum
  unsure (1)..(391): unsure at all n locations
  Clone ID: PAT_TA_97655
acatgaaataattaccttcttgtggagcaaataaatagtttgatcacatgacgactgctcgagcgttgaaacttggtatggtttgttcatgcacaagcttgcaatttcaacttgctgggcagaaacaataattctacttccgtttcttgttgtcaggaaagtacatcctaacacgatgccaccctctattgtcgaaagtcattttataacaaccaggtactattgctacacaactggggcattaaacacacngnctaaatcactttgtncaagttcnccanccttgggcaagacatcanccgcaacnttttccttgcccggnttttccnagnccaacaaggagnttttcaaaaaattgccttaccaactcccgggggaacctttccgnttt

SEQ ID NO: 97656 - DNA, 377 bp, Triticum aestivum
  unsure (1)..(377): unsure at all n locations
  Clone ID: PAT_TA_97656
ttnttttttttgccgggaaatnncagtttattgcatgtcacaaacattgnccaccggcataaaacggacagncagctacagnnccanaaaatgtnacacatcgngaccgatacatggntgantacattccaaagggcacacaagtacatcacaagnattgnggtacaatggacgccagccntgcacangagaaatggaggagatcatttatgaccattnaaaattttttncaagcnngttncttcaaaacgtanngacaacgntatatccttccntgccggaaaacncaagcaangcaagaanggctgccgncttcttttttnagggctgccnnaaaancaaagcttcaaagctttctcctcaccanntccatgcaa

SEQ ID NO: 97657 - DNA, 370 bp, Triticum aestivum
  unsure (1)..(370): unsure at all n locations
  Clone ID: PAT_TA_97657
atttaatccaagcaaggtgtggtnaatnnaaatccancangaanacatttctcatccttgccntcnttgctatcgtggngancatcgacacanatgnagttagagttccantgccacagttgcaaccacaaaatccaactcancaacagtcacaagagnangttccattggtacaacaanancaatttctagggcatcancaaacattttcaccattcaaccatatcnacaagcgnaanattttcatcacaacaacatatcttcancttgaacaatttcncaagcncaacttcanatcggcatcaanaanaattcaccacagcaacnatntcacaacggaagcacatatcggaactcaanaacaatttcc

SEQ ID NO: 97658 - DNA, 199 bp, Triticum aestivum
  Clone ID: PAT_TA_97658
ctgaatctgaacatgacatgatgaaacactggaatgtaatcagaccattttctctctctatgtgtgtgtgtaacaagttcctttgattgattgtcatacttctcacacacacggactggatcccggctgcgagggcaacctctagcctctgcatcttcctccctgacggtagcggcctaacacgcatgaagagccgatt

SEQ ID NO: 97659 - DNA, 495 bp, Triticum aestivum
  unsure (1)..(495): unsure at all n locations
  Clone ID: PAT_TA_97659
tagngcacangaatcaaatccaagtaagtagtacctaacgcanatccaccatgaagaccttactcatcgtaacaatccttgcgatggcaacaaccatcgccaccgccantatgcaagtcnaccccggctaccaagtacaatggccacaanaacaaccattcccccagccccaacaaccattctgccagcatccacaacanactattcnccaaccccatcanacgttccaccatcaancacagcagacattaccccatcaaccacatcaacaantttccccanacncagcaaccacaacaacatttncccaagcccaacaaacattcccccaacatccccaactacaatttnccaanaaccccataanccatccnccanccttcaanaaccccaanacattttcccaatcacntatcaagaaaacttttcccanccccaanaacattctgnatcccaaaagcgcntattcttcccaannacaacaacgttgatcaa

SEQ ID NO: 97660 - DNA, 290 bp, Triticum aestivum
  unsure (1)..(290): unsure at all n locations
  Clone ID: PAT_TA_97660
gtcacccgagcgggggctttaagctggtgtgaacgctggtgtggcgctgtgggcctggctgtagtgtgctactgctggcccgcctgttccaagttgagtagtgggaccggcggggcctgtgccaaagctgggcctcacgggccatgatttggcaggcactgcgtaaggctggcctcacaagagcaacgacaactgcctgcttccaacggtggaaagataacgggccgctgtnnacttcaaccgctttggcctcgcaacccacccaaggaacccaccatttntaaannggg

SEQ ID NO: 97661 - DNA, 577 bp, Triticum aestivum
  unsure (1)..(577): unsure at all n locations
  Clone ID: PAT_TA_97661
gcgaaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcngtgccgccggacggtggagaatttccgcgcgctgtcaccggcgaanaaaggcgtncggnaanaacgggaagccgcttgaactanaangggacgcctttnaacgcggtgatttccccactttaatnttccaaaggggggaattttaacccngggggaaangaaaccnggggggaattccatttttggggnaaaantttccccnnnaaaaatttttcccaaaaagcaancnaaaccngggtttctccccaangggnaaaanggggggccaaaannaaaggtccaattttttaatnggnacgttccccggaattngttccaanggnaaanaattgtcttngnaaagtctccanggnatgncttctcaanaacatcaaaangnggcnccgnagggaactgctcaancaggtgtctcccnan

SEQ ID NO: 97662 - DNA, 499 bp, Triticum aestivum
  unsure (1)..(499): unsure at all n locations
  Clone ID: PAT_TA_97662
tttaacaccaatccaccatgaagaccttcctcatctttgccctcctcgccgttgcggcgacaagtgccattgcacaaatggagactaaccaccattttcacaacaacaaccaccattttcgcagcaacaacaaccaccattttcacaacaacaaccaccattttcgcagcaacaacaacnanttctnccncancaacnatcattttcacatgancanctancancattttcacagcaacatcaccgtttncgcaccaacaacagctattctacctgatgaacncaattttgcatgataagaaccaatntttccgcaacaaccatantttcngaagaacaacaaanntactcaactngaagaaactccatttttcaccatcagcagcgtagtanaccaagcaggattctccagaaaagagncangnggaagcaaaccngcaagcccaagtttagaaanattccagtccgcanannttcaaattgcnnaaccnaaaacctg

SEQ ID NO: 97663 - DNA, 394 bp, Triticum aestivum
  unsure (1)..(394): unsure at all n locations
  Clone ID: PAT_TA_97663
tttttttttttgccgnanaaacccagtttattgcatgtcacaaccattgnccactggtacanaacggncagacagctacagctccaanaaatgtcacaantcggcaccgatacatggntgantacattccaaagggcaanaatacatcacaaaattgtggnacaagggccgccagccgtnagcagaaaaatggngganatcatttatgacgaaagaacacttttatctagctagcttcctccanacggtacgggcacggttgattcangtccgttggctgcanatctcaancaatgcannaactgtgccgtcttctttgtgaagcctgctgcaaaagaanancgttcaagctttttccacctccttccnccaaggaaagtngaaaacaactatt

SEQ ID NO: 97664 - DNA, 485 bp, Triticum aestivum
  unsure (1)..(485): unsure at all n locations
  Clone ID: PAT_TA_97664
gtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaaggaaataaggaacttancgctgcagacgctgcctgcaatgtgcaatgtctacatccctccatattgctccgaccaccattgcgccatttggcatcttcggtactaactggagaagagaagaancctagtactanatatatgaaacaccgttttcctaatccacantttgatcgttgtagcggtgaaaaaataaagngtcatgcactacatgttagaacccgacttactattcaaacttgggaataaaagacatacacatgtcttgtctgcaaaaaanaaaaaaaaaaaa

SEQ ID NO: 97665 - DNA, 449 bp, Triticum aestivum
  unsure (1)..(449): unsure at all n locations
  Clone ID: PAT_TA_97665
agatggcggcggcggcgacggcgacgactacagcggcggcgacggcggcggcggtggggccgggggaggtgatctccgtccacagcctggagcagtggaccatgcagatcgaggaggccaacgccgccaagaagtggtggtgattgacttcactgcatcatggtgccggaccatgccgcatcatggtccatttttggctgatctcgccangaattcccagctgctgttttcctcaaaggtcaacgtttatgaactgancccattgctaacattcaagcgtccaaggcaatcaacttcccngtcaatgaagggaaggaactcaagganggtttttccggnttcaaggnggccttaaacaggttgncccaaccggtgccaanacacctaccggnatttccccaaanaaatncctttaaattatcncaatggaccgtatcgttacgcttctc

SEQ ID NO: 97666 - DNA, 476 bp, Triticum aestivum
  unsure (1)..(476): unsure at all n locations
  Clone ID: PAT_TA_97666
gtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaaggaaataaggaacttagcgctgcagacgctgcctgcaatgtgcaatgtctacatccctccatattgctccgaccaccattgccgccatttggnatcttcgggtactaactgagaagagaagaatctagtactagatatatgaaacaccgttttccttaatccgacanttgatcgttggtagcggtgaaaaataaagtgtcatgcactatcatgttaagaacccgaactatactantcaaacttgnggaatanaagacatacacagtctgtctgcaaaaaa

SEQ ID NO: 97667 - DNA, 476 bp, Triticum aestivum
  unsure (1)..(476): unsure at all n locations
  Clone ID: PAT_TA_97667
gtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagtccccagctcagcaaccacaacaacattttcaagccccaacaaccattccccaacaacacaacaaccattccccagatcaacaaccacaacaacatttccccagcaaccacaacaacaatttccccagactcaacaaccccaacaacatttcccccaacaaccacaacaacattcccccagatccaacaaccccaacacaattcccaagttccagcaaccacaacactttttcccagcccaacaanatng

SEQ ID NO: 97668 - DNA, 278 bp, Triticum aestivum
  unsure (1)..(278): unsure at all n locations
  Clone ID: PAT_TA_97668
acgacttcgagctgctgaggaagatggtgctgccggacggcaccgtgctgcgcgcgcggctgccgggccggccgaccaaggactgcctgttcgcggacccggcgcgcgacggcgccaccctgctcaagatctggaacatgaacaggttcacgggcgtgctcggcgtgtacaactgccaagggcgcggcgtggactccgcngagaagaagaacttcttcaacaagnaaggccggggccggcgcgctgaacttgcgngntaaggaanccgaacttcaatt

SEQ ID NO: 97669 - DNA, 519 bp, Triticum aestivum
  unsure (1)..(519): unsure at all n locations
  Clone ID: PAT_TA_97669
nanncatcnnaagnagggcanatntnactcctnacttgcntcctcgacaatggcngccggaacgtggatcacgacnatcatggtgaccaaggannaaacgccacctcgctcgctcatgggacatgganagaatctggcttacttgctcgccgnatcnctgacggtcgccttcccttgcgtactcncancccgagtccagcatcttggacttcccacgcagggctctgntcaccatacgtgggactcaacctgtcccacggcgccncgtnggtaacgngngagnatnnctngaaagtccgngnncnntnttnnnaaaaaccaagctctnagccgccgggccaaggcgggcgtccanaaggccagaaggcgaaaaaggcaantaagcaacagtgantctgaggaagtnaggtcaagatnggnaaccgcactgcngcggtggtcaacggcgcatcccggagccgtgtccaagattttctggggccactgggagacattaagaccactgatggtggggantcn

SEQ ID NO: 97670 - DNA, 215 bp, Triticum aestivum
  unsure (1)..(215): unsure at all n locations
  Clone ID: PAT_TA_97670
ccanccnccnacccgtcagcctanggttttgngtccgacgcntccgcctccgccgcgcaccatgggccccgacgagctccccaaggncgccgccgccggtgccgacgagatttccccgttctccttcagaatctggccgccgacacagcagacgcnggangccgtggtncagcacctgagtggacaccctgggacggcgacaccctcctctgnaa

SEQ ID NO: 97671 - DNA, 486 bp, Triticum aestivum
  unsure (1)..(486): unsure at all n locations
  Clone ID: PAT_TA_97671
agagcacaagcatcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacaanctattccccaaccccatcaancattccaccatcaaccacaacaaacatttccccaaccccaacanacatacccccatcaaccacaacaacaatttccccagacccanacaaccacaacaacatttcnccagccccaacaaaattcccccaagaacccaactncatttccccagcaacccancaagcattcncccagctcagancccannaacattccccaatcacancaaccanaaaacnttcccagtcccatcaanattncgcagccnaacaacananngtattg

SEQ ID NO: 97672 - DNA, 379 bp, Triticum aestivum
  unsure (1)..(379): unsure at all n locations
  Clone ID: PAT_TA_97672
gttancaccantccacaatgaagaccttcctcgtctttgccctcctcgctcttgcggcggcaagtgccgttgcgcaaatttcacagcaacaacaagcaccgccattttcgcagcaacaacaaccaccattttcacancagcaacaaccaccattttcgcagcaacaacaaccaccattttcncngcaacaacaactaccanntattcaacnatctgttttgcnacagntntcnccatgancngtattctcnccagcagcaangaatcccagtnncanatgcangatgtcngtgcnatgtnaaacatgttgcatnacangatttgcaacgtgaagngagancactttgccagcanatgangaaatcttccgnacaatccg

SEQ ID NO: 97673 - DNA, 200 bp, Triticum aestivum
  Clone ID: PAT_TA_97673
gaaacgggcatttcatggatggatatcactgagacactaaatttgatacttgcacatatgtttttgatgttcttttctttttcactgtgcttccatgattgatgaggtacttcttttaggtgctctgttggtgtataaaactaaagctatgtttgttaccaagacaaagcattgtttgattgtacttgaaaaaaaaaaaa

SEQ ID NO: 97674 - DNA, 341 bp, Triticum aestivum
  unsure (1)..(341): unsure at all n locations
  Clone ID: PAT_TA_97674
ctcgaccgggaccgcgtccctccccaaacgacggcgatgatggagggcgccgcccagctcctggccgacggattcgccggctccccgctcctcggggccagcccctcccacggcaatgatggagggcgccgcccagctcccagccgatggattcgccggctccccgctcctcggggccagccctcccccgtgccgggtcgagcatcggttnggaggccttggggctgccgccggtgcgggatncccgcgccggccttnccggctggggaaccaaccggnggcaacaactttgccccttcgnccttgtnnttaacanacntttacngtttganacatatttt

SEQ ID NO: 97675 - DNA, 508 bp, Triticum aestivum
  unsure (1)..(508): unsure at all n locations
  Clone ID: PAT_TA_97675
cctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtgggacacatccgtcatcaaaggccctccctgcaagtttgttgaggctccacctccaaagactggggaagcatggtcacgcaaagtgtcactttggttgccattgacatctttaatgggaaagaacttnaaggaatcttccttcaatcccaanaatgtgactcccccatgtttaccgccaaaattatcaactgattgacataactgatgatggtattcaaccttcctaactgaaaaggggaacacnaaggatgaccgnantttcccactgangaagttctgctttggcanttnaanacggttttntnatggaaagactgtccttcgtgattccgccagggtgaaaaaaat

SEQ ID NO: 97676 - DNA, 464 bp, Triticum aestivum
  unsure (1)..(464): unsure at all n locations
  Clone ID: PAT_TA_97676
ccgcacccaatccctgtttgcagccgccgccgccgccgcctccgcctccgccggcggaatcgactctgtctgccgcaggaagaagataaaaaactggtggtctctttttttgtcggagcggggaagaattaaaatgaaggtgcggcaatccgtgaatgtggtgatgcaaaagtatggcagaagcacantttgtatacgtgantcgcatcaaggcggangnaaanccttcnaacgtttcaacgggggagnaanagcaccaacaaattcncannaaaaagagattttnaaataggcgcnacannaacagngtggccccaagtggggatnatnntcccggttcncccggganatccaatttcaaaaattcgggttaaaagggaaancnntttttgccttttaaaaaacaacaanggggttctaaantccccgccngatgaacggtccccctctggganaaattaacc

SEQ ID NO: 97677 - DNA, 515 bp, Triticum aestivum
  unsure (1)..(515): unsure at all n locations
  Clone ID: PAT_TA_97677
gcagcttgaaagcaagcaccggcagcatggagagcagtcgcatgccactgagtgccacccctcgcatgccatgcagcctccaaacccttgcgcgccgcaaccttctccgtgcccttcaccgccggaaggacgcaaggcagccacgccatctctcaatctcatgcgaggcgaccggccgcggccgcgtcgaccgccgtgaggtgctcctcgggctcggcggcgccgcggctgccgggctgggcgacggaccaaggccgaagcgcgattcgccgcgcccatccangccccggactccgcaactgccaaacgccccgagtccccgaacacgccgcccggacacaaactgctgccccgacgccccggnaccggcatcaccgactttcgactgccgccgctccttcgccgttccgcctncggcggcagccaactgggtggacacggtactgggcaannaacaaaaggccttgcgtcaatgaacaactgccnccgatgaccccgcaatttcaanacatggn

SEQ ID NO: 97678 - DNA, 508 bp, Triticum aestivum
  unsure (1)..(508): unsure at all n locations
  Clone ID: PAT_TA_97678
ccttatcgtcttcttcctcgacctcctccaccgcctgagctcgccatggccacgacggcgttcggcgcgcgcacatcagcagcacggggggaagcagcagcagtaccagccgctgcggcgcattgaggggttgaccctgaggtccgcgctccgcagcgacccgcgcgtccccgcgctggccgcggccgcgctcctcgtccctctcggcgccgcgctgctgggcctctcgggcctcttcctgctggccacgctcgccggcgtcgcgctcgcggcgcctctcgtctgctcttcagtccggtgctcttgcccgctgngntngggtgccttgntcnccatggnggggctcgccgcnacgggngcgctcgcggtctcggggctctcggcgctctctgggtcgtggggtacttcaaaaggggctcgcgcanggcnatccggccggtttggcggaatggtggtgaaccctttggnnacgggaagcggnagggananaggggcccggctttngggn

SEQ ID NO: 97679 - DNA, 514 bp, Triticum aestivum
  unsure (1)..(514): unsure at all n locations
  Clone ID: PAT_TA_97679
aggagctcctgcagggaaagccatcattagccaccccgatgcaagaatgcacactgctgttagcagctgcagcagatcaagaaagaggagaaggataagaaagataacatcatcgccgtatcaccattaggattggctgatccggtggcggccatgtcgtacgatcaggtgctctctgttctcggaggtggcggcaaggcggcggcggcgagcgcgtggagcggccatggaagcaacatcacgaggcagatcgtcaagtgcaccaggtggcagctggaggagaccaccgacctcatcacctgcccttaccactactactgcgacagctcctacccgggcgactactcggctgccgtcggcgccctcgtcgccgttttagccctttattgcctcctgtccgcggcggcttcacggtggtagagatctcanggctggcggcggcagccggcgacggcggccgtggcgtctggcggataagcggaantacctgggccgtcggggccttcttatccgc

SEQ ID NO: 97680 - DNA, 522 bp, Triticum aestivum
  unsure (1)..(522): unsure at all n locations
  Clone ID: PAT_TA_97680
attaagttcgcgccaaattaggcaagctagcgcgcactgcacgtacgcgtgggcgcgctctgtctgctgccaaaaggcgtgcaaaccaaagcttgattagtagcggaggccggcgatgaggccacggccgccggctctcgtgagcagcctcctcctcctcctcctactattcgcggtgccgaggcatgccgccgcggcgggaggggacggcggtggcatggtgcgggtggacggcacgcggttcgtggcgggggacggcgaccggacggtgtacctcagcgggttcaacgcctactggctcatggagatggcctccgacccgtcccggcggggcggggtggtgtcggcgttccggcaagcggccgcgcacggcctcaacctcgcgcgcacctgggccttcagcnacggcggcgaccgaaccgctgcagtctcgccgggcgtctacacgaggacatgttcaagggctggactcgtcatcgccgangcgaggcggcacggatatactcctctctgctcacaaaa

SEQ ID NO: 97681 - DNA, 353 bp, Triticum aestivum
  unsure (1)..(353): unsure at all n locations
  Clone ID: PAT_TA_97681
ctcganttcaggngatnactcgnccaacgcatccctcgccagtcccaccgcacgnacctcgacggctcgacangtctctcctctctacaagtactcgcggtgccaanattanaggcattaaantattgcgcatcgccgagagaaaaaaaaggangaccgtcgtataggaagaggagcacnacgacccgagccgatgcctcgcgccatggcgggagtantancgtcnctcaacgncgcgtccctgtccgcgctgtctccccaggccncnggggcgaccngccgtcctgctgncgcatcctcgtccccgcggcggacccngngctctcgtcnntncctggttcgccgcggcgcat

SEQ ID NO: 97682 - DNA, 514 bp, Triticum aestivum
  unsure (1)..(514): unsure at all n locations
  Clone ID: PAT_TA_97682
gcgccccacgccggaggcctcgcgccgccgcccgttccccatcgccccacgccggaggcctcgcgccgccgcccgttccccagcgnccaacaccggaggcctcgcgcgacctcctccctctggcgtctcctccctccaagcgcctcctctcttcggcgagcagcacggcgcagactgcgtgaacagcgcgggcggcacggcggatttctcactccggcgagcagcgtggcttactccctccatcgcctcctcanancgacgagcancgcgggcggcacggngcggggcgggccggtnagcngcgcgggctcctcantcccggngagcaacggggccgcncggtggcgggctcctccctccggtggctcctcantccgggaagcaacgcgagcgngaactcctccttcngggtgggctcaatcaangtggctccctcccgggaaagggggtttcncggggnaggtcggggnntcaaaatttnttcccggnaaggccggaaggtnanaattcgntt

SEQ ID NO: 97683 - DNA, 536 bp, Triticum aestivum
  unsure (1)..(536): unsure at all n locations
  Clone ID: PAT_TA_97683
ctcctcccgccgccgccgcagccgccgcctgcctcgagccgccgtcgccatggggagaagacctgcgaggtgctatcggcagatcangaacaagccgtaccccaagtcaaggtactgccgtggtgtgcctgaccctaagatcaggatctangatgttggcatgaagaagaagggtgtcnacgagttctctcactgtgttcaccttgtctcatggganaaggagaatgtgtccantgangctcttgaggntgcccgtattgcttgcantaagtacatgaccaagcatgcatgaaaggatgccttccacctcagggtcagggttcacccgttccangtgctccgtatcaacaanatgctttcgtgtgccggggctgatangctccacactggtangaggggtgctttgggaagcgcagggagtctgtgcncgtnttgcnattgggcangtcacctttccgtgcggtgnaagcccacaatcatcaanccacggangccctcgncnngcaagttcacttcctggcggcanatataatgtn

SEQ ID NO: 97684 - DNA, 502 bp, Triticum aestivum
  unsure (1)..(502): unsure at all n locations
  Clone ID: PAT_TA_97684
acaacgccggcggcggcaaccccaacaacgccggcggccgcaagtacttcttccccaagtccaacaaggccaacaacaaggccaaggcgccgcgcaacaccacctccttcatcatccgggccaagcgggcggggggcatcgcctcgctcgtctccccctgccccgtcacccccgccgtgctccccaccccgcgcatctccccctcccgcgagggcctctccgacatggcgcagcagcagtggggcgtcgacggatacggctccatgaagggcctcatccgcctccgcgcctcctccccccgccaacccgacgccgaaggcgaagacgacgactccagcagcggcagcgactcnaggagcacgtcaagtcaacgccgctcaacacatntcagcgcttnagatgtctacccggcggatgcaacggaccggcggtactcttgaggacttacacatncacaagacttaatccagctcaggggngactaaatcaggnagtctctcat

SEQ ID NO: 97685 - DNA, 555 bp, Triticum aestivum
  unsure (1)..(555): unsure at all n locations
  Clone ID: PAT_TA_97685
acactatttaacaccaatccaccatgaagaccttcctcatctttgccctcctcgccgttgcggcgacaagtgccattgcacaaatggagactagccacatccctagcttggagaaaccattgcaacaacaaccattaccactacaacaaatattatggtaccaacaacaacaacccatccaacaacaaccacaaccatttccacaacagccaccatgttcacagcaacaacaaccaccattatcgcaagcaacaacaaccaacaatttcaacaacaacaaccaacaatttttgccggcaaacaaacagtnnnatctggtnaagcaacctatcctntcacaagcnaaaccatggcttggaatcctccaacaagcaattntncccggtggaatggcaacatgnctggctaaggtcncnatngttgngggaaaantantggccaggtntgcagnaaaaatnttgncggnagttgcggaaatcccngnaatcaagcncaatgnattcgttgcaanantcacccgnttggcaaaaggaanaaaaatgggcngggttngnc

SEQ ID NO: 97686 - DNA, 540 bp, Triticum aestivum
  unsure (1)..(540): unsure at all n locations
  Clone ID: PAT_TA_97686
acccccaatatttgcgccacaataggacccatttcccagagaacctccgccatggaaaaacatcttcaagttcaacaacaacaacagttgaagctaccgtcggggttcaggtttcacccgacggatgtggagatcattaccgcctacctagtacccaaggtgctaaagaaacccttcgacactagggaagttggggaggtggatctgaacaaacatgacccatgggaactccccgagatggcaaacatgggggagaaggagtggtacttcttctcccaaaaggaccacaaataccccactgggatacggaccaacagagccacaaccgccggctactgggaaggcactgggaaaagacaaggagttctccaaccgccaaccatgatctcatcggcacgaagaagacactatcctctacaagggcaaggcacacaagggggagaagacaactggatnatcatgatacagntccagagagnaagcanccgggaccaaccttccactgacatcacaacacatcacatttatnnatcttcaagg

SEQ ID NO: 97687 - DNA, 547 bp, Triticum aestivum
  unsure (1)..(547): unsure at all n locations
  Clone ID: PAT_TA_97687
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatgggcggtattggacaatgtggaagctgcctatgttcgggtgcactgacgccacacangtgatcacgaggtggaggaggtcaaagaaaggggtacctgacncgtattccgcatcatccggttcacaacatgcgtaagtgcattggtcangntcatgcctnaaancacgggctgcaaggatccggaag

SEQ ID NO: 97688 - DNA, 255 bp, Triticum aestivum
  unsure (1)..(255): unsure at all n locations
  Clone ID: PAT_TA_97688
gccggttccatccctggcggtgggttctgctccgcgatcnacttgctgctcgtaaccgctgttccttcctaaactcctccaccggtgagtgcatccaactggacctctcggagctccttgaccatgagctgctcgccgtcacccccgagggcctccttgtccngctcnacgacnagagccatgtccgcctgcttaaccngctnacgcgtnacctnaaanagctacggcggctnacaatncngcggcccncggngg

SEQ ID NO: 97689 - DNA, 420 bp, Triticum aestivum
  Clone ID: PAT_TA_97689
atcccctttgctctcctctcttcccccatctcgatctcctccatcttccccagcaagttcacaaatcctcccgtatctccatcttcccaagtcccatataaccccattggctgcaaatcccgagtaaccaagccggagacgccgcggggccgccgttgcaagaggaggacggggtgttgcaaggcgctgccgccgtctcaacaggcgccgccgccctctcaacaagggcacaactggggatgacgggctacaactgccggactgcaagggaggccgctatttctccctccatcttcctgtgatgtctgcatctagcttgcagccgggcagtctgttgtttcaagggccgccccggttttctttgggtcattctctgaaatcttgtgcaactttttggtcctattcctcactccaaaaaaa

SEQ ID NO: 97690 - DNA, 391 bp, Triticum aestivum
  unsure (1)..(391): unsure at all n locations
  Clone ID: PAT_TA_97690
gggatactagtactgtactttcctctcccttcntctccgtccgcagtctgctgcttccgggcgtcaatggggagctctgccattttaggagaagcggagatcccctgaattgggtgaccancattaaatttacgggtgtggctcnttggngtttggaaggcgacaattttttctagcgaagatcgccgtcggttaatttggccggntcttgattctttctgganctcgttttacntgctcggatcgatcaccggtgctcaatgacnncctctgtcccatttntctctananncttgtttggtcnnttgatcatggatcctttcacggcattgtaaagangatgattcgacgtcgncggntctgcancggatggctactcgccntcctcgtg

SEQ ID NO: 97691 - DNA, 546 bp, Triticum aestivum
  unsure (1)..(546): unsure at all n locations
  Clone ID: PAT_TA_97691
gccaccggtgactcgagacctccccatccccgacagcaaccaaatatttgagtggagtggagggaggagataaggggaggtagataggcgatgagtccagttgagattccccactggttcgatcccgttcccaactcagtatgtgtggatggaaagaggctgcggcaatctgcaatgcctgttgaccccatgtccaaggtgcttgacgacgataaccttctcatcgagattctcctgctaatccggtaccccaacaaccctcaatctgcgctggtccccgtcngcaaaactttggttctngtaangctcctgaccctggccttcctccggccgcttctgcgaacttcaaccggccccggctccttcggggtaanatttaaagacaaaggggaaaccgtcaacnctttgtgccgatgcnacggaagccccaaaanaatggtgnancatcaattnggcaactccggcctgatgccaaaaaacccagntgggtnaccgggaangcancactnacaaacanttacaatgnatgaaaaccggttatnattt

SEQ ID NO: 97692 - DNA, 532 bp, Triticum aestivum
  unsure (1)..(532): unsure at all n locations
  Clone ID: PAT_TA_97692
tcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaantgcctatgttcgggtgcaccgacncaacncaggtgttnacnaggtggnggaggtcaaaaagggtnccctgacncttatgtcccatcatcggnttcaaaacatgnccaagtgcaatgcgtcagntnaatcccttaaancacggggtggg

SEQ ID NO: 97693 - DNA, 415 bp, Triticum aestivum
  Clone ID: PAT_TA_97693
atcacctgcaagcaatggacgtttcgggcaccggagctggcgccaagggcaagaagggcgcggccgggcgcaaggccggcggccccaggaagaagtcggtgacgcggtccgtcaaggccgggctccagttccccgtcggccgcatcgggcgctacctcaagaagggccgctacgcccagcgcgtgggcaccggcgcccccgtctacctcgccgccgtcctcgagtacctcgccgccgagctgctggagctcgccggaaacgccgccaaggacaacaagaagagccgcattatcccgcgccacctgctgctcgccgtcaggaacgacgaggagctcggaaagctgctggcgggcgtcacatcgcgcacggcggtgtgatcccaaagatcaacccggtgctcctcccaagagcgccg

SEQ ID NO: 97694 - DNA, 396 bp, Triticum aestivum
  unsure (1)..(396): unsure at all n locations
  Clone ID: PAT_TA_97694
cccgccaaggccgccaagacctccgccaaggacgcgccagggaagaaggcgcccgccgccgccagcacccccaagaaggccgcccccaggaagccgcccaccaagcggtcggcgccggtgaagaaggccacgcccgcnaagaaggcccccgccaagaaggcnaanaattanancgtcnctgtcctcccgcaacaagtctcccgtagcagttttccccggtncggtgtcggtggnagtcnaggattcngtgttcnanacggtaaattttanatccgggttcggggtgcnntggttnaatccggngtacccttggaggtgtanctgtgggtgaaacgatgacnacnacnacggcggggcaanggttttcccgggctctncaatntacttnaaattttg

SEQ ID NO: 97695 - DNA, 539 bp, Triticum aestivum
  unsure (1)..(539): unsure at all n locations
  Clone ID: PAT_TA_97695
agtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggattcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggnaatgtgacaactggaaccggatggngttgctaacatcaatgttacngacngcaatatcccccttacnggacaaattcaattgttgggccgtgctgtgtctccacggtgacnctgatgattttggnanggtggcaatanctnncaagagcctggaaanctggngccctgttgctngcggaanaancggcc

SEQ ID NO: 97696 - DNA, 444 bp, Triticum aestivum
  unsure (1)..(444): unsure at all n locations
  Clone ID: PAT_TA_97696
ctcttttgatccgatcaatcaatgatagatcaantagcttatttcgcattgtcatacacaatgcantatagttagaacaacccttgtttattttatccacttcttagntaccttttatgttcangtatccatagaaaaggtcacaatacatcactttcatttatatcggntgtgcgcanngaatcatctggttacanttctgtnnattttccgctaccctatggtttgtagttagtaccgcgtattatagtccgtttaggccttggagttgcgtangatntgagagcnntaggttcagtgaaaangtcttagngtctangatggntttttttttgtngactcttttgatacgtntncatgggtggnntcacataatgacggctcggncatcctgggcnactacgaccannccnattagntgnatgcttttccatggctcctaaa

SEQ ID NO: 97697 - DNA, 519 bp, Triticum aestivum
  unsure (1)..(519): unsure at all n locations
  Clone ID: PAT_TA_97697
gccaatctcgcctccgatcgaccccaggctcgtcgaatcctcctcccccaccgcctcaagatgcagatcttcgtgaagaccctcacaggcaagaccattacccttgaggttgagagctccgacaccattgacaatgtcaaggccaagatccaggacaaggagggcattcctccggaccagcagcgtctcatcttcgctggcaagcagctggaggatggtcgcaccctcgctgactacaacatccagaaggagtccacccttcaccttgtcctccgccttcggggaggcatgcagatcttcgtcaagaccctcaccggcaagaccatcacgcttgaggtggagtcatctgacacatcgacaatgtcaagggcaagattcaagacaaggagggatcccccggacaagcaacgccttatctttgctggcaagcaactggaggatggtcgcaccttgctgactanaaatcaaaaggggtcaacccttaactttgcccccgttnttcgggangaatgaaatttt

SEQ ID NO: 97698 - DNA, 192 bp, Triticum aestivum
  unsure (1)..(192): unsure at all n locations
  Clone ID: PAT_TA_97698
gccanaccatctttagcttacaggcgacgtgacagccatggacatggtgcccgcttcagcggagccgctcctccacccggagnagtgcnaanttcgtcaatcagncnaccgnatntggggggtacttgtggcggaagccctgctcctcatgctgctggtcaccgtnggccctcncngtcnaatgtttttcgg

SEQ ID NO: 97699 - DNA, 568 bp, Triticum aestivum
  unsure (1)..(568): unsure at all n locations
  Clone ID: PAT_TA_97699
agaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccaagcaaccacaacaaccatttccccaagactcaacaaccccaacaaccatttccccaacaaccacaacaaccattcccccaagactcaacaacccaacaaccatttcccagtcaagcaacacaacaacttttcccaagccaacaacaatgcgcagcccaacaacgcaacatcatcccccacaaaacggcatcatcaacatctctaaacaacagtganccn

SEQ ID NO: 97700 - DNA, 539 bp, Triticum aestivum
  unsure (1)..(539): unsure at all n locations
  Clone ID: PAT_TA_97700
gccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaattcgagaccaccaagtactactgcaccgtcattgatgccctgggcaccgttgacttcaacaaagaacatgattacnggtactcccaagctgactgtgctgtctcancattgacccaacactggtgtttngagntggtnctcccaaggatggcaaaccgtttanannctccttgctttacccttggngttaacaaatatttgcnctgcaacaaatgntgcacaccctaattcccnaaggtcctatgaggaatgtcaagaatcct

SEQ ID NO: 97701 - DNA, 566 bp, Triticum aestivum
  unsure (1)..(566): unsure at all n locations
  Clone ID: PAT_TA_97701
acaacctttaccccagccccaacaaccgcaacaaccattcccccagcaacaacaaccattgattcagccatacctacaacaacagatgaacccctgcaagaattacctcttgcagcaatgcaaccctgtgtcattggtgtcatccctcgtgtcaatgatcttgccacgaagtgattgcaaggtgatgcggcaacaatgttgccaacaactagcacagattcctcaagcagctccagtgcgcagccatccatggcgtcgtgcattccatcatcatgcagcaagaacaacaacaacaacaacaacaacaacaaggcatacagttatgcggcactatttcagtcgtccaaggtcaaggcatcatcccaacctcaaacaaccagtcaattggaggtgatcaagncattgggattggggaatccttccaacaagtgcaacgtgtttgttcaactgatgtccacaacaaagnacatttgcaacatatccccgacattgggggcaatgnaaatgcagcgtttgctatagnnnatggtcaaccttgctaagttatgcacaacggtgtacgatna

SEQ ID NO: 97702 - DNA, 520 bp, Triticum aestivum
  unsure (1)..(520): unsure at all n locations
  Clone ID: PAT_TA_97702
gtagagcgcatcatttaagccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcaagccacaaccatttncgaccacaacaaccatttcacaaccgcaaccacagttatccgcaaccacaagaacnattcacaagcagcaanaacaacnacaacaacaacaacaanccttcaacaaatttgcaacaacaacggatccaaggcanggtgttgtattgcagnnacacaacattacgncnagggaatacaantttgcac

SEQ ID NO: 97703 - DNA, 487 bp, Triticum aestivum
  unsure (1)..(487): unsure at all n locations
  Clone ID: PAT_TA_97703
agtccatctacggcgagaagttcgccgacgagaagttcgtccacaagcacaccaagcccgggatcctctccatggccaacgccgggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaggtcgtcatcgccgactgcggccaagtctaaattcgcccgcccgccggtcncgttctcctcaccgcccttttntcccttncntgtcntccatttnaataagaagcccgtgtcctgtcttccctggccgtccataattccntggttggttaagangntttaagggcccnttngccctgttttgcttccggggcttngtaattccgggnccggggggancttaccgtttgaaganatgatccccatgattt

SEQ ID NO: 97704 - DNA, 568 bp, Triticum aestivum
  unsure (1)..(568): unsure at all n locations
  Clone ID: PAT_TA_97704
ccacaacaaccatttccccagcaaccacaacaacaatttccccagccccaacaaccacaacaaccatttccccagccccaacaaccccaactaccatttccgcaacaaccacaacaaccattcccccagcctcaacaaccccaacaaccatttccccagttacagcaaccacaacaacctttaccccagccccaacaaccgcaacaaccattcccccagcaacaacaaccattgattcagccatacctacaacaacagatgaaccctgcaagattacctcttgcagcaatgcaacctgtgtcattgggtgtcatccctcgtgtcaagatcttgccacgaatgatgcaaggtgatgcggnaacaatgttgccaacaacttanacagntccctcaanaagtcccagngcgcagcatccaaggggttcgtgcattcatcatcangcagcaagacaacaacaacaacaacaacaacaacaaggatacagtttagggggcatattnantcgtccaangncagggatatccaactccaacaaccagtcaatggggggggtcaggcatgggatgg

SEQ ID NO: 97705 - DNA, 220 bp, Triticum aestivum
  Clone ID: PAT_TA_97705
aatcactccatataagttgcagttgaagtgtcttcagcgggaatttgaggaggtcatgaatactgaggaagggaaagatatctacataaacacagtagatgcttttcaaggccaggagcgtgatgtgattatcatgtcatgcgtgcgtgcttcaaaccacggcgtgggttttgttgcagatatacggcgcatgaatgttgctctaaccccaagggggggg

SEQ ID NO: 97706 - DNA, 548 bp, Triticum aestivum
  unsure (1)..(548): unsure at all n locations
  Clone ID: PAT_TA_97706
ccaggggctgaccaccgccctggtcccttgtctcagccggcgcgccgccgaacgcctccagccccatcctactccgtcccccatccacccgaagaggctctccactccgccgccaggagaacttctgctgcccctgccgctacaaatcaggggagagaaccaccagcttgccactatagtcactgaaggtacttctgaaggtacttctgcaagctagccatccgagcctcaatccccccatccgccggacaagcttctacacccatccgagttgccccaccgcaagctagccactgaagcataacagcggtcggagagaaaggaggagtggcgccaccgggtgactccacacctctccgtccccgacaacaaccaaatatttgatgggttggagggaggagagcgggtgctgagataagaggagtagatagtgatgaatcagtttagattcccacgggtcaatcccgttcccaatcantgtgttggtggaaagagggggggccggtaccaatcgcctatatgancgtataccgcgctcacgggcgtct

SEQ ID NO: 97707 - DNA, 520 bp, Triticum aestivum
  unsure (1)..(520): unsure at all n locations
  Clone ID: PAT_TA_97707
gagcacaagaatcaaatccaagtaagtagtacctaacgcanatccaccatgaagaccttactcatcgtgacaatccttgcgatggcaacaaccatcgccaccgccaatatgcaagtcgaccccggntaccaagtacaatggccacaacaacaaccattcccccagccccaacaaccattctgccagcaaccacaacaaactattccccaaccccatcaaacgttccaccatcaaccacagcaaacatacccccatcanaccacancaacaatttccccaggacccagcaaccacaacaaccatttccccaagccccaacacacattcccccaacaaaccccaactaccatttccccaacaaccccaacaaccattcncncaagctcaacaaccccaacaanatttccccagtcacagcaaccacaacacttttccccagcccaacaacattcctgcaccccaacatccgcacatcattccccaagcaacacanccgttgattcagtactctacaacaacn

SEQ ID NO: 97708 - DNA, 517 bp, Triticum aestivum
  unsure (1)..(517): unsure at all n locations
  Clone ID: PAT_TA_97708
gccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagcacaaccatttcgaccacaacaaccatatccacaaccgcaaccacagtattcgcaaccacaacaaccatttcacagcagcagcagcagcagaacaacaacaacacacacaacacacancaagnatcctncaanattttggcaaaaaacngtcccagganggtttntttgcagnacaaacatgngnanggaaatacaagttggcacaagtctncca

SEQ ID NO: 97709 - DNA, 522 bp, Triticum aestivum
  unsure (1)..(522): unsure at all n locations
  Clone ID: PAT_TA_97709
ctccactcctctctctttcccttttcctctgcctcgtgctctcctttcctcgccgccgccaccccaacctaggcggctcctctcctcgtcgaaccagcagcctcctctccatcttcacgcgcagcctccttcccaccgggcttcgcctcttcgggcggcgggacgcagtggctctattgatggcagatggggcgacaacggcgacgctcctcgtcgcccatggcggtcggcggcgctctggccgtggaggcctgctcctcatgctcctcctctacccgctccacctctccgcggccgcgcccgagtccgagtgcgccaagttcgccggcccgcgcgcgcacctgcgctggctccgcttcatccggcccgtgccgcgctgcgttcgccgcgtcgcctcctcctgcgctagccggctccgccgccccgacacgcccctgcgcatgccgctgcaanaccccgcgcgatngtcggtcgctccggcggctcgcctctgccggggcgggtgtctctcctcgcgcgccc

SEQ ID NO: 97710 - DNA, 533 bp, Triticum aestivum
  unsure (1)..(533): unsure at all n locations
  Clone ID: PAT_TA_97710
ggcagccgaagccaagggggaaagaggcagcagcagcaggactgatccaaaggggtcgaaggaagcagaggccacatcaacagaacagagggcatgtgacagaaggctgcgaccaaggactagagttggcaaaacacccatcaccaaggcggcgaacagcagcggcagctccgagtcggaggagatggacgtcaacaccgtcggcgtcgacgcgccgccgtcgcagttcgtcgtcatgctcaaggaatgccacttttgtcaccaagaacgggcagtacctgaacgtgccacgggattcagcgtggcgcatcgnaccccggagaggaagaaaggtgctgctgncggnatggggggcgantccgttggacggttgagcctggaacacttccacattgtgcgtgggcaagacccgcactccttcccggtacgggtggcaccattctgcgtccacaaccactccgcgtcngcgaacatcttcttcccagcgttggcaaagcgcggcggcacgccattnctcaagtggaggtcccaag

SEQ ID NO: 97711 - DNA, 299 bp, Triticum aestivum
  unsure (1)..(299): unsure at all n locations
  Clone ID: PAT_TA_97711
ctcaantggngaacaaacattatctaacacaaatcaaccatgangaaattcctcgtccttgccctcattgntgtcgcggcgaccaccanggccgccgaaccctttactgcattccgtnctgcttgggagccgcaccatccatcatctccagnncagcaantanctccacagccacanaacaaccagttccacatcanaagttgaccccatgcatggatgccctcctacaacagtgtnccccanttgccganatgtcgntcctccggtcacangtggtgcnacatagnagntgcttggna

SEQ ID NO: 97712 - DNA, 504 bp, Triticum aestivum
  unsure (1)..(504): unsure at all n locations
  Clone ID: PAT_TA_97712
gaatgaagaagttcttctatgaagacaaagatttgatttgagaaaattagtttcgtgaagagaagataaagagagttgtattgggtagtccatgagaagattaaatgaagcgaagttcatttcaagtacttttcagacttttcaaacattgaggaacttgaagcgaatgattttacgaagatgctctttatgaggatcaccgtacttagtcattacacaagaaatttgtacaagaaacttggatactagggcctgggacatatagctgtgttttgcaacacttgcttcatgtttgatgggaaaagtgtgtaagntggttgactgtgtccgttcaagaaccataganggnaaggngcantttaaccngtgaatgggtacatgagaggccacacaccctatgaatacttcatgccncttcctggncggttancccattatttcatttacctactttgtctaatgtatccttatcacanggagccnanggttgcattgtggagttgn

SEQ ID NO: 97713 - DNA, 476 bp, Triticum aestivum
  unsure (1)..(476): unsure at all n locations
  Clone ID: PAT_TA_97713
ccaaccccaacaaccagntcaattggaggngatcangncattggtgttgcaaantcttccaaccatgtgcaacgtgtatgtcccacntgagtgctccancatcaaggcaccattttccagngtagtcgccggnattggtggccaatgaaaaatgcaagagncatactaataggtagatggatcatcgntgcttanntgatttacccatcgatgtaacgatgatagantaaactggcgtgcaccatcatgtgtgaccccgaccagtgcaanttcaagcttgggaataaangacaacgaaagtcangtttgcgaaaaaaaaacaaaataaaaatttcctaagcaaacacaacaaaaanttccccaagccccaacaaccacaacaancatttcnccagcccaacangcccaactaccatttccgcancaaccacancaaccattccccagcctcaagaacccaacanccattccccagt

SEQ ID NO: 97714 - DNA, 539 bp, Triticum aestivum
  unsure (1)..(539): unsure at all n locations
  Clone ID: PAT_TA_97714
ggctgctggccttgttgcccttgtcctggatgctgaccttgttgcccttgtcctggttgctgcccttgtgctggttgttgcaattgtcctggctgctgcccttgtcctggatgctgcggagaanttgggtantaccctgattgcccttgtcctacactgctgcagagaagttgggtagtaccctgnttgcccttgtcccgantgttgcananaanttgggtaannacccttgntgtccttgtccgaactgctnaccttgttgcccttgtccnggttgttgcccttgtcctggactgttgaccttgtngtccttgtcctggatgttgcccttgtcctggctgttgaccttgttgcncttgtcctgtntgcagcccttgttgccttgtgcnggntgttgcaattgacctgnctgcagntgcgaataattgggtaataccctggttgcncntgatctgctgatgacattnntgcccttgtcctggtgcngccttagctggcnttcaaatgcctgactgcngngagaattgggaacaccttnt

SEQ ID NO: 97715 - DNA, 401 bp, Triticum aestivum
  unsure (1)..(401): unsure at all n locations
  Clone ID: PAT_TA_97715
atccgatcccgcctcgccgcgctccgcccggacggccccatcgcgcggaggttcttggctgatctgcccaccgtcctggtagtcggcgactcggtgttcgtccatggtggccttcttgaggccaatgtcgagtatggcctggagcggatcaatgcggaggtcagcgactggatccggggtgagcgcggagacaatgccagggcgccagagtatgtgtgcggccgagacgctgtagtgtggctcaggaggttctctgaaggcttcaattgcgactgccagaggcttcagggcattcttgggatgatccctggagcaaagaggatggtaatggggcacacgatacagantgagggaaccagtgnattttgtggggcaaagnccntcagggngnntttgttttc

SEQ ID NO: 97716 - DNA, 462 bp, Triticum aestivum
  unsure (1)..(462): unsure at all n locations
  Clone ID: PAT_TA_97716
ttcaaacccgaccgaaaagaccccttctccccctcatcggcctcaccaccgaacgcgaagcaaaccggcgtcgagtccgccctcgccggcccactgttgataaccaatctgtccctctgaccagtcggccccacacctgcccgtgccaagcttaactgcgaccgctgtcttcaagcccacacaaatcaacaacacacactcccactcccacgctgacacctacctaggtgccgcgccgccgggaccccagcctcgccgtctccggcggcgtgctcccagatctcgactcgacggtccgtctctgctccgcgcggaatcgactgacgggggcgggaggccagcgtcgtccgtagctgattcgtgatgggcggcagcagcaccagcaccttcgtcatcangtggataaacttcctcacatgatactggngatacttgtggtggtttgggttcngatgaccccca

SEQ ID NO: 97717 - DNA, 281 bp, Triticum aestivum
  Clone ID: PAT_TA_97717
ggtcgatgaacgatctttggcgccatattaccttttatgacatcttgcatctcaaggggaacaatgcaaggaggccgcatcattctatcgagtctatcgatgaatgaataagagagcagagtatcttggggcacatcttgtatgggggtgcttgttttgggcacaagcgatgtatgatactgatttgggttggctagatgaatgacttattcttatgtgaacccatgtaacgaactcaatatagggtacaattgcatgttggtggacacaaaaaaaaaaaa

SEQ ID NO: 97718 - DNA, 563 bp, Triticum aestivum
  unsure (1)..(563): unsure at all n locations
  Clone ID: PAT_TA_97718
gagaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttcaaccaacctcagcagcagcaacaacaagtcaacaacaacaacagggtctgggttctagccagcacaacaacaaacacaactggatanggttggattgcngtgatanggactgggtgatcagacatcccggaattcgactgcatgtcaca

SEQ ID NO: 97719 - DNA, 565 bp, Triticum aestivum
  unsure (1)..(565): unsure at all n locations
  Clone ID: PAT_TA_97719
ctccccagtccctgccaccccaccccaccgcaccaacccgccccgcccccatccgccgcgcggcgagcgaccctagttaaccgcagctccagcagcggcaaacgggctagctccctccctcccctcccgcggacgccacccgagagcagcagccccaccgtctctctctccccgacgcgcgcgcgggccggcgaatgcataggaggganggcgggggagagatggggtccaagaccaaggggtgctgcgggtggctgatcgtggcgctggtgctggcgctggtggccacggcggccgtggtggccatcatgaagcgcaagccgggggaggcggangggggccggagccgcccgcccaaagccgctccccgtcccgggcccgcccggggacatcgactccaagtacggcaacgcgctcgggtcgcgctccaattcttcaagtcaaaaaggccggaantggtggacaacagttcgtggcaagcgntctcgctaacaatggaaagancaaactggttntccaangggtgtngacccgggatnatatgaantcacttccatggctnacg

SEQ ID NO: 97720 - DNA, 571 bp, Triticum aestivum
  unsure (1)..(571): unsure at all n locations
  Clone ID: PAT_TA_97720
gcactgtggagaagatctcaaggtatttccatggagggtgatgaagagcttctggcacaaacagaggttaaagtagaaccaaaaagggatgagtggatgacaacactacctccagaaaggaaacctggtggtatgactatgcaatcaaccacttttagccggggcccaaaggaaggtagaggtgatactagtgtttggacagacacccctttggacagggcccagaaagcaaagatgaattatttggaagcatacaatgaagctactgcactagcttcaaatgaagaggataagaaaagggctagtgcggatgcagaattggtggacaaatacaataaagcaaaacgtcaaaaacattggtgcagaagtatcaagaagaggttgctagcaaatccaaagaaaaatccaaggaactgaaggaagtgaacaacagccggagaaggaagactgggtggtcaacatccatggaancatgggacctttaaaagatctgacactggaaggaaactgtaattttgatcagaagcatactaagaacttactcaaggttctctggaanttcaaagaactc

SEQ ID NO: 97721 - DNA, 568 bp, Triticum aestivum
  unsure (1)..(568): unsure at all n locations
  Clone ID: PAT_TA_97721
gcgtagctcacttcagtccagtcggcatggcggctccgaggggcgcggcactggtgctggcgatggtgctcgcggcgatgctggtggcgccgccggcgacggtgcacgccatatcctgctccacggtgtacagcacgctgatgccgtgcctgcagtacgtgcagcagggcgggtcgccggcccggggctgctgcaccggcatccagaacctgctggccgaggccaacaacagccccgaccgccgcaccatctgcggctgcctgaagaacgtcgccaacggcgcctccggcgggccctacatcacccgcgccgccgcgctcccctcaaagtgcaacttcgcctcccctacaagatnaagcccaagcgtcnacgcaactcgntcaactgaacgaactgaacgccctggccntgtgtcnntcaacntanttgccttgtaaggannccatntctggagaataaatgctgctacaagtactgaaacttactaggctttggcggcaatnctttccttcnactagncctggngtgtggttagggccatcaantaatnncccaagcantcangggn

SEQ ID NO: 97722 - DNA, 502 bp, Triticum aestivum
  unsure (1)..(502): unsure at all n locations
  Clone ID: PAT_TA_97722
ggacagcgtcccggtggaaggcgtccaggtgcagttcagcagtcccagcagccagttcctatgatgccacagcagatgcttcctaggggacgtgtctatcgttatcctcctggtaggggtattcctgatgttcctatacctggggttgctggaggtatgttttctgttccatatgatgtgggtgggatgccgctgcgtgatgcatcaatctcccagcaaatacctgttggggctctggcaacggctctggctaatgcttctccagagcagcaaaggacgatgctgggtgagaatctctacccccttgtggaacagttagagcctgataatgctgccaaagtgacaggcatgcttcttgagatggaccaaactgaattctgcatttgcctgagtcgccaaaaaccctgaaagcaaaggtggttaagnaaatgncctcctaaggatttgccaacaacaagctggcggtacggctgatnaactggnttcctaaccctaaaganac

SEQ ID NO: 97723 - DNA, 522 bp, Triticum aestivum
  unsure (1)..(522): unsure at all n locations
  Clone ID: PAT_TA_97723
gtgcagcggtaatttcatatttttgatgtgttctgtagcggtaatttcttcatattttgatgcatggattcgtaatttattatatgcttgattatgtacttctatcaacttctatagtatcagtcttacactttataggtggatctgcgagcagacattataatatcgattgtccccgctttgcgcagcacgcgatataataatcctcgctccagcgcgtgctgactaatcgtggttaaatttcgattaattaaccatccgctcactcccgacaagatttttctccctggagatatatatttcttgtggggaacgagtgggtggggatgcagatctgcggggatggttgacggttgggcagtaaatcagaagtgtttttttgttctacttangaaaaaaaaactagaagtgatttgttcctggtgagaagtgaagtccccgggcccaacaaagcccagcaacgacacgctgcggtgcaaggatagtagggtaagctgactgacgcatgaagaagangacaag

SEQ ID NO: 97724 - DNA, 544 bp, Triticum aestivum
  unsure (1)..(544): unsure at all n locations
  Clone ID: PAT_TA_97724
gcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcancaccgagtacatgacctacatgttcaagtacgacaccgttcacggncactggaagcacagtgacatcaagctcaaggacgacaagactctgctctttggcgagaagccagttaccgtcttcggggtcaaggaaccctgaggaaattccntggggtganggtgggtgccgattacgttgtggagtccaccggtgtcttcactgacaaggacaaggccgctgctcacttnaagggtgggtgccaagaangtggtcatctctgccccaagcaaagatgcccctatgtttgtggttggtgtcaacgangacaagtncacctcaaacgttnacattgtcccaaaatgctaactgcacaactaactgccttgctcccctaactaagatcattaatgacaactcggtatt

SEQ ID NO: 97725 - DNA, 568 bp, Triticum aestivum
  unsure (1)..(568): unsure at all n locations
  Clone ID: PAT_TA_97725
gctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggacctcccaggctgattgtgctgtgcttatcattgactccaccactggtggttttgaggctgggtatctccaaggatggccaagacccgtngagcacgctctccttgctttcactccttggtgtgaagcaaatgatctgctgctgcaacaagatggatgccaccaccccaaagtactcnaaaggccctttatgaagaaatttcaagggatncncttcatacctgaagaagntggttacaacctgacaagtncctttgttccaacccnggtccaagggtgacaacatgatntagagnccacaactttacgggaaaagggcccacctctccaaggggggcccgnaccaatccccctanatgatcctatangccgctcantggcgtcttttaaac

SEQ ID NO: 97726 - DNA, 571 bp, Triticum aestivum
  unsure (1)..(571): unsure at all n locations
  Clone ID: PAT_TA_97726
cccagctccaacagccattatcccagcaaccacaacaaacatttccccaacctcaacaaacattcccccatcaaccacaacaacaagttccccagcctcagcaaccacaacaaccatttctccagccccaacaaccattcccccaacaaccacaacaaccattcccccagactcaacaaccacaacaaccatttccccagcaaccacaacaaccatttccccagactcaacaaccccaacaaccatttccccaacaaccacaacaaccattcccccagactcaacaaccccaacaaccatttccccaagctccaagcaaccacaacaaccttttccccagccccaacaacaaattgcggcagccccaacaaccgcaacaatcattcccccaacaacaacggncattcattcaaccatctctacaacaacagttgaacccatgcaagaatatcctcttgcaacaatgcaaactgcgtcatggggtatccctctggtcaatatctggcacaaagcgattgcaagtgatgcggnaacaatgctgcaacaactagcacagatccncaacagtccg

SEQ ID NO: 97727 - DNA, 551 bp, Triticum aestivum
  unsure (1)..(551): unsure at all n locations
  Clone ID: PAT_TA_97727
accacatggccggactgcgccgtgaccgccggcgtcggcgaggagcccaaccctccctctactcctcccagccgcctggatcgactatgccgcgccatggacgagcgccaaggacgccgccgccatggacgagcgccaaggatgccgccgcctcgccgtcgcggctacgctgcccgcaacgacaattcttgcggccaccgatggaccggcgtcgcgccaatcgctcgccgccgcctcccagttcccgatggcgcggccacctatgctctgtcatcgcgccactcactcgtcgtcgccttttagaccccgaagaccgccgccgccgcctcccagaccccaaagaccgccgccgccgcctcccagacccgacgacttccgctgctgctcctagacatgatggcgccccgtcgccaatgacgagatcatcgtcgtattcatttcnatcgcatgctgcgtangtccaaggagtgatgcttttctgtttcaacaaaggngtnctttaaattaanggactttttngnccacgnatccataacttgaatcaatccgan

SEQ ID NO: 97728 - DNA, 431 bp, Triticum aestivum
  unsure (1)..(431): unsure at all n locations
  Clone ID: PAT_TA_97728
gccagaccacgcaataccttctcccattctccagcggttccgcatccctgcaacaccaacaggcccgcagcctcccggccgctgatcctccgtcatagtctttgacccctccccgcaccccgccagcgcgacacctgctgccccgctcgcacatgtcggcgttggtcagtgtctatctcgcttaatcccgcggcggagcttgccacatcgttgtcggtgccatggccatcttgcacatggagccacctctgccaacgtcaacgacgagcgcgaccccgagtactgagaggctatgcgagggcgattgagggcgaaganccaatttttncctttgggccacaaccttcgtctcgcacgcgacaactgcacatctcgcttgcacaagangacacttgttacaacctnagaggancccatattcnccgggggtc

SEQ ID NO: 97729 - DNA, 538 bp, Triticum aestivum
  unsure (1)..(538): unsure at all n locations
  Clone ID: PAT_TA_97729
caacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggtcagggttccatccaatctcaagcagcagcaaccccaacagttgggccaatgtgtttcccaaccccaacagcantcgcagcagcaactcgggcaacaacctcaacaacaacattggacagggtactttttgcaaccacaccagatactcagcttgaggngatgattccattgcgctccgttcctacaacgattgcctgtcaagtgccttgtntanaacacactatgtgcattcngggttggcccggattggggccacgaaaagn

SEQ ID NO: 97730 - DNA, 540 bp, Triticum aestivum
  unsure (1)..(540): unsure at all n locations
  Clone ID: PAT_TA_97730
ctcgtgccatttaagccaagaaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccacacaacagccatatccgcagccgcaaccatttccatcacaacaaacatatctgcagctgcaaccatttccgcagccgcaactaccatatccgcagccgcaactaccatatccgcagccgcaactaccatatccgcagccgcaaccatttcgaccacaacaaccatatccacatcgcaaccacagtattcgcaaccacaacaacaatttcgcagaacagcagcaacaacaacancancacanaaccncacacaacacacacacattctncaacaatttgcaacaacaacgatccagcagggagttgtatgcaacacacaca

SEQ ID NO: 97731 - DNA, 426 bp, Triticum aestivum
  unsure (1)..(426): unsure at all n locations
  Clone ID: PAT_TA_97731
catccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcanccatttccatcacaanaaccatatctgcagctgcaaccatttccgcagccgcaactaccatattcgcagccacaaccatttcgaccacancaaccatntccacaancgcaaccacagtattcgcangcacaacanccnattcacagcaagcagcagcagcagcatnaacancangcatcacntcctcagcnacagtacngcnaatccttcaaanagttttggaacaacnntgattccat

SEQ ID NO: 97732 - DNA, 521 bp, Triticum aestivum
  unsure (1)..(521): unsure at all n locations
  Clone ID: PAT_TA_97732
cccccaagcaccagaacctcctcaacatccccgcgcatcgacgacatggcccgcaccaagcagacggcgaggaagtccaccggcggcaaggcgccgaggaagcagctggcgaccaaggccgcccgcaagtcggccccggccaccggcggcgtgaagaagccccaccgcttccgccccggcaccgtcgcgctccgtgagatccgcaagtaccaagaagagcacggagctgctcatccgcaagctccccttccagcgcctcgtccgggagattcgcccaggacttcaagaccgactccgctccaatcctccgccgtctccgcctgcaggaggccgccgaggctactcgtgggctcttcgaggacacaaactctgcgccatccacgccaangcgtcacatcatgcccaaggaatccaactcgcccgccgcatccgtngcgaaanggctagctgctgctgcanccatatcatgctcgtgcaantcctgttattgggtgggaattattgcgtctgttagtnctgtg

SEQ ID NO: 97733 - DNA, 524 bp, Triticum aestivum
  unsure (1)..(524): unsure at all n locations
  Clone ID: PAT_TA_97733
gaccaggctgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaanganggaactgctgattcaactttcctgtacttgcacaatggctgaaaaaagncaaatgctaatcncactgtntgcnaaaacnangcggcctaataatttgcnttaacaanggtggcaatccaaaccccaagtttgggcnataacgtcaaangtttaatgccttgnaaactttccgnaaattggggaatnccttttaaggggaaccccaaattgggngttgntttgggaaaanccttgtnaacccgtttttcaaaaaaaaaaaa

SEQ ID NO: 97734 - DNA, 429 bp, Triticum aestivum
  unsure (1)..(429): unsure at all n locations
  Clone ID: PAT_TA_97734
ggattcccccatcccagcagtgcctcttctttgctgggaagccactgcacaatgaccgcaccctggagagctacatcagcggggatttgaacgtcatcgccattcaccttctgcatcggcgcgcgctgctgcatcgccggattgtggacagggtgcgcaggctgcggaacaagcaggaacttgggcacggctgtctgtaatgccgtgtgccggtgtggtccaatttgtgtcaatggagtctaagcgaagtcgaactgttagaagtctattataattctgtcagaatcacccacatgcattttgtgtcaatgcagctgactgttgtggctaacttaaggttgtccaaatgggctggttgtgttggctttaaatgggatggttggcttnccnggttggctgaacantgttgggcttaccaaaaaaaaaaaa

SEQ ID NO: 97735 - DNA, 376 bp, Triticum aestivum
  unsure (1)..(376): unsure at all n locations
  Clone ID: PAT_TA_97735
ctccactttcctctccatctcactcactctctccctccgccgccggcgcagcgtcctccccgcgactccgatggccagcaagtgggtcaggcccgaggtgtacccgctgttcgcggcgacgggcgtggccatcggcatctgcgcctttagcctccttcgcaacatcaccgggcaacccagaagtcagggtcaacaagatggggangggcagcgggagtgcttgagaaccatgaggagggnaggcgctacgccgagcacggcctcaangccnatttgcaggacaagacccccgaantatgcaagaatcanaanttcttaacaagccaaaattganncacttaanccggncggtgaccccaattannaanggttgtgg

SEQ ID NO: 97736 - DNA, 570 bp, Triticum aestivum
  unsure (1)..(570): unsure at all n locations
  Clone ID: PAT_TA_97736
gcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatattcgcagccacaaccatttcgaccacaacaaccatatccacaaccgcaaccacagtattcgcaaccacaagaaccaatttcacagcagcagcaacaacaacaacaacaacaacaaatccttcaacaaattttgcaacaacaactgattcatgcatggatgttgtattgcagcaacacaacatagcgcatggaagtcacaagtttgcaacaaagtactaacagctattgcaagaattgtgttgtagcactatggcagtncctgagcatcgagtgcaggcat

SEQ ID NO: 97737 - DNA, 546 bp, Triticum aestivum
  unsure (1)..(546): unsure at all n locations
  Clone ID: PAT_TA_97737
accttcttccagcacacccaacgcacccgcaaatcccccactctcccgaacaagcgatggcccccaaggcggagaagaagccggcggcgaagaagcccgcggaggaggagcccgcgacggagaaggcggccgagaaggccccggcggcgaagaagcccaaggcggagaagcggctgccggcgggcaagacggcgtccaaggaggccggcggcgaggcgaagacgaggggccgaaagaagggcagcaaggcgaagaagagcgtggagacctacaagatctacatcttcaaggtgctgaagcaggtgcaccccgacattggcatctcctccaaggccatgtccatcatgaactccttcatcaacgacatcttcgagaagctcgccgccgangccgccaagctcgcccgctacaacaagaagccaacatcacctcccgggagattcagactccgtccgcctcgtctccccggggagtcgcaaacacgccgtctctaaggcacaangcctcacaantcactctctaaattcatcncattgctgntcaacc

SEQ ID NO: 97738 - DNA, 477 bp, Triticum aestivum
  unsure (1)..(477): unsure at all n locations
  Clone ID: PAT_TA_97738
atggcatcttcactcagcttcatccttgctcttctcctcgcaatcgctgccaccgacgctttcactgtccacctactcaacaagtgcccctacacggtgtggccaagcacctacccggtccgcagcgggagcaagctcgacccgggtcaactggncgccattgaagtctccccgggcatggtgtctggatggatttgggggcgcaccggctgcaacttcgatgccancggtcccgggtcctgcaccangggcaaatgcggtggnatgctgtcctgtgccnccggttttaanccaccccngaaaatcccccaattanncctgggtaanggggggaaccctgaattntaangaaatccaatcccccaagggntnaaagtnccaaaaacntttgggcctttcggaaaaantgtnaantgggaaacntntccgggnataaancaaattncctncgncttaagggggccggggtttttaatg

SEQ ID NO: 97739 - DNA, 349 bp, Triticum aestivum
  unsure (1)..(349): unsure at all n locations
  Clone ID: PAT_TA_97739
gtgacatgcttggttgagtaccccctggaagattgtgtcctccccgtggatctgtctgtggccatcgtagaggagattgtggcccttccccaacgagcaagaacaatgtangcggtagcaggaggtangggtggatgcggggatggatgttgatggttgctcnaaggttgcggtgtggaaagccaagaagcacnaaatccaaaaccggtaggagtttaagtcctgttggccgcggtgggtccccaacttaagngaggtattttttcccgttggttnaantccggttggtnnaaccaaaatngcaatcccaaaaattttcnaggtgaccaanannttcctttaaccaaaa

SEQ ID NO: 97740 - DNA, 235 bp, Triticum aestivum
  unsure (1)..(235): unsure at all n locations
  Clone ID: PAT_TA_97740
gtcgcccanccccaccctctcatcctccctccctcccccgaccgattttgacgactcctttgacctctcgcgctgtccctcccccgccccgccccgcctgcgtcgccganccaagctccangcncccccgccccctggncggtggattcatggccaacagcaacctccccggcggattattaangagacgcaacngctgctcaacnaaaccaancgccggggaataaangccctc

SEQ ID NO: 97741 - DNA, 570 bp, Triticum aestivum
  unsure (1)..(570): unsure at all n locations
  Clone ID: PAT_TA_97741
gagggattcatggccggcgctggcggagatcgccgcgtcgcttctccttgcgcgtccctcgagctccctctatctcagaaaaaaaaacatttggcgggagtgaaacttcagctcaaaccgctccggcgtcgaacggctgcagcgtcggagctccagtgggaggaggcatgggtcaacaggaacgttccggcaagtggggaatggcggacggtgagctccgaggacatccggcgtgtgggaaacggtggacggaggcgcaggaccgacgcgtgctagctagctagccgcgtcctggccgcatgtgctagctagctagccagccgcgtcttggctaacagctgccacgtgcgtgctagctagctagccaccgtcatgaggctggcaggagccatggagtgcggtcacacgcactggacangagctcttggtgcagttgccatggcggcgatgaggaccaactgcaatttacattttaattttagggcgcttatgcaatttcatctcacccgaaaattgcggtacggctgttcntcggagcctccgctaaattgctagtggcatanattgcta

SEQ ID NO: 97742 - DNA, 349 bp, Triticum aestivum
  unsure (1)..(349): unsure at all n locations
  Clone ID: PAT_TA_97742
gttttttttttttgccggagaaacgcagtttattgcatgtcacaaacattgtccactggtacaaaacggacagacagctacagctccaagaaatgtcacanatcgggaccgatacanggctgagtacattccaaagggcaacactacatcacaaaattgtggnacaaggggccgccagccgtgaagcangncganatggaggagatcattttntgacgaaaagaacacttttaatctagcnagcttctccacnacggtacggcaactggttgatttcntgtccggtttgncggcaatccccagccaatngcaggancggntccngccctccttgtaagngcttgcggaa

SEQ ID NO: 97743 - DNA, 426 bp, Triticum aestivum
  unsure (1)..(426): unsure at all n locations
  Clone ID: PAT_TA_97743
ctcctagcaagctatatacctacatagtacagccatggcccccaccgtgatggcctcgtcggccacctccgtcgctcctttccanggggctcaagtccaccgccggcctccccgtcagccgccgctccaacggcgctagcctcggcagcgtcaagcaacggtggaaggatnaangtgcatgcaaggtgttggccatccgaaggggatcaaagaagtttcgagaacctgtcttaactggcaacggtcaacaacnganggcctcctcaaagcaaggtccaataactngattcgctccaaantgggtngccttgccccaagttcaaacaanggttngggttaaacttcccnntacnaaaaagnaaatccccnggggtnaaaaaatggccggttttggnaaanttggaaacccccanattncggggcact

SEQ ID NO: 97744 - DNA, 541 bp, Triticum aestivum
  unsure (1)..(541): unsure at all n locations
  Clone ID: PAT_TA_97744
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggaagggcgtcctcgatcagcaaggagtgctgctccggcgtgcangggctgaacggcctggcccgcagcagcccggaccgcaagatagcgtgcangtgcctcaagacctccgccaccaagcatcaanccatcaacatgggcaagnctccggcgttncccggcaantcggctcagcgtgccttcccatcagcattccacaaactgcaacaattcaactattcaatatatanccttcctactgcatgcatggacccctngcgtggacttaatctacttgatggagtgctcatacatgttgactacaaaaataaatgaantgct

SEQ ID NO: 97745 - DNA, 520 bp, Triticum aestivum
  unsure (1)..(520): unsure at all n locations
  Clone ID: PAT_TA_97745
gagagagagaggactagtctcgagttttttttttttttttttttttttttttttttttttttttttttttttttttttttttttttancancggccccggggtcnaaaacttgaaccccggctatgtgcattgacaaggaaaaaatgtcacgtaccatgattcaggaanaanaaanctgtaatgccanattgcaggcatgantancanaaaaatanaaatttccactgtanaggttttttcccaagaagggcattgcaaagcttcaaaaacaaattttacttattgaaaggctggctgcngagtcaangncccccccgacttcaaaaacaccanaccctttacngttgggccnccggnctttcttggaatccaaatacccctgagccctaacacagcgagataaatgataaactgaacggttccttggaggcatggcatccaagacaantattcccggggggntccanccacgcgaacncataaagacccanatacaacacatggggggtnatatnccaa

SEQ ID NO: 97746 - DNA, 522 bp, Triticum aestivum
  unsure (1)..(522): unsure at all n locations
  Clone ID: PAT_TA_97746
cccccaagcaccagaacctcctcaacatccccgcgcatcgacgacatggcccgcaccaagcagacggcgaggaagtccaccggcggcaaggcgccgaggaagcagctggcgaccaaggccgcccgcaagtcggccccggccaccggcggcgtgaagaagccccaccgcttccgccccggcaccgtcgcgctccgtgagatccgcaagtaccaagaagagcacggagctgctcatccgcaagctccccttccagcgcctcgtccgggagatcgcccaaggactcaaagaccgacctccgcttccagtcctccgccgtctccgccctgcaggaggccgccgaggctactcgtgggctcttcgaggacaccaactctgcncatccacgccaangcgtcaccatcatcccaaggacatccaactcgccgccgcatccgttgcgaaagggctangtgctgctgcaaccatatcatgcgtcgtgcantcctgttcatggtgggaattatttcgtctgttagttctgtt

SEQ ID NO: 97747 - DNA, 410 bp, Triticum aestivum
  unsure (1)..(410): unsure at all n locations
  Clone ID: PAT_TA_97747
gcgcagccacctcgctgttgcgccgccatcacccctgcaacggatcatcccgccctccacctctttttcgtcggggagacgacgaactcgtcctcgagcattgaccgcgcgcccgcgttcgtgggctgcatccacgggcgatcgatcaccgcctcatgtacgccgccgggcgtcggactaattttcataagcttcattcatatgtgacatcaggaagcttcaaaaaacaggagaagtgcaagaaaacgtcgccccaaacaaatcgcaacttgccaacctccgcaacaaccgtcaaaaccatgggtcacnggcgcctggtccgccgattcgnggttcttncctggggtgcatgcttcaacggcttgttgctgctccgnaaccctccgtccaaataatccgtatntcngttc

SEQ ID NO: 97748 - DNA, 253 bp, Triticum aestivum
  unsure (1)..(253): unsure at all n locations
  Clone ID: PAT_TA_97748
ccanccaggcacccagcccgagctgtaaagctccgncgaggtacanctanncggtgtgtgtgtcgtctgtgttcggccactccgggnagatgaagctcccgctgtccgtgggggcgcccgacgcggtgccagagctggacaanccgtcgctgccggcgacgtggctcatcctncangcgctcttctgcgccacctccatggncgtcgggttccgcttctcccgcctcgtcgtcttcctcctcttcctgcccac

SEQ ID NO: 97749 - DNA, 521 bp, Triticum aestivum
  unsure (1)..(521): unsure at all n locations
  Clone ID: PAT_TA_97749
gcaatactagttaacaccaatccaccatgaagaccttcctcatctttgctctccttgccattgcggcgacaagtgccattgcacaaatggagactagccgcgtccctggtttggagaaaccatggcagcaacaaccattaccaccacaacaacaaccaccatgttcacagcaacaacaaccatttccacagcaacaacaaccaattattatactgcaacaatcaccattttcgcagcaacaacaaccagttctgcagcaacagcaacagcaatagcaacagcaacagcaacagcaacagcaacagcaacaangaacaacaccaacagcaacagcaacagcaacagcaacagcaacagcaacaacaaaaacaacaacaacgacnaccacaacctcgtgccgaattcgatatcaagcttatcgataccgtcgaccgaaatttgaggagaangntttattaagtttcacaaacgttctcgttcaaagntctggnataaagtttccnggaacagctcacgaaatt

SEQ ID NO: 97750 - DNA, 497 bp, Triticum aestivum
  unsure (1)..(497): unsure at all n locations
  Clone ID: PAT_TA_97750
tggaacnttgncgcgccangnggtggcanacgctctanngccaatggntccccggaatgcaggaattccggttttttttttttgccgganaaacgnantttattgcatgtcacaaacattgctncactggnacaaaacggnnagacantctacagctccaacnaaatgtcanaaatcggnactgatacatggcntgagtagattccaaanggcaanantanatcacanacttgtggtanangggccgccacgccgtgagcagagaaatggtaggagatcatttacgacggaccagaacacntttatctannganacttcctccacacggtacggccacggttgatntcgtgtccgttggntgcaaatctcaggcaatgcaggaactgctgccgctcntcatttgtgaggcgactgctngcaagaagcaggagccggttcatgcntttccccnctcgttcntccatgcangtaanaggaatcaacttatnatcaatcc

SEQ ID NO: 97751 - DNA, 377 bp, Triticum aestivum
  unsure (1)..(377): unsure at all n locations
  Clone ID: PAT_TA_97751
ggaanggaacccaganatcggtnagggagaaaatggtgcgggtggcnaccttcttccggatgancttcggnncgttcctcntccggnagtcnatggacaaggtccacntctggntcgcnctccaccaaganganaancaagaaaggatggaaagggagatngatataaanaagatgcangcagacctaattgctcangcaaangagagtgaatcatgnntgtctttncgccaatggtttcaacnanttgctttgtcangtntttactttccaantgataanccttggctgatgtatgcttgncacctcnaacaaaccaagttgttagaactttgttgnatccaacaagcaangctcatgganggtaaaaaaaaaaaa

SEQ ID NO: 97752 - DNA, 538 bp, Triticum aestivum
  unsure (1)..(538): unsure at all n locations
  Clone ID: PAT_TA_97752
cgcaaatcactccaatccgacacatccaccatctaatcagccaccaaatcgaagctaactatgcatctcatcgcctagcagcaacacgccggaggcggaggggatcgaggaggaggcaggaccgccggatccatcgagctaccgcgcggcggatccagatccaccaccacccgcgggaggggtgatgaggagccgcgtcctcggagcanggcgccgccgcctgggcctgggccgcatctcagcggtcggttctacttctatctagggtttcaaccaacaaatcggcctccaaatccaggccatggagtcgccgccgcacaagctcaatgtcggccgggacgangaccgaatcaacgcgctcaacgacgaactcctcgtcggnatcctcgagcgcctcgacctgcgccaaggcggtccgcgccaattgantctcgtccccggtngggtcaactcccctaacgggtatngcgcctgcaactccaaggtccgtcactttcaaaggngccangccgctccaaggtcatggacgcnttnaagg

SEQ ID NO: 97753 - DNA, 429 bp, Triticum aestivum
  Clone ID: PAT_TA_97753
ccgcggtggccaccacaccacacttgccttgccttgctcccccacctccataccgatctcacccccaatggtggccacgcccacactctccccccagccctagatcccattcgtttgcgcatggcggagcacgccgcccgccacctccgccgccgcggccccgtcgccggctggtgctgctccttcgccggcgtcccgcccagccccgaccaccgcctcccccaccgcaccctctcccacgccgccgcgccgcaaggaccagcagcaggatctgtgtgcaccggcggcgagggcccgcggaagcagcaagctgccgccgaaatccccctcctccttccaagggtcgccctcctccaaagctggcgggcctcatcgactacccgcgccggattctctccccgggccgcgtctcccccatcgaccccgacg

SEQ ID NO: 97754 - DNA, 509 bp, Triticum aestivum
  unsure (1)..(509): unsure at all n locations
  Clone ID: PAT_TA_97754
gccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcatcttgtgtctgaatatccttggncaaggaaaactanaatcaatgatgtttaagccnttaattaactgaagttgtgaaacgctggnaaagacaatgttttgatat

SEQ ID NO: 97755 - DNA, 529 bp, Triticum aestivum
  unsure (1)..(529): unsure at all n locations
  Clone ID: PAT_TA_97755
gccctcctcagcctccaccgtcgaggtcgccagtgagtccctctttgacggtgaggtcgtcccctcctcgatcatcgagatcgcaccctacctccacgtcgccaacgaggtcgaggcaagcaacccacacgtcgcctacctatgtcgattctttgccttcaggatggccaacaacctcgaccccaccgctagcgcccgtggtgtccatgaattcaagaccgcactcctgcagaagcttgaaatggagaatgattccaccttgaagggaagggttgagcagagtgatgcacgcgaaatgcagagtttctaccagcactactacaagacatacatcacggcactccaaaatgctgcccgatacagcttaacttggctcaacctcaaaaaaggngtatccagacttcaagtgtgttgtttgggtgtttcacataanatccaagttgatcacgtgatccaaagcagctttgaatgccttantgacactaagggtctgcaangccaaaggacatcaaaagaagntgatcagntt

SEQ ID NO: 97756 - DNA, 519 bp, Triticum aestivum
  unsure (1)..(519): unsure at all n locations
  Clone ID: PAT_TA_97756
aagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcangggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaaagccctacgtgctcctacgtttggagattctaccaattccccctactaatccaaaaaattttccaaaggcccgcctcaagggaancaaanttgaaagagataagttgaacaatg

SEQ ID NO: 97757 - DNA, 209 bp, Triticum aestivum
  unsure (1)..(209): unsure at all n locations
  Clone ID: PAT_TA_97757
gttttttttttttgccggagaaacncagtttattgcatgtcanaaacattgtccactgggacaaaacggacanncanctacagntccaagaaatgtcacaaatcggcaccgntacatggctgantacattccaaanggcaacaatanatcacaaaattgtggtagaagggccggccagccgtgancatagaaatggnngagatcattta

SEQ ID NO: 97758 - DNA, 604 bp, Triticum aestivum
  unsure (1)..(604): unsure at all n locations
  Clone ID: PAT_TA_97758
attcaagagttatggggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaagggacgaatgctatcacatccgaagcctggtttgcnggggaaagacaagccatnggatnctggttaatnttagccttaatccaatttagaacctaatttgaaagaangggtttccgtttactaaacaatggtttaactttccaattggtagggtaaacgtantttgggtttcaaaaagccctacgtgctcctacgttttgggagggatctacgaaattcccccctacnttattcaaaaaacnttccaaagggcccgcctcaatggtatccaaagttnaaaaganataagttgaacaaantatggnccgcccttaatggggaagttccaataaacc

SEQ ID NO: 97759 - DNA, 530 bp, Triticum aestivum
  unsure (1)..(530): unsure at all n locations
  Clone ID: PAT_TA_97759
acctgaatattctttggacaatggtctattaaaacattaaggaagaatttgggtgggagccaatgcagggttacagactaagatcattgaggcactgcactcttctcctgtaggagggcattcgggtagcttggctacttatcagaaaatcaagaagctatttcattgggccagaatcaaaactgcagttaaggagtttgtgcaacaatgtcagatatgtcagcaagctaaacatgaaaactgcaaatatcctgggttgttggcacctttaccaatacctaggggcccttgggaggatatctccatggattttattgagggccttcccaagtccaatggatcctcttgcattctggtagttgtggacagatacactaagtacagtcactttataccccttaaacacccatacacggcggcagctcagattgctcatatctttctgcagcangtggtaaaactacatggtatgccctacaccattacgtcaagatagagacaagatctcaccagtaatttctggnaaagaa

SEQ ID NO: 97760 - DNA, 553 bp, Triticum aestivum
  unsure (1)..(553): unsure at all n locations
  Clone ID: PAT_TA_97760
ttttttttaaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtgggaagactcaacattcttcttgaaaacatctangtcatccccttcaagcttgggcagagaggttcttgatgtagcgcttcatgtgagagataaactgcttcttgtcaaaagcaaggttgctcctgaagacnggaaggtgtcaacaatgtcaaccancttcacgggctggtcatccgacaacctcatcatcaacaacaancctcaagcaagnggggntg

SEQ ID NO: 97761 - DNA, 554 bp, Triticum aestivum
  unsure (1)..(554): unsure at all n locations
  Clone ID: PAT_TA_97761
agaacaaacattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcagtcaagatgcgaggccatccacaacgttgtgcacgccattattttgcaacaacaacaacaattggtacaagctacttccacccaacctcaagcagcagcaacaacaaggtcaacaacaacaacanggtccggggttctagcaagccacaacaacaaacacaactgggtnaagggttggattgccgtgataagggacatnggtggntcnaancatcccgg

SEQ ID NO: 97762 - DNA, 515 bp, Triticum aestivum
  unsure (1)..(515): unsure at all n locations
  Clone ID: PAT_TA_97762
atacatcgcatttacaagtggataataccacgacaaatccacaaaggaaataatggaggtgcaacaaggatcaatcaatgcgtgagatcaagaagaataatgctgctcagatacagtcatacagatcatgcaacaatttttttggttcttctgcatccaactcttcagttgctgggaaaaaatattactttgtgcccctaacaatcatcaagacatacaagattaagctaggcatgccatagatatggaactaaaccccctttatggttataagaagatcaagaaagccataattatggcagttagttttcatcaatttcatcctgcaaatgttctggcaagatatcgacctagctacctacaacagtttactaggaaaataccgatggatcattaacatccaagtctgaaaaataagcacatacataattaacctgagtactgccaaagcagcctaaacagtaagtataaaataacataactaatgtcaaaggntgcctaagcagtctatagca

SEQ ID NO: 97763 - DNA, 502 bp, Triticum aestivum
  Clone ID: PAT_TA_97763
cgagtttttttttttttttttttttgttaagtacaaacatacttttgacatagcaatttgatttcgattcaatgaatagtagtcaccaggtgagtcgtgacatgagaagatagcacacaatcacatttcagagaacatctaccacacaatctgatgatgttgataagatgtaacaaggcgagtatgctcagagaacgtgggttgatggtatttctggagtaggacaacttttactgacccatccaatacgcctttccaccttgtcatatatcaccagtaaatcctgcattgagacatctccaattcgcatcatttggccttcaggaaactttgatccattaaggatgcccaagcatacattcccttgtgtcgtgtggacgaggtagttttcgggagggatatgcatgaccgccttgttgtcaaattccaacgagagtggcttgaatttccccttgattcctttaatgatttgattggcttactcccctttcaacaaacaagg

SEQ ID NO: 97764 - DNA, 192 bp, Triticum aestivum
  unsure (1)..(192): unsure at all n locations
  Clone ID: PAT_TA_97764
gcatccatctcctagcgctgaattccagagatctcacacctctctctcctccctctcccccgtccttcttcctcccctctctcctccgttttggtggcggggtggtgcaagttggtcgcagtggagttggcacagggcgttgcctttttgggcgcacaacaaaggcaggagggnaggagaattcncctgacg

SEQ ID NO: 97765 - DNA, 380 bp, Triticum aestivum
  unsure (1)..(380): unsure at all n locations
  Clone ID: PAT_TA_97765
ccgcagcagcagcagagagccagccgcccttcgctccccccagaggccagagacggacacgatggcggngcccacctcctccgcggcatccaccctcgcccccttctcccaccccaaaaccctagccgccgccgccgccgccgcatcctcctccgtcgccttctccccggncgcatcccaccccgcatgcgccctaacccgccgccgcgcggtcgccgccatggtcgcgggcccggncaanggcnggggccgccatgccgtcgctcnanttttnaancgccgtntttaaaaanggnaaanggcnccctcccccngggccacaagantnaattctnagggggggggngaaaactctttcccggtnggttccggggggggtt

SEQ ID NO: 97766 - DNA, 315 bp, Triticum aestivum
  unsure (1)..(315): unsure at all n locations
  Clone ID: PAT_TA_97766
gtgacctcctccccccgtgcggcgacgccgcgccgcaccggggcctccccgtcgggcatccctctcctcccatcgccgccgccgagggcatcgcaggctaagcctgcgggccacagcggcggcggcggcaatcttccttggccggcgatcggatctgggtggcggcgacctactccggccgattcaagggcggtggctcaggncngtggcgaacagngttgtcgtgctggcggcggcgactaagcgatcacntcggcngctatggtgtccgatctggatccctttcgggatctggttggngggtcctcnagncgt

SEQ ID NO: 97767 - DNA, 455 bp, Triticum aestivum
  unsure (1)..(455): unsure at all n locations
  Clone ID: PAT_TA_97767
acattatctaacacaaatcaaccatgaagaaattcctcgtccttgccctcattgttgtcgcggcgaccaccacggccgccgaaccctttactgcattccgtactgcttgggagccgcaccatccatcatctccagagcagcaaccaactccacagccacaagaacaaccagttccacatcaaaagttgaacccatgcagggatgccctcctacaacagtgtagcccagttgctgatatgtcgttcctccggtcacaggtgggtgcaacatagcagctgcttggtaatgtgggagcaagtgttgtcangcaactaaaagcgatncccaagnagtcaagatntgaggncatncaaaacgtcngtgcacgccatccnttttggaacancanccaacaattggtacaagggtatttncaaccaaccttangagcaaacaacaacaanggnccacaacaa

SEQ ID NO: 97768 - DNA, 462 bp, Triticum aestivum
  unsure (1)..(462): unsure at all n locations
  Clone ID: PAT_TA_97768
ccatttgttcatccatctatcttgcagcagctgaacccatgcaaggtattcctccagcagcaatgcagccctgtggcaatgccacaaagtcttgctaggtcgcaaatgttgcagcagagtagttgccatgtgatgcaacaacaatgttgccagcagttgccgcaaatccccgaacaatcccgctctgaggcaatccgtgccatcgtctactccatcatcctgcaagaacaacaacagggttttgtccaacctcaagcagcaacaaccccaacagtcgggccaaggtgtctcccaacaccaacagcaagtcgcagcagcaagcaagcaactcggacagtgttntttccaacaacctcaacaactacaacaattgggtcaagcagcctcaacaacaacagntaccacagggtatattcctgnagccacaccanatatctcaacntgaggggatnactttcantt

SEQ ID NO: 97769 - DNA, 454 bp, Triticum aestivum
  unsure (1)..(454): unsure at all n locations
  Clone ID: PAT_TA_97769
cagaggttccaaatctgggaacgcatggtcaatagtcatggtactgccatatgggtgctgcgaaagaccgctcgcatgcatagtgtgcttcagtatgctatgctgactatagtagggtactctgaggatggcgatgcgcttcttctatcagtgtccttcggtggtgtggccacctacagcttcatgcttcaacttgagtcaatggagtggacgaatcttaatcaaagatttttgcattgttcctatcatccgttcgcatacttctatactgcaggtactgtcagagcgtcaagtaccgctccagccattgagccaccacagcagcgaagtacaattccagccattgtgccaccanaacagtgaagtactggtccaaccattccacagctgcggggtaaaaccatatattgtcatgcatctcgtcaaccttcagtttccgtntgatctgcatatt

SEQ ID NO: 97770 - DNA, 463 bp, Triticum aestivum
  unsure (1)..(463): unsure at all n locations
  Clone ID: PAT_TA_97770
cctcccccctccacctcctccccagcgtcgcctcccgttcggaaccccaagctcccccgccgccggcgaaatggtgcgtcaccgccaccggcccgcgcctagccccacgccgttccaccgcgcttcgtcctcctggacggatcccccgcgcttcttcttttctgcggttttgatttggtgttcgaatctcgttctaagtgtatggatcgcgaatcttgcaggccccgaagcgaggcggcaaggccccggtgccggcgaagaagaaggcggcggacaaggtggtgaacccgctgttcgagaagaggccgaagcagttcggcatcggcggggcgctgccggcccaagaaggacctccaccggttcgtcaagtggcccaaggtctccgcattcaagngcagcgccgcatcctcaaagcancgccctcaaaggtgcccccggcgctccaacaagttcancccgcacc

SEQ ID NO: 97771 - DNA, 177 bp, Triticum aestivum
  unsure (1)..(177): unsure at all n locations
  Clone ID: PAT_TA_97771
ggacaagttggttccnttccctctgcatncatcaanccatcanccnccgtcgtcntcctcncccctccaatcccancccctctccgcncggnggncgtgtcnctttcncctctgctttcctcatctcntttcccatcgcanncgcaggggacccgatccaccctctctcncccctac

SEQ ID NO: 97772 - DNA, 483 bp, Triticum aestivum
  unsure (1)..(483): unsure at all n locations
  Clone ID: PAT_TA_97772
gacggaggcgaggcggttaccgacgccatcgccgagcttctcagccccgtgggcctgctcctcctccccgtgggcctcctcctcctcatccgcctcctctcctccgaccgcggngccgcggcgctcgccgacgtgttcgctttcggcggctcgcccgacgccgtgcaccgcgtcgggggttcccccattggtgtggctctcatgttgctcctcatcctcgccctcctctactaccgctccgcgctcttcggcggnggcggagacgacgacgagtaggcgcctgccagtaggtagttccctgatctcggggttgttttgctagtttccgtttcatgggctgggcttgggtgtaaaagtgcggtgtaaattaactggtaactactccccgtcttggtttgctctgcgttaaggctgaaggttctgtgctgcaaaaaaaaaaaaaaaaaaactccgagggggggggccgggtnaccaattccgccc

SEQ ID NO: 97773 - DNA, 394 bp, Triticum aestivum
  unsure (1)..(394): unsure at all n locations
  Clone ID: PAT_TA_97773
accacaacagccatatccgcagccgcaaccatttccatcaacaacaacaacaacaacaagaacaaaaacaacagttgcaacaacaacaacaacaacaacagcaactgcancaacaacancancaacancaacaacaaccgtcgagccaggtctccttccaacagcctcagcagcantatccatcangccaggtctccttccagccatctcagctaaacccacagggtcagggntctgtccaacctcaacaactgncccagttcgcggnaataaggaanctagcgctncagacgntacctgnaatgtgcaatgtcnacatccctccacattggtcngnccaccaantgcgccattttggntttcccnttncaactgggaagaggnaggacttcct

SEQ ID NO: 97774 - DNA, 446 bp, Triticum aestivum
  unsure (1)..(446): unsure at all n locations
  Clone ID: PAT_TA_97774
ccacatttgagctaagatgaggattgctctagtgacgctccttacccttgctatccttctagtaggatcagatgtggaagcagaacaacttcaatgtacgactgcagttatcaaacggcccggtgggtgttcaaacagtacttgtgagtatgattgcgaccaaaagcgcaagcccatctgtggtccacggtgctcttggaaggccaattgtgttggcgggagctgcaagtgcctggtgtgcaatgtgaaggaaacaacgatgctataactacctaacttaagattagttcatgtcaaagaaaataacaagcaatactgtaacatacagtatgggcaagcaatacttttgctggaaagtgatgtaacacaaagttcaagttgcaccttgaggtatatggagttacaaaatatgtgttgtgtttanactnnaacacgcnngntcatgg

SEQ ID NO: 97775 - DNA, 241 bp, Triticum aestivum
  unsure (1)..(241): unsure at all n locations
  Clone ID: PAT_TA_97775
aaccannccacacctctctctgcctgcccatttcctctctccctcttcctcccctcgccgtgggctccacccgtcagcctgccgcgtagtatagactagagagagagagcgacaagggcccgggngggtgtncaaacatntacttgngagtatgcttgcgagcaggtagcgcattggcnactctgtgagtctnanggtgctctnggntagtgncanttgngttgtgnncggacgctgtatc

SEQ ID NO: 97776 - DNA, 456 bp, Triticum aestivum
  unsure (1)..(456): unsure at all n locations
  Clone ID: PAT_TA_97776
gatcatcaatacatacatgctgcagtttcagatatacacatgtactccctccgtccgaagaaacttgacaaactttttcggacggaaggagtataaaactagtcttatcaggggtaaaacaactacacgtccactctactacaaagtggaaggaaggactagagacagcagattggaagaaagaaaaagcccagatgacggagcagagcaggcgaaagcgatggattgaaaaacgggctatctgcgccgtggtgacctggatcagccggcgaggcgcttcttcttggcctcggcctcgtcggtggcctccacctgctccttggccgcgcgcaagtccgcctccgccgcctcctgctcgctcctcgccgtcgccttccggccaaaacgnccaacaagctgggcttcaaggtgctggccccactccctgcaacgggacgcccccgaaagaaagccaag

SEQ ID NO: 97777 - DNA, 484 bp, Triticum aestivum
  unsure (1)..(484): unsure at all n locations
  Clone ID: PAT_TA_97777
gaangccgancgtganaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctggtatctccaaggatggccagacccgtgagcacgccctccttgctttcactcttggcgtgaancagatgatctgctgctgcaacaagatggatgccancactcctaagtactcgaaggctcgttatgaggaaattgtcaaggaagtctcttcgtacttgaaagaaggttggctacaaccctgacaaagttcccttcgtccccatctctgggtttgaggggtgncaacatgattganangtccaacaaccttnantgggtaanaaaggggcctncccttcttgaggctcctgaccaan

SEQ ID NO: 97778 - DNA, 480 bp, Triticum aestivum
  unsure (1)..(480): unsure at all n locations
  Clone ID: PAT_TA_97778
gaatttacnttcatggaagaagangagtcntcaantntgcacttcccagcaaatgatccanccattgannagttantttgccacaagtgcaaggatcctcaacaaccacctgatctcaaatgttcttcctgtggcctgcgtgtacaccatcagtgctcaccttggcaggaaagtggacagcctggtgacagtgccaattggnggtgtggtacttgtcgggagtggcaatgatnagctttcaacttcattacattggttacccgagtgcccggagcgantgctgccgattgttatggcaggtggaatgtatatcccatgaagggtgctggggaatatcaatggaatttttttcagtctagctgttggnatgcggtgatgggcgatcctgtggaaatgaaatcggcgttggntactgggacaaactcctaatcatcaannaagctacactagttataccgtctgtgcgaaagttgacatttt

SEQ ID NO: 97779 - DNA, 480 bp, Triticum aestivum
  unsure (1)..(480): unsure at all n locations
  Clone ID: PAT_TA_97779
gctgaggatacatataatttcctgattaattggttcaagaggtttccgcagtacaaggaccgggaattctatatctcaggagagagctatgcaggtcattatgtgccacaactagctgaccttgtctatgagaggaacaaagacaagaaggccagcacatacatcaactttaaagggttcattgttggaaatccattaactgatgattattatgactcgaagggactggccgaatatgcttggagccatgcagttgtatcagatgaagtttatgatcagataaaaaagaattgtgattttagagcctcaaactggaccgatgattgcaacaaagccatgaacaccatctatggacagtaccagttgatcgacatatacaacatttatgggcccaagtgcaatcttgggacaaacatcagcagcatctgttgttgacaaaagcactcaaatatagtgaccatgaaccnttcaaggaggagg

SEQ ID NO: 97780 - DNA, 244 bp, Triticum aestivum
  unsure (1)..(244): unsure at all n locations
  Clone ID: PAT_TA_97780
cctctccgtcttcctcattcgcgncgcccctctctcnantcattcgtcccgccgcgccgcccgccggccgccggatccgatcttgattctactcgaccagcgcgccgccgtggcagggcnggggntccgccgatcnacccccatggtgcagctcccggccatggggaancgccancacccggnggcngcngtaacgtcatgtnatcgcnggccgcntccatttccatgagtngtggcaattttc

SEQ ID NO: 97781 - DNA, 485 bp, Triticum aestivum
  unsure (1)..(485): unsure at all n locations
  Clone ID: PAT_TA_97781
agaagctccagctgaagctcgccggcggccgcgtggctgtcgactacatcccgtcactgccgccaccgcgcaacgtcgtggtcttcagggtcctcctcagggccaacaaccccggcgggcgcgccaccattgtttacgccaacgtcaccgtccggctcacggacgcgtcggcgggacctgctgcgacgatcaccgagttcgacctgccgcagcgcatcgacgtggcgcagcgtatggcgcacgaggcgaccgcggtggccgagctggagccgggggaggacctgccgatgaggtacgtgcgcacgctctatgaggggcgcggcgtggccggcgcggagatggagctgagcggggtcttgtccacccacacggggattgccaacaccaacgtcctcaacacgtactactgctggccggtgaacatcccccgtctcgcaagggactcccgcccgccgacgtgccctgnttccaaaaagctggacgca

SEQ ID NO: 97782 - DNA, 506 bp, Triticum aestivum
  unsure (1)..(506): unsure at all n locations
  Clone ID: PAT_TA_97782
ntaanntcntcctcctctcgccgccgcngccgnagccgacnccgccgcanccncnatgtcagggaggaagaagacccgcgagcccaaggaggagaacntgacgctcggccccgccgtccgcgagggggagnacgtnttcggcgtcncgcacatcttcncctccttcaatganaccttcatcnatgtnacggttctgtccgggaggganacgctcgtccgcatcaccggtggaatgaaggtcanagctgatcgngatgaatcatccccttatgcagttatgtttgcatctcaggatgttgctgttncatgcanggangcttggtattnctgtctctgcancattaatgtccgtgcatactggtgggaacaatnacannannntccagtgtccctggtagctcangntnccccttanaggctcttgcaagtttctgggaatgaaanaattggganncattgatgatgttaccccggnnccnaccttgannttacccngccntggantg

SEQ ID NO: 97783 - DNA, 302 bp, Triticum aestivum
  unsure (1)..(302): unsure at all n locations
  Clone ID: PAT_TA_97783
ggttcgggttctggttcggttcgggttcggttcgagagagaggccgagtagctancctagtctagggtttcggtagagaggnagggagatccatggnggagacggagtaccgctgcttcgtgggcggnctcgcctgggccaccgacgacaacaacctccancaggccttcagccantacggcganatcctcgangccaagatcatcancnaccgcganacggggaggtcccgtgggttcggcttcntcacgttcggcatgngaggantctacncgccatngccatcnangacatgaacggna

SEQ ID NO: 97784 - DNA, 411 bp, Triticum aestivum
  unsure (1)..(411): unsure at all n locations
  Clone ID: PAT_TA_97784
agcaacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaanccactattttcacaacaacaacanctatttcctcaacaaccatcattttcgcagnaacaaccaccattttggcagcaacanccaccattttctcagcaacaaccaattctaccacaagcaaccaccattttcgcagcaacaacaaactagttctnaccgcaacaagcaccattttcanaagcancancaaccangtttncccttccaaaagcanatcaccttttcccaacaannaccagcaa

SEQ ID NO: 97785 - DNA, 431 bp, Triticum aestivum
  unsure (1)..(431): unsure at all n locations
  Clone ID: PAT_TA_97785
gttctgttagcatctaatatgacaaaccatgcagctaatgcagcatggagacaatctaatggatgagactgatcaagctctcgcacgatctaaacagactgtccaagagacgatcaatgtgggtaccgaaactgcagctgctctgaaagcacagacagagcaaatgagcagggttgttaacgaagctggattccattcatttctccatgaaaaaggcatcaaaattggtgaaagaaattggtaggcaaggtttgcgactgatcgctgcnatcaatgggctttgctttttctcaattggccgctgggagtcatangctgtnatcattggttaaagnattggttaaacccaacacaacaaaagatattccctgaccctcccccggggctcnntcccaccngggtcanacaanaangggtnggtttttccaaat

SEQ ID NO: 97786 - DNA, 369 bp, Triticum aestivum
  unsure (1)..(369): unsure at all n locations
  Clone ID: PAT_TA_97786
tttaaaagaactgcagctctgcagtgaatttcagattccatggaacaaacngggagtttcttttcttctgcangcccaggagcaangcatggtggggcanatatgttcaggcacacttgntacagttgtactacaaaggctttcacacagcgancctactgggaaatgntcgacnttctccanaaagancggaaaaccacntcggttncganatcctaatgaatggnaagagcttccacaaanantagctggtnaanccaaacccatttgcantctagcnacaagttctctaagcaattnctcgccagaattngaacnaatgcttgnnagaaatnanctcnttaagccttcaanccaaattnccaagaa

SEQ ID NO: 97787 - DNA, 315 bp, Triticum aestivum
  unsure (1)..(315): unsure at all n locations
  Clone ID: PAT_TA_97787
gttcgcttcccatcgcgtcccatctcctctctgaaccaccantcaacaacaacanncagatggctcgcttcgccgtggncgccgccgtcatcncgctcctcnccgtcnccgcngccgcgcagggccccatgccggcgtcctagnatggccccgctccccgcaccgcnggtgaggtcgncggcnaccgnccctgcgccggtcgncacccccgcccatcgccgcgtcgccgtccncgatggactcgcncccgggcccnctcaccnacgctctctcctgttatgacgcccntccggtggtctccgnnatgctccatcg

SEQ ID NO: 97788 - DNA, 446 bp, Triticum aestivum
  unsure (1)..(446): unsure at all n locations
  Clone ID: PAT_TA_97788
ccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcaacaacccggaccgcaagatagcgtgcaggtgcctcaagagcctcgccaccagcatcaagtccatcaacatgggcaaggtctccgggcgtgccccggcaaagttgcnggcgtcagcgttgccttcccccatcaacatntccaccaaacttgcaacaa

SEQ ID NO: 97789 - DNA, 438 bp, Triticum aestivum
  unsure (1)..(438): unsure at all n locations
  Clone ID: PAT_TA_97789
cctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccgggganaccggcgggtgcgactgcaccacctgcaagtgcggnaccgcgtgcgggtgctcctgctgcanctgcaactgagccggcgcccaagangncgggcggcaaaagcgagcaccaggattaggaggacaaacaaagcaagcaacatcancaacagttnaccaacaacccaacgtatcatcaacaagcccccgcaancgctcccggggg

SEQ ID NO: 97790 - DNA, 280 bp, Triticum aestivum
  unsure (1)..(280): unsure at all n locations
  Clone ID: PAT_TA_97790
cccagccgccttcctctgtcgccccgccaccgcaacccgcaagcctgaccaccccgtcctccttccggcagtgcgccccaccttgccgagctgctcctcgcgggctcctagatccagcgagatccgaggcatgcccagccagctgaactcccggtgatcagtccggtccggctaccgcctccagcgcgcctcctggcaatggatccgggccggcaaccgccccctgcacagccatgaccaaccccgccgcaggatccatccgtcagntggcccccccccc

SEQ ID NO: 97791 - DNA, 298 bp, Triticum aestivum
  unsure (1)..(298): unsure at all n locations
  Clone ID: PAT_TA_97791
ccaagcaacactagttaacaccantccacaatgaanaccttcctcgtctttgccctcctcgctcttgcggcggnaagtgccngttgcgcaanttttcacagnagcaanaacgcaccgccattttcgcagcaancaaggganccaccattttnacggcacacaagtaantaccagncanctcatccatctgttttgcaacaagctaaaccnacgcaangcantccntccaancaagcaaggtgcaatcccttggtggggaantgcaagcgangtcttgcncanggcaacaacatggttg

SEQ ID NO: 97792 - DNA, 380 bp, Triticum aestivum
  unsure (1)..(380): unsure at all n locations
  Clone ID: PAT_TA_97792
tcgccacggttccccttaccggccggtcgccgcagccgccgcagcactcgtcggccggtcgccgtancggccttccgttcccttgagttcccagcctcacaccactctctgtanaanccatggcatggnggaggcctcttcttgagcctgagccgcccgacaccggaanancagaagtcgtggnctcgccggntgccggcgggcttcaactacgacgcggnttctccacnggcgcccanccaacccnnaaatcaccaagccngcaattaanaaccctctgaaagacaaacgaanaggggcgcatggnccgaaccagtnggttctccnggttgaaaccgggtcagcnaaactcncntggcccggntnccgnggggccgaac

SEQ ID NO: 97793 - DNA, 449 bp, Triticum aestivum
  unsure (1)..(449): unsure at all n locations
  Clone ID: PAT_TA_97793
gatcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatganaagatggaactcatgctgtcccaagtgaagggcaaggacatcaccgangctcttggctgctggtaaggganaagtttgctgcggttccatctggtggtggngngtgtggctgtttcaagctggctgcccctgctgctgggaggtgctggctgcccctgcangttnanttcaaagnaaagcangngaacgttcgtgggcgaaanggaactgnttgntngttaacattggccttcaannccgttcganccaaagttnncgggggnaacctggngtccg

SEQ ID NO: 97794 - DNA, 382 bp, Triticum aestivum
  unsure (1)..(382): unsure at all n locations
  Clone ID: PAT_TA_97794
cccagccaaccactcccacttgctagctagcagcagcagccatggccgctctctcctctgcagcggtgtccgtcccttccttcgccgccacccccatgcgcagcagcagcagcaggatggtggtgcgcgcgtcgctgggcaagaaggccgccagcgcggccgtggccatggtccgcgagcgcgatgctgctgggcgggtcggcgatggcgcaggacgtgctcctgggcgccaacggnggcgtgctgggtgttcgagcccaacgacttcagcgtcaaggccgggcgaagaacatcaccttcaaagaacaangctnggntacccgcacaacgntngtggtttcgaccaaggancgccngttgccctcccgggcgtgggaacgtc

SEQ ID NO: 97795 - DNA, 526 bp, Triticum aestivum
  unsure (1)..(526): unsure at all n locations
  Clone ID: PAT_TA_97795
acattcccccatcaaccacagcaacaattttcccagcctcagcaaccacaacaacaatttatccagccccaacaaccattcccccaacanccacaacaaacatatccccagcgaccacaacaaccattccccnagactcaacaaccccancaaccatttccccagtctcagcaatcacaacaaccttttcnccangccccaacaacaatcccgcagncgccaananccacaacaatcattcccccaacaacanccatcgttgnttcaacaatctctanancaatagttgaacccatncaagaatttcctcttgtaccaaatgcangcctgtgtcccttggntntcatccctcgngggtcaantgatccttgccactcggtnnaatgggccagggttnatgccggnaacaaangttgccaactcaactagcaacaagttcntcaagncaagtccgaggtggtncanccccaanccatancaancgntgcattcccaactnancaatggcangnagnaagctancang

SEQ ID NO: 97796 - DNA, 395 bp, Triticum aestivum
  unsure (1)..(395): unsure at all n locations
  Clone ID: PAT_TA_97796
gtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaatctcagcagcagcaaccccaacagttgggccaatgtgtttcccaaccccaacagcagtcgcagcagcaactcgggcaacaacctcaacaacaacaattggnacagggtacctttttgcaagccacaccaagatagctcagcttggagggtgantgaacttccattgcgctcccgtancctancaaaccgaatnngccgtgtcaantggggcc

SEQ ID NO: 97797 - DNA, 489 bp, Triticum aestivum
  unsure (1)..(489): unsure at all n locations
  Clone ID: PAT_TA_97797
tggatgattcagtcatttctacaacaacagatgaacccctgcaagaatttcctcttgcagcaatgcaaccctgtgtcattggtgtcatctctcgtgtcaataatcttgccacgaagtgattgccagctgatgcagcaacaatgttgccaacgactagcacaaattcctcaacagctccaagtgcgcaagccatccacaacgtcgcgcattcatcatcattcagcangaacaacancgaaggcngtgcaaatcctgcggccaactatttnaagcttcgcccaaggggtctggggtnatcaattcaaaccctcnaacaaaccaagntnaatttggnagggggattaagggtcaattnggtaattgaaaaaactccttccaaaccnatngtgncaancttgnaatgtccccntgctntangtggctccnaccaatccaaccaangccaataatggccaaacaataanaccccttttnnttggncgggcccaa

SEQ ID NO: 97798 - DNA, 409 bp, Triticum aestivum
  unsure (1)..(409): unsure at all n locations
  Clone ID: PAT_TA_97798
actttatttgtcttttattcccaagcttgaactaccacatgtcggggtcacacatgntngngcaggccactttatttgtcatcgntanaacgatcggtgaacaanctaagcaaccatnattcatctacctattagcataactcttgaatttttcattggccaccaatgacangcntctatgttggcatatggcatgttgatggnngagcantcaggtggngacatacacngttgcaacatgggtttggacatantttncaataccaatgaccttgatcccctcccaaatttgagcctgggtttggttgagggttggatgatacccaagaccnctgggccgacctgganatnantgggccngcaagggattctggaacnccctccgcttgttgtttcttngctngcaatg

SEQ ID NO: 97799 - DNA, 407 bp, Triticum aestivum
  unsure (1)..(407): unsure at all n locations
  Clone ID: PAT_TA_97799
gctgcagaaacataggcaagcggaggaattgccctcacaccatctcttcagtccgtccacaccgagagaggaaaaagatacggagcggagtatctatgttgcggcgaacggcgtcggcgtcggccgccatggtgtccggctactggcagagggaagccgtgggtgcgtgcacagagagcctcgggtcggagagcggcgacgtcggcggggagatcgagcagcttccggccggcgccggcgccggagtggacgaggacggggcacaacgcgggaatggtggagcttcanaatttggcgggcaaaangcggcnaaggcaaaagcccctccctccggccaatgccaagccgggccangggtttaatcccccccntcggccnttgtcgggccctcccnacctcacccaagt

SEQ ID NO: 97800 - DNA, 374 bp, Triticum aestivum
  unsure (1)..(374): unsure at all n locations
  Clone ID: PAT_TA_97800
agcagctaggacaagggcaacaaacaggacagccaggacaaaagcaacaaccaggacaagggcaacaaacaggacaagggcaacagccagaacaagagcaacaaccaggacaagggcaacaaggatactatccaacttctctgcagcagccaggacaagggcaacagcaaggacaagggcaacaagggtactacccaacttctctccagcagccaggacaagggcaacaagggcactacccagcttctctgcaagcagccaggacaaggacagccaaggacanaggcancaaccaggacnagggcancatccangaacaagggaaacaancaggacangggcaatcaanggntactatcccaaacttctccaca

SEQ ID NO: 97801 - DNA, 495 bp, Triticum aestivum
  unsure (1)..(495): unsure at all n locations
  Clone ID: PAT_TA_97801
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacnatgctatcacatcgagcctgttgctggggaagacagccaatggatctgttatgtagcttatccattagacctatttgaacagggttncttactaacatgtttnacttccattgtagggtnacctacttggtttcnaangccctaccgtgcctccncgttttgggaggatctaacnattcccccctacnttattcaaaaanctttccnaaggnnccgcc

SEQ ID NO: 97802 - DNA, 535 bp, Triticum aestivum
  unsure (1)..(535): unsure at all n locations
  Clone ID: PAT_TA_97802
cacactctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagagganacgaanggagccccgaagccaagcaactggcggccgaaccggaggccgagggcgccccgccgtgggtccgaggacaagagaacaaagggaggnccgttggcctgaaccaataancccggggggcgggcccgaangaangttnaaanggaagaaggcggccncctngcctgccgaagggccaaagcccggccgnctcccgctttctnnttaaaganaanaaacggttgngngnaaaaccnccggcccccggtggccn

SEQ ID NO: 97803 - DNA, 278 bp, Triticum aestivum
  unsure (1)..(278): unsure at all n locations
  Clone ID: PAT_TA_97803
gtggaggaagaagaagaatgcgaanaaggtcaaattccacgaccacgaccacaacacccggngagggaacgtcagcaacacggtgagaaggaggaagacganggtgagcagccacntccattcccattcccacgcccacgccaacctcatcaagaggaanagcacgagcagaaggaggaacacgantggnatcgcaaggaggaaaaacacgngaggaaagggaagtgaanaggaacatgatgancgnganacacccncnctcacaccannctcatcaa

SEQ ID NO: 97804 - DNA, 168 bp, Triticum aestivum
  unsure (1)..(168): unsure at all n locations
  Clone ID: PAT_TA_97804
gccgccgccgccatctcctcctcttcccctctcgtagcgcctccgcctcgccttccccacacaaccagcgaggggcatggttccagatcgggcattgccatggagagcaggagcggccggacggttgggctgaaggagtaggggaggcctgcggnggggtcnnaacgt

SEQ ID NO: 97805 - DNA, 275 bp, Triticum aestivum
  unsure (1)..(275): unsure at all n locations
  Clone ID: PAT_TA_97805
cgagttttttttgntttatttttcacgatcgatgttttttcggatgaggaaaatgaagcaaatggggagtttcagaatgcagaatggaccgacggcatgtgtcccaaccttcaagttgtgcgattgacgggtgttctctgttcgtcaaatgaaatgtgttttatacagcttcttttatctaaagctacagttcttcgcattatgtctattaatcttggttacggaagcttaaagtctagtgaagatgcactgcgtgaactgatancatatagaaa

SEQ ID NO: 97806 - DNA, 376 bp, Triticum aestivum
  unsure (1)..(376): unsure at all n locations
  Clone ID: PAT_TA_97806
ctcagctcaccgtcacctccccccaaatcgccgacgcgtcctccctccctccctccctctctctctctatctatctttctcagccatggcgaagcagcttgccgtgcacgctctcctgctggtggtcttgctcctcgcgctctcgtccgttcacgctggcagcaactcgacggcctcggccggaccactgtatggcatcgagttcccgccgtacaacacggccgtcgccgacgccggttgngacggcaggctggtggccgnggagggggatctcgcgcgccagccaccctccctcaaagctccacatgacccanccgttcccgccgcccgagggaaaacacgggggaaacgnctcctttcttcctcngacccctct

SEQ ID NO: 97807 - DNA, 520 bp, Triticum aestivum
  unsure (1)..(520): unsure at all n locations
  Clone ID: PAT_TA_97807
gaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacancaactatttcctcaacaaccatcattttcgcagcaacaanccaccattttggcagcaacaaccaccattttctcagcaacaaccaattctaccacagcannccaccattttcgcagcaacaacaactagttctaccgcaanaaccaccattttcacagcaacancnacccaagttttacctccacaacaatcacccttttccacaacnacaacaatggcanncacgctnggtgncaacaacaaaatcccctgttgtttcaagccatccatttttggcaagccangctnaanccatggcnaggctnttcctcccagncangcaagtnccnngccctnggtgggcaaatntccnaaanggttttg

SEQ ID NO: 97808 - DNA, 373 bp, Triticum aestivum
  unsure (1)..(373): unsure at all n locations
  Clone ID: PAT_TA_97808
caaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccaagcagcgtctcatcttcgctggcaagcagctggaggatggccgtaccctcgctgactacaacatccaaaaggngtccaccctccancttntcctgcgtttgngtngggggcatgcanantttcctgaagacccctcactgggaaagnccatcaacccttgaggtngnggagctcccngcaccatttacaac

SEQ ID NO: 97809 - DNA, 498 bp, Triticum aestivum
  unsure (1)..(498): unsure at all n locations
  Clone ID: PAT_TA_97809
ccgccgccgcctcctcctcctcctctcggctccttctccttccttccagtttcagccatgggtaaggagaagactcacatcaacatcgtggtcattggccatgtcgactctggcaagtcgaccaccactggccatctgatctacaagcttggaggtatcgacaagcgtgtgatcgagaggttcgagaaggaanccgctgagatgaacaagaggtccttcaagtacgcctgggtgcttgacaagctgaaangccgagcnccnagagggggtatcaaccaattgataattgnccttgtnggaagtttgaggaccaacaaagttactaactnggaaccggtncanttggaatgncccctgggcaccgntngncttcaatcaaagnaacnatnattaccnggttacctcccaagggctgacttgtgcngttgctccaanaaccgaantccanccaacntgggtggtttttgtnngnctggtaatctcngaaangaccnggcn

SEQ ID NO: 97810 - DNA, 439 bp, Triticum aestivum
  unsure (1)..(439): unsure at all n locations
  Clone ID: PAT_TA_97810
gcctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgattacctcatcctttccgtcggatttgggtggaggtggttgctccagctgctgctgctgctgccccggctgctggtggtgcctgctggccggctnaangaagaanaaantaatagaaanngggtnaggncaacggaanaaangcntttatncnattgggttcagccnttgtttgactnagcnatttaatttcagntntncctggt

SEQ ID NO: 97811 - DNA, 307 bp, Triticum aestivum
  unsure (1)..(307): unsure at all n locations
  Clone ID: PAT_TA_97811
gcaaccaaatcttcttgagggttttctgcaactgcaatggcgttgtccaccatggcactctcctctccggcccttgccgccaagcaggccaagatcgcctccttcaacgtgttcggcgagggccgcatcactatgcgcaagacggcggccaaggccaagcccgccgcttccagcagcccgtggtacggccctgaccgcgtcctctacctcggcccgctctccggtgatgcgccgtcctaactnaaccggtgaatttccccggagaactannggtgggaaaacnggccggggctctccgggtngaccc

SEQ ID NO: 97812 - DNA, 396 bp, Triticum aestivum
  unsure (1)..(396): unsure at all n locations
  Clone ID: PAT_TA_97812
gccagatccgcagcccctccatcccaatggcccgcaccaagcanacggcccgcaagtccaccggcggcaaggcgccgaggaagcagctggccaccaaggcggcgcgcaagtcggcgccggcgaccggcggcgtcaagaagccgcacaggttcaggccgggaaccgtcgccctccgcgagatccgcaagtaccagaagagcacggagctgctcatccgcangctccccttccagcgcctggtgcgggagatcgcgcaggaattcaagaccggancctncgcttccagtcctccgccggtctccgcgcctcccaaggaagnccgcccagggcctncccttngtccngnctgtttcngaangnaaaaccnaacccttgttgngnccattcaacggncca

SEQ ID NO: 97813 - DNA, 302 bp, Triticum aestivum
  unsure (1)..(302): unsure at all n locations
  Clone ID: PAT_TA_97813
ccaatccaccatgaagaccttcctcatctttgccctcctcgccgttgcggcgacaagtgccattgcacaaatggngactanccacatccctagcttggagaaaccattgcancaacaaccattaccactacancaaatattatggtaccaacaacaacaacccatccaanaacanccacaaccatttccacaacagccaccatgttcatangcaacaacaaccaccattatcgcaggaatcancaancaccattttcanaatcancaacnaccatttttgcgggaacancanncccgtttct

SEQ ID NO: 97814 - DNA, 161 bp, Triticum aestivum
  unsure (1)..(161): unsure at all n locations
  Clone ID: PAT_TA_97814
gcggaggctgggctgggaagaaggcattgtcgtggacttcgagcacgccgatgagagggggcgggtggagggtgcggtagcggcggaggaaggcgtggccggtgatgagacggcggaaggaggcgcgcgccanggaggcgcgggctaagtcggcagcagtg

SEQ ID NO: 97815 - DNA, 478 bp, Triticum aestivum
  unsure (1)..(478): unsure at all n locations
  Clone ID: PAT_TA_97815
gcaaccaccattttcgcagcaacaacaactanttctaccgcaacaaccaccattttcgcaacaacaacaacaaccagttctaccgcaacaacaaataccatttgttcatccatctatcttgcagcagctaaacccatgcaaggtattcctccagcagcaatgcagccctgtggcaatgccacaaagtcttgctaggtcgcaaatgttgcagcagagcagttgccatgtgatgcaacaacaatgttgccaagcaagttggccgcaaaatcccccaagcaantccccgctattgagggcaaatcccgtggcttatcaatctaactccaatcaatccctggcaaggaacaacaacaagggttnaaggggttncaatccnantcctcaagcaagcaagcaagcccccaacanttggggccaaattgttttttcccaatcccccaancaagcaggtcncaagcaagcnaactcggggcnaacn

SEQ ID NO: 97816 - DNA, 192 bp, Triticum aestivum
  unsure (1)..(192): unsure at all n locations
  Clone ID: PAT_TA_97816
gagagagagagagagagagagagagagnattgattgattccgcaaggtactcattaaaccattaaaaaatantctcacaatggaaccagtaaancatgacaaaagtttcttcttcancanngagtataatanntgangatatcacatccattcttctcaantgcatcangaagnatctnnattggaaaaant

SEQ ID NO: 97817 - DNA, 452 bp, Triticum aestivum
  unsure (1)..(452): unsure at all n locations
  Clone ID: PAT_TA_97817
acactagttaacactaatccaccatgaagaccttcctcatctttgccctcctcgccgttgcggcaacaagtgccattgcacaaattgagaatagccacatccctggtttggagaaaccatcgcagcaacaaccattaccactgcaacaaacattatcgcaccaccaacaacaacaacccgtccaacaacaaccacaaccatttccacaacagcaaccatgttcacaagcaacaacaaccaccattatcgcagcaacaacaaccaccattttcacaacaacaaccaccattttcgcagcaacaacaaccggcaacaattattcccccagcaacaacaaccgttgattcaagccatatctacaacaacagatgaacccttgcaagaattacctcttacagcaatgnaaccctgtggtcattggggncaaccccccgcgggcnatgatttttgcg

SEQ ID NO: 97818 - DNA, 434 bp, Triticum aestivum
  unsure (1)..(434): unsure at all n locations
  Clone ID: PAT_TA_97818
cagcagctcatcgtgcagctcggctgcgacgtcgtctacatggtcaccggcggcaactgcctgcagaagttcgccgagtctgtatgcccgggctgcacgcggctgcaccagtcctactggatttgcatcttcggctcctcccagttcctgctctcgcagctccgcgacctcaactccatcaccgccatctccctcgccgccgccgtcatgtccctcaactactccaacatatcgtgggcggngtgcttggccaagggccccgtcgccggggtgagctacgcgtncaagggcggcaaggnggnggactcngtgttccgggtgtgcancncgctggggcaagtggntttcncgttcnccggggcacggngtggtcctggagatncangncaacatcccgtncaagcctnacaagccgtccaaggtgcccatgtggg

SEQ ID NO: 97819 - DNA, 254 bp, Triticum aestivum
  unsure (1)..(254): unsure at all n locations
  Clone ID: PAT_TA_97819
cacaaactacactcatccactcaagcaaaagctagcggngtagtagctcacttcagtccagtcggcatggcggttccgaggggtgcggcactggtgctggtgatggtnctcgcggcnatggtggtggcgccgccggngactgtgcacgccatatcctgctccacggtgtacagcacgctgatgccgtgcctgcantacgtgcagcagggcgggtcgccggcccgggggntgctgnnccggcatccacanacctg

SEQ ID NO: 97820 - DNA, 450 bp, Triticum aestivum
  unsure (1)..(450): unsure at all n locations
  Clone ID: PAT_TA_97820
agtgctcaatacaaatccaccatgaagacctttctcatccttgccctccttgctattgtagcaaccaccgccacaattgcagttagagttccagtgccacaattgcagccacaaaatccatctcagcaacaaccacaaaagcaagttccattggtacaacaacaacaatttccagggcagcaacaaccatttccaccacaacagccatatccgcagctgcaaccatttccatcacaacaaccaatntttgcaagctncaaccaatttccggcaaccggcaactnacaatatcccgcnagccnnaactnacaatatnccgnaagcccnnaaccatttnggaccaaaacaatnaatatncaaaaccngnaaccncagttntcgcaaccaaaacaaccaatttcgcaacaacaagcaacaggaagccagcaacaaccaccactaccacngttt

SEQ ID NO: 97821 - DNA, 455 bp, Triticum aestivum
  unsure (1)..(455): unsure at all n locations
  Clone ID: PAT_TA_97821
ccccgctctacttcagtctatgtcttctcctcttcccgtcccgagctagggactttccaatcgggggattggttgctgtaggatttgcctttgctgcacctcatattttttttcaggatttaccagtcgggggatttccttgctgacggattgtcgttggtgcatctcctctttctcacgtattttttgtctttgtttgaatcttactgtttggtggtagtgtgtgtagtatgtttagggtttctaagatgtgcaagtgtgatttggttttacggcttggntttaaggttttgggtttattagggtttggaactggggtaaatttaatgtgtcttgtangtcctggaaaagatncattcctttttaancggtttaatgttttttnggtgantgcanaatccannggnggtggtgnctttttgntaggcccttcctngnagtaattttttaggaag

SEQ ID NO: 97822 - DNA, 348 bp, Triticum aestivum
  unsure (1)..(348): unsure at all n locations
  Clone ID: PAT_TA_97822
gccgcctcccccaccaacctgccccgacccgctcccgacctccgaggcaagcagcgcctccgccatggcgttcgagaagatcaaggtcaccaaccccatcgtcgagatggacggcgatgagatgaccagagtattctggcagtctatcaaggacaagcttatcttcccatttttggacttggncattaagtactttgacttgggaagttctacaccgcgatgcaactgatgacaaggttacaagtnggaggctgcaagaggctactctcaaagtncaatgtngctattaaatgtgcaactnttactccagattaagatngggttaaaggagttcaacctaaaacaaat

SEQ ID NO: 97823 - DNA, 452 bp, Triticum aestivum
  unsure (1)..(452): unsure at all n locations
  Clone ID: PAT_TA_97823
caacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcangccatatctacaacaacagatgaacccttgcangaattacctcttacagcantgcaaccctgtgtcattggtgtcatccctcgtgtcaatgatcttgccacgaagtgattgccaggtgatgcangcaacaantttttgccaagcaactagnacangatncctncgccaagctcaagtngtgcagnccatcccaatangcgtcggtgcaattccaatcgnncattggcanncnaggaatannt

SEQ ID NO: 97824 - DNA, 476 bp, Triticum aestivum
  unsure (1)..(476): unsure at all n locations
  Clone ID: PAT_TA_97824
tttttttttttttcctctcctaattatctgtttattctcttaaatgatctaaaatacagtatagactgtgtcttcttgaaagatcaaacaaatatatatatactgtccacaaggatagaatggagaccaagagggaagttcgaaaacacgcattacaaacatatatggctcctttattttcgttctatattggagtagactctggacatgtttgggtttattcccgncgagctcatcaatttagcctgatttcttatgcctgattcccatgccctgcacgaccantgcccgctcttcccggttcaaaagccttngggtcctcnggaanncgccaanagggacaaaatnaccaatccntncancccccngtncgcanggtnaaagtcnncccaggcccncagggctccaacccangccantcgncnccttttnctggnaggggagcacataatncccccttgaangggtnngttttt

SEQ ID NO: 97825 - DNA, 434 bp, Triticum aestivum
  unsure (1)..(434): unsure at all n locations
  Clone ID: PAT_TA_97825
gtcccctccagctctcgagttcgacagatcttggctcacttcaccgccggcggacgcagcgaagcgagggaggagcaatggcggaccgcgggggctacgtgcaggtgcagcacgggcagtacggcggcgggcaccacggcgggcagcagcagcacgggcgccagatgggcgagcagatnaagggcatgttccaagagaaggcgctgacggtggcnacgcttttcccgctgggcgggctgctnctngtgctttccgggctggggcttgngggcancgttgtggggntnggccgttgccaagcccgntnttcctngtctttaaaccccaanntnggcccgggcgcgctnaacaacnggctggncgtnaacgggttcctcancctccngccgctggggctgggcgggctntccncgctcaacnttttctccaaaant

SEQ ID NO: 97826 - DNA, 457 bp, Triticum aestivum
  unsure (1)..(457): unsure at all n locations
  Clone ID: PAT_TA_97826
aagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgcttatcacatcgagccctgttnnctnggggaangacaagccaatggatnctgttatgtancctgatcccattangacccaatttggaaganggttccntttactaaanaangttttactttcagtggtnggttcacgtnattcggttncanangccccntaaggtgctccnccgtttgggcaggg

SEQ ID NO: 97827 - DNA, 442 bp, Triticum aestivum
  unsure (1)..(442): unsure at all n locations
  Clone ID: PAT_TA_97827
ccgcctcgccatcgacgccatggccccgccttctccccccgcccacgcggcccggcgcgtgccgcccccgtgctggacccccgaggagaccgtcgcgctcgcgcgcgcctacaccgcgcgccgcctcgccgtcggccgcgcccacctcagctccgccgactgggccgccgtcgccgcggccgccaccccgtccaagaccgccaggcagtgccgccacaaggtcgagaagctccggcgccgcctccgcttcaagcgccgcccgcctttgcccatcctcganggggataaatntgctcgaagacccttcgtcgtccccctcgngctcccaattccgtttccgccgccggccgnctccccgnttncccctntcccttcnccggccaanaaatagggnggggggcccnatttccattnaanaaagggtnttnnttcccgggganan

SEQ ID NO: 97828 - DNA, 444 bp, Triticum aestivum
  unsure (1)..(444): unsure at all n locations
  Clone ID: PAT_TA_97828
cggcggcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcaacgtcatattatgggntgatgggaaaggtccgcactgacaagacctaccctgctggtttcatggacatcatttccattcccanggactgngtgaagaactnncangcttctgttatgacacccnaggggtcgcttccgccttcactcctttcaggg

SEQ ID NO: 97829 - DNA, 332 bp, Triticum aestivum
  unsure (1)..(332): unsure at all n locations
  Clone ID: PAT_TA_97829
gctggaaaggctcggcttcaaaaccgtacgtggagcttccgcctcatacggctcctctagggatgggggtaggcccagcccangcttgtgcggttaaggttgttgctagagcacaagcagaaaatcaaagtacgtantanttaacgcaattccaccatgangaccttactcatcctgacaatccttgcgatggcaataaccatcggcancgccaatatccangtcnncccttagcggccanttacaatggttacaacaagaacnattcccccangctccaaccagccattaatcccagcattcacantantanaattttccccaatcctcac

SEQ ID NO: 97830 - DNA, 451 bp, Triticum aestivum
  unsure (1)..(451): unsure at all n locations
  Clone ID: PAT_TA_97830
gctaagctaaacagcangcgagcaatggcgtccacctcctgcttcctccaccagtccaccgcgcgcctggccgcctcggcgcgccctgcgcccgccgtcgggcgcacccagctgttcgtctgcaaggcgcanaagaacgacgaggctgcacntgacgctgccgtcgtcaccattcgagcgcgccgcgctgtccctcctcgccgngtgccgccgccgtcgccgtcaaggtctcccccgccgctgccgcctacggagaancagcgaacgtgttcggcaaggcgangaanaacaccgacttcgtggnatacaagcgggggaggggtttaaactgatnatccccggcccaaagtnggaacccccagcaagggagcgtnatntttcccctgggcaaggtgctccgctacnaaggacaancnttcgattnccnccaggnaaaccctctcccgtttat

SEQ ID NO: 97831 - DNA, 421 bp, Triticum aestivum
  unsure (1)..(421): unsure at all n locations
  Clone ID: PAT_TA_97831
ggaaaaccaaccagaagaaaagctcgggaggagagcgtggggggactagggagcatggcggagcacaaggaggagccggtggcggagtccatgatggacaagatctccgacaagttccacggtggggactcgtcgtcgtcgtcctcggactcggacgacgagaagaaggggtcggcggcgggcgtcaaggccaagatctaccgcctcttcggccgcgagaagcccgtccacgcccgtcctcggcggcggcaagcctgcttatcttgttctaaggaggaacaanaangtctccggnggggtgcttgctgggcgntactgccatcctggctggctgttccaggtcatggagtnccatntgcncaccttgggggggcaatngnctcanccctctccctgggaanccctcctccctcnatgtcca

SEQ ID NO: 97832 - DNA, 448 bp, Triticum aestivum
  unsure (1)..(448): unsure at all n locations
  Clone ID: PAT_TA_97832
agcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcagctgcaaccatttccgcagccgcaactaccatatttcgcaagccacaaccatttcgaccaaaacaaccantatccacaaccgcaaccacaagtattcgcaaccncaagaaccaatttcacaggaagcagcaacaacnaccacaacaacaaccnantccttcaacaaatttttgnaacaacnactgattcn

SEQ ID NO: 97833 - DNA, 343 bp, Triticum aestivum
  unsure (1)..(343): unsure at all n locations
  Clone ID: PAT_TA_97833
gtcgcgacctctcccgccgccaccacccgtgcctcctcttcctcctcgctctctcgcgcacggggctcgcgtccgaaaccctaacctcccaccatggcggctgaaggcggtggcgtccgggcgctgtcccagcgcgagcaggacatccagatgatgctcgccgccgacgtccacctcggcaccaagaactgcgacttccagatggagccgctacgtcnacaaagccgccgcaacttgacggaattaaaatcaataancttnggaanaaccnggaaaaanttcaaatngcccnaagggtnaatnnttccaatgnaaacccttaagngancantgggnaaattcg

SEQ ID NO: 97834 - DNA, 361 bp, Triticum aestivum
  unsure (1)..(361): unsure at all n locations
  Clone ID: PAT_TA_97834
accaacccccaaaacctccccgcatctcgcgcctctcccccgccgccgccgccgccgccgaggacaccgagcgtctccctgcccgatcgccatggccgccccgacggccttcgctgccgccaggttcctcccgtccgctcacctcgactcctccgcgcgcctcgccccgctccgggccgccccgacctcaaacctcgccttctcgccgctgcccgcctcctcctccgcgctcctcgccctccgctcagcttccccgtcccgtccgggccgggagggaaggctgcccccgccccccgcccccggcgctcctacnggggtngnggctgaaggattntggcgancnaantcggactccgggggg

SEQ ID NO: 97835 - DNA, 427 bp, Triticum aestivum
  Clone ID: PAT_TA_97835
atgagctccaaccatctcctttgcctgagattcagctccttccgcgtgaaaatgtacttcgaactcttgtgatccatgtacacatcacattggtttccaataagaaaatgtctccaggtcttgagcgcatgcaccacggttgctaactccaaatcatgcatggcataattcaactcgtgcggtcgaagttgtcgtgaggcatatgaaacaactcttccgtcctgcataagtactcctccaagtcctaagtgagaggcgtcgcaatacacttgaaaatccttgcgtatatccggaagaatcatcactggggctgtaaccaaacatttcttcaattcctgaaaactagcttcacattcctcggtccatttgaacttgttgtccttcttaaaaattctgtcaagggttttgcaatcttggagaaaattcc

SEQ ID NO: 97836 - DNA, 251 bp, Triticum aestivum
  unsure (1)..(251): unsure at all n locations
  Clone ID: PAT_TA_97836
acacaactagagcacaagcatcaaatccaagtaagtattagttaacgcaaatccaccagtgaagaccttactcatcctaacaatccttgcgatggcaacaaccatcgncaccgccaatatgcaagtcgaccccagcggccaagtacaatggccacaanaacantcattcccccagcccccaacaaccattctggcnaggcanccanancaaactattccccanccccatcaaatattccacnatcaaccac

SEQ ID NO: 97837 - DNA, 291 bp, Triticum aestivum
  unsure (1)..(291): unsure at all n locations
  Clone ID: PAT_TA_97837
gtcctactgtcanatacacacananaagtgctacctacctnatcgattagccagccatggcggaggagaagcaccaccaccacctgttccaccacaagaaggagggcgaggacttccagcccgccgctgacggnggcgtcaacatgtacgggtactcgaccgagacggtggtgaccgccaccggcaacgagggcgagtacgaacggatnaccaaggaggagaagcaccacaagcacaaggagcacctccggcaaatnggcgcccgccgcccccggagncttncccctcnaa

SEQ ID NO: 97838 - DNA, 417 bp, Triticum aestivum
  unsure (1)..(417): unsure at all n locations
  Clone ID: PAT_TA_97838
gccagcctcagctcacccgaagcaaagccagctagcacgcancgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctcgggcgacccccccgagcntactcanccggggagttcccccgggngaataacgggctgggacaacgcgggggttgttcngccngaaccccnagaacntcgccaatcnnaccgggtagcttngagggtcatccaatgncngctngggccatggcttcgggggngctcnggtngctcttnccccgat

SEQ ID NO: 97839 - DNA, 189 bp, Triticum aestivum
  unsure (1)..(189): unsure at all n locations
  Clone ID: PAT_TA_97839
acaacattgacaacatgaagaccttcttcctcctagctttccntgcnctggtagtgagcactgctattgcgcaatatgcanaagttcccagaccanctgcgcaagctcccaacgcgggtggttttggggaaagggttgcgatagcgcctaaatgcganttggttctgaaaatttcgaaggaaaacaacc

SEQ ID NO: 97840 - DNA, 458 bp, Triticum aestivum
  unsure (1)..(458): unsure at all n locations
  Clone ID: PAT_TA_97840
ggaaagcagcacccgaggaaaccctaaccaccatcgattgattgagcggcggcgcggcggagcggcggagatggagacgatnagcagcggattcgcggggttcaagatctacaccatcgacgaanatggcgcatcaagaccggccggcggaactcgcggggttgcgacgaccgggaaggaggtcagcagcagcagcaaggtcngggcaagcacccggngggagggccgaggtcttcgcgatgcgaatccggatangctgcgaaagggcaatggcgggagcgccaacttcttcggcgattcgttcaatttaagtgcctgggnaagaangaatcctccacctcgagacgancagaaangatcaggggngcgatcccccancaaacccgtctttgccctggggaataccctcccttcggnggggggtctngcgggttcctttcggacgacnanancctgct

SEQ ID NO: 97841 - DNA, 330 bp, Triticum aestivum
  unsure (1)..(330): unsure at all n locations
  Clone ID: PAT_TA_97841
caccattcactcaactggagaacaaacattatctaacacaaatcaaccatgaagaaattcctcgtccttgccctcattgttgtcgcggcgaccaccacggncgccgaaccctttactgcattccgtantgcttgggagccgcaacatccatcatctccggagcatcaanccaattccgcagccacaaggaacatccagttccacatcaaaagttgaacccatgcaggggatgccctcctacaacagtggtancccagttgcttgatatgtcatntcctccggtcacanggtnnggggcaacaaanggaaacngcttgggtnatggnggga

SEQ ID NO: 97842 - DNA, 321 bp, Triticum aestivum
  unsure (1)..(321): unsure at all n locations
  Clone ID: PAT_TA_97842
gtcccacctcacccgaataagcataaacgcgcccgagaggcttgaaacacacccgaaaagcccttggaaatcacgccgacggtggggggttaggcgagatggacgcgacggcggaaatccacaatgtcgccagcatgcggcgcgacagcgggtccatatggcggcgcggggacgacgtgttctcgcgatcgtccagggacgaggacgacnaggaggcgctgcgctgggccgcgctcgagaaactgcccacctacgaccgcgtccgccgtgccatcctcccgcctctcgacggcggcgagggcgcggcccccggagcggcgg

SEQ ID NO: 97843 - DNA, 351 bp, Triticum aestivum
  unsure (1)..(351): unsure at all n locations
  Clone ID: PAT_TA_97843
tggaggccaagaacgcagcacgactgcacagcaccagctgccgaccgaccgcgggcggagctgaccccccgacccgatcagatccctcgccgcccgccccctcagatctccccgcgcgcgcccctcccagatccagctccgagcacttggattttcaacaaagaggtcctgccggcggtggtccgcgtctggaagctcgtcggctgctgcttcttgcttccaagtgctctgtggcgaaggggaaccggcgggagattggggctgggtggggaaaanttccaacctggggaacggttggggcgcttaacctctncgtnngccccctcggnctccaatgncaactgcaaaaaa

SEQ ID NO: 97844 - DNA, 272 bp, Triticum aestivum
  unsure (1)..(272): unsure at all n locations
  Clone ID: PAT_TA_97844
aagcaacactagttaanaccaatccaccatgaagaccttcctcgtctttgccctcctcgccgttgcggngacaagtgcaattgcgcagatggngactagatgcatccctggtttggatgagaccanggcancagcaacnattaccaccanancagatatttcnacaacaagnactattttcacaacatgcancancnatttcctcagtanccatcattttcgcaggcatcantccaccattttgggcangcaacaancnaccattttctcag

SEQ ID NO: 97845 - DNA, 317 bp, Triticum aestivum
  unsure (1)..(317): unsure at all n locations
  Clone ID: PAT_TA_97845
gtcgacatctccgacgaggacgacggcggcggcgacgaanaggagggtggtgacgatgacgacgacnacgacgacnacgatgatgacnaggaggacgacgaccaagtcgacgaggaggaggagcctgaggaggagctaggaactgaatatctggtgcagccgcttgngccgtgctnangatgataagcattcnactgnctttgannccaccngtacctggtcatggtgctnaggacnaaggagattgacggatgattactcttgnggatggtgaggattctgtcaacgcnnaatcttccttcgactngagggaacag

SEQ ID NO: 97846 - DNA, 241 bp, Triticum aestivum
  unsure (1)..(241): unsure at all n locations
  Clone ID: PAT_TA_97846
cctgagctgcgagagagaggaaagggcgaaaggcggtgtgtgttctgttcattcccttcgttcggaggcggagccgaggagacggncggcggcgaccactatgggcggcggctagggnaantcnaggaancgccnctcttccccctcctcaggggaggaanatgagaggnancggnagantacgtgggncactcattggttancaggantgagcggccgcccacncgtnggggcnatngac

SEQ ID NO: 97847 - DNA, 385 bp, Triticum aestivum
  unsure (1)..(385): unsure at all n locations
  Clone ID: PAT_TA_97847
ggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgaccgaggcaagggacttcgacctgcccctgaangaaccggttntaccttgcagccgctgccancngggggnagggcggctgtcccnggccanagggactncnccccangganaatccttaaanctnaaaggncgnctnaaccnacaa

SEQ ID NO: 97848 - DNA, 323 bp, Triticum aestivum
  unsure (1)..(323): unsure at all n locations
  Clone ID: PAT_TA_97848
ggcaaccagggtactacccaacttctccgcagcagtcaggacaatggcagcaaccaggacaagggcaacaaccaggacaagggcagcaatcaggacaagggcaacaaggtcagcagccaggacaagggcaacgaccaggacaaggacaacatngggtcctanccaatttctccgcaacagccgggacangggcancaatcaggacangggcanncagggtacttaccccannttctttgcggtaggccagnncanctggcagcaanccancgananggggtaagcaatccantgancaaggggccaaccaatggttcagcaag

SEQ ID NO: 97849 - DNA, 328 bp, Triticum aestivum
  unsure (1)..(328): unsure at all n locations
  Clone ID: PAT_TA_97849
gtgcaggatgctggattcaaagctgcaatagtgtatgacaacgaaaacagtggagttctggtttcaatggctggaagctcaagcggtattcagatatacgctgtgttcatctcaaaggtctcaggggaggtgctgaagaaattttcaggccgtactgatgtggaggtgtggataataccgacatttgagaactcancctgggcgattatggcgatttcattcatatcactgctcgccatgtctgctgttttagctnccctgttttctttgtgnagaaagacatccgaaanangggcggggaccggcctnagnaatcnaagaattcccg

SEQ ID NO: 97850 - DNA, 366 bp, Triticum aestivum
  unsure (1)..(366): unsure at all n locations
  Clone ID: PAT_TA_97850
tcgcagcggaccggaaaatctctccggcggcgccgccgccgccgccggcggcgaagcgccatcctctccggtctctcctcctcttctcttcctccgtgccttcacctgtctcgccggggcgccgcatccccgcctccgaagcaccatcccattcgcacccgcctccatagggaatcaatctctccgccgccgccgccgccgccatgctccgcctccgtggctgcatcctcgtgcggctcctctcttcccccgccanctcccantggcccccctctccaacggccccntctncggcggggccngtncgcggccccgcnnttttnccttaaaacccttangttttggnnggctggagnnanaaccttg

SEQ ID NO: 97851 - DNA, 459 bp, Triticum aestivum
  unsure (1)..(459): unsure at all n locations
  Clone ID: PAT_TA_97851
gccaaaatgggcgccgacggggcaccagctccgtccggttcgcgccccgcgcggccgccgcggnggccgactcggtgctgatcgccgcctccaccagcacggcccgcccgccggcgtacctgccatcgccctccaccaggaaggtccccgggtacgaagcagtccgcgccgcctgccattgcctcgccgcagaagcangggagcancacggacgggcacacaaggggcggctcaacttcttccagcgcgcggcggcccgccggggctcgacgccttcgagggaggggtttatccacaantgtcctgngagcgggcccancgngttgccgcnnancggccgaccccgccggttgnaaattccccgcannttcgcccccccttcggcnaagcaanggccccgtnncgcgcgcccccngngcttccggggccgcnaatcctncccctttcnantaanggggc

SEQ ID NO: 97852 - DNA, 357 bp, Triticum aestivum
  unsure (1)..(357): unsure at all n locations
  Clone ID: PAT_TA_97852
cttcaccctccaggtgctccagctcctccactgacccaccactatgccgatggacaccccgccgccgcgcggggcggcgctgtccgacgacgaccgcctcctcgtcgcccactgcgccgcgctctccttcccctccgcctcccgctccccgccctccgccgccgccgcgtcctccgcctccttccaggcgcaccacgcgtcccacccctacccctgcgccgccttcgtcttcccgcccaccttgtccgccgccggctggatgccttcctcccccgaacgccggcggtcccgcnccgtttcggggancgcgggagggtncanccccgcgntccttnccgtnggtgcgncaagcgttcc

SEQ ID NO: 97853 - DNA, 302 bp, Triticum aestivum
  unsure (1)..(302): unsure at all n locations
  Clone ID: PAT_TA_97853
gtccgtccccacacacacacgcacgcgtttgacattttccgcccaccaccgccggagggagctccagccatggccgccaagtgctacccgacggtcagcgacgagtacctggccgccgtcgccaaggccaagcgcaagctccgcggcttcatcgccgagaagaactgcgcgccccttatgctccgcctcgcgtggcactcggccgggaccttcgacgtggccancaagaccggcgggcccttcgggaacatnaantgccccgcggggctngcgcangggngccaaacgccggnctcnaaatc

SEQ ID NO: 97854 - DNA, 336 bp, Triticum aestivum
  unsure (1)..(336): unsure at all n locations
  Clone ID: PAT_TA_97854
cacactctctcancatntnagccacatnntcacacaagcactaccttcanatagccancctcagccactccgggcattttcttgcatccacgactggcaatggccaccgctgatgtccanaacccgacgggacgctgctgacggatcgaggcgcccttcggtgntgacgccgcgtggtcgccgaggatcgctcccgagagactggatcgaggtccccngcgccngaagttgccgnagtccatgtggttgaccncggttcgnggttgatgttnacaaaggaggaggctccgggnacgccncttaagacggngggnngccaanggagnccnagccaat

SEQ ID NO: 97855 - DNA, 341 bp, Triticum aestivum
  unsure (1)..(341): unsure at all n locations
  Clone ID: PAT_TA_97855
ncatcgccatcgccaanatgcaagtcgaccccggataacaagtaaaatggacacaacancanccattcccccagccccancaaccattctgccagcaaccacaacaaactattccccaaccccatcaaacgttccaccatcaaccacagnanacatacccccatcanccanaacancantttccccaggacccangnaaccacancaaccatttccccagccccaacaancattcccccancaacccnaactatccatttccccancaattcnaagcanccatttccnccaagnctcaacaatgtccaacaacaattttncccaggtcaaaagcaattcaa

SEQ ID NO: 97856 - DNA, 284 bp, Triticum aestivum
  unsure (1)..(284): unsure at all n locations
  Clone ID: PAT_TA_97856
tgaccacccacccacctaccagccaccaaggcggccgatctcccctccccagccgcgccaccgccgacgccgcatctccggcagccgttcgtctcgagattgatctttggtgactgttagaagccacagacactgaagatggcgcagcctgctgagctttcccgcgaggagaatgtgtacatggccaagcttgcanagcaggctgagaggtacgaggagatggtttgagttcatggnagaaggtggccaagacagttnactccganngagctcacagtcgaagg

SEQ ID NO: 97857 - DNA, 427 bp, Triticum aestivum
  unsure (1)..(427): unsure at all n locations
  Clone ID: PAT_TA_97857
atcatttaagccaagcaagcagtgctcaatacaaatccaccatgaagacctttctcatccttgccctccttgctattgtagcaaccaccgccacaattgcagttagagttccagtgccacaattgcagccacaaaatccatctcagcaacaaccacaagagcaagttccattggtacaacaacaacaatttccagggcagcaacaaccatttccaccacaacagccatatccgcagccgcaaccatttccatcacaacaaccatatctgcaagctgcaaccatttccgcagccgcaactaccatatccgcaagccggcaactaccatatcccgcaagccggnanccnatttcgaccannaccaaaccaatntccaacaatcgcnaacccaacaggnnttcgccaacccaacaaccaacccaatttcc

SEQ ID NO: 97858 - DNA, 475 bp, Triticum aestivum
  unsure (1)..(475): unsure at all n locations
  Clone ID: PAT_TA_97858
aagaagatgggtttgaagaacaacatggtggtgctaaaggtgtgtttggtgctacttttccttgtggggggtactactagtgccagcttgaggctgagtgagcttggcctgctcatgaaaagtgatcatcatcaacactcaaatgatgatgagtcttcaaaaccatgctgtgatcaatgcgcatgcacaaagtcaaaccctcctcaatgccgctgttcagatatgaggctgaattcgtgccattcagcttgcaaatcttgtatttgcgcattatcgtatcctgcacaagtgtttttgtgttgacataaccgatttctgctatgaaccttgcaagcccaatngaggatgacaaggaaaactactaatgaaacaaagtgttatgcaagttaagctctctctccaatggacaaaagcccccctttaagcctttgtttggtangttaaggaatgactnaattaaactttggaataaaac

SEQ ID NO: 97859 - DNA, 485 bp, Triticum aestivum
  unsure (1)..(485): unsure at all n locations
  Clone ID: PAT_TA_97859
ccgaacccctagctcaccgccgccggcgcccctccgtctcacgcgtcgccggcgcctctacgccgcacgcagcgcctccgcctctccctcttgcgtcgtcgccgcctttccatgttgccatacgccgtcgcctctccctcttcaagatttaatttttactccggcggctggatctgaagcgcagctgctccaccttcctcagggtggcggggatctccggcgcttggatctgaagcgcagctgctccaccttcctcagggtggcggggatctccggctcgctgcgcaggggaagggcccgacccgccggcggccgctgcgggcaaaangggaactgcgtcggcgacatcgtcggngtcgggcgtcccaaaggaaaaggggcaacggngggaacgcaactggcgggcccaatgcaaaangcaaaaccgtngccgttgccggtcgtccggccagcngcgnccgcttggncganaaggaagnnagcca

SEQ ID NO: 97860 - DNA, 487 bp, Triticum aestivum
  unsure (1)..(487): unsure at all n locations
  Clone ID: PAT_TA_97860
gcgatctcaccgagaaaatcctcgaccgaccgaacgacaaggccctctcatcctcctcctccaagatgcagatcttcgtgaagactctcaccgtcaagaccatcacccttgaggtcgagtcgtctgacacgatcaacaatgtcaaggccaagatccaggacaaggagggaatccctccggaccagcagcgcctcatctttgctggcaagcagctagaggatggccgcaccctggctgactacaacatccaagaaggagtccaccctccacctggtgctccgcctccgcggaggcatgcanatttttgtcaaagaccctcaccgggaaagaccatcaccttgggggtggggtcctcggggcaacaaccnacaattgtgaaaggngaaanattcaaggacaaagggngggaanttccccccggaccaaacaangtccggaattttttgccgggaaagcaactccnaaggaatgggcgncaacantgggt

SEQ ID NO: 97861 - DNA, 468 bp, Triticum aestivum
  Clone ID: PAT_TA_97861
cccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagattccgtggggtgaggctggtgccgattacgttgtggagtccaccggtgtcttcactgacaagggacaagggcgctgctcaatttgaagggtggtgcaagaaggtgggtcaatctctgccccaagcaaaagatgcccctatgtttgtgggtggggtcaacgaagga

SEQ ID NO: 97862 - DNA, 480 bp, Triticum aestivum
  unsure (1)..(480): unsure at all n locations
  Clone ID: PAT_TA_97862
ggagcggaaccaacaaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccagcagcgtctcatcttcgctggcaagcagctggaggatggccgtaccctcgctgactacaacatccagaaggagtccaccctccaccttgtcctgcgtctgcgtggtgggcatgcaagatattcgtgaagaccctcactggcaagaccatcaccctgggaggtcgaagagctccgacaccatttgacaacgtcaaaggcaagatcaaaggacaaaggagggcattcccccggaccaagcaagcgncntaatctttgctgggcaagcaacttggagggattgggccc

SEQ ID NO: 97863 - DNA, 357 bp, Triticum aestivum
  unsure (1)..(357): unsure at all n locations
  Clone ID: PAT_TA_97863
cggaaccgtagacgaagcctcggacggaacgatacaganaancctcggaaggggagcgatcgggaacatcntgagcgtgaacaacaggttcgagaagggtgacgagctcanggggcaactgaagaggctggtacaggccggtgtggatggtgtcacggcataacctcnggtggggcttngttggagggcaagggncccaagggtntacantggtccncccnacaancaattntttnnactggtgcannaagctggncctgaanttnnaaagccatnaagtcattncnacaatnttggtgggnaaacgtcncgttaanctnctcaaanaanccccatttccgcanattgttncgntaa

SEQ ID NO: 97864 - DNA, 483 bp, Triticum aestivum
  unsure (1)..(483): unsure at all n locations
  Clone ID: PAT_TA_97864
gttaacaccaatccaccatgaagaccttcctcatctttgctctcctcgccattgtggcgacaagtgccattgcacaaatggagaatagccacatccctggtttggagagaccatcgcagcaacaaccattaccaccacaacaaacattatcgcaccaccaacaacaacaacccatccaacaacaaccacaaccattttcacaacagcaaccatgttcacagcaacaacaacaaccattatcgcagcaacaacaaccaccattttcacaacaacaaccaccattttcgcagcaacaancaacaaccattatcgcaggcaacaacaaccaccattttcacaacnacaaaccaccattttcggcagcaancancaanaaccaccatttncacangcagcangcagncagncactanaaacatccaaccatttncncagggacacaagnaacccaccggttttcacaancnagncacccaatttttc

SEQ ID NO: 97865 - DNA, 491 bp, Triticum aestivum
  unsure (1)..(491): unsure at all n locations
  Clone ID: PAT_TA_97865
cctcagtcctcacagcatcctctcagtccttagcttccttccctcgccgccacccaccaaggaaaggaggatgtcttgctgcggcggcaactgcgggtgcggctccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcacccgcgtgcggctgctcctgctgcagcttgcaactgagccggcgcccaaggaggccgggccggcaaaggcgaagcacgaaggatnaggagggacaangcangcaaagcaccatcaaccaccangttcaancnnccacccangcgttatcatnaacaancccgcccnnattgcgnctccncgggccccgccgccccttaattaaaataaaaaan

SEQ ID NO: 97866 - DNA, 450 bp, Triticum aestivum
  Clone ID: PAT_TA_97866
aattaacttctttttctgtggaacagctttcagtgaaaacttaaagatgaagagtttccttctcgtcgcattattggcagtcgctgcagctgcatcagtaatcaccaatgaagcacccgaagagcctgaggttctggagatcccagaggggctcgaggtggctgatgtagacgaagtggctgggatgtccgagttagcggtaatcaccagtatggttaaggatgaagctgaaataccatggcagcctagcttcgccccgcgtcgtggcttgagcgtgggaaatattggttcagctgacagacttatgtcaaggaccacgcactcaagaatggctgttgcgaaccaaatcttgactcaagacgtgacctaccgaggcagtgcctccactatcatcacagccatcagggttcaagtcataggttcctcccagggggctacgggttcagtggg

SEQ ID NO: 97867 - DNA, 450 bp, Triticum aestivum
  unsure (1)..(450): unsure at all n locations
  Clone ID: PAT_TA_97867
cgactctctggacgcggacgtgatccagtcgtacatggagttctcgctcgcatccatgttgttctacgcgctgaaggaaggcgcctgctccgagcagtcgtcccgcatgacggccatggacaacgcctccaagaacgccggcgagatgatcgacaagctcaccctcaccttcaaccgcacgcgccaggccgtcatcacccgagaacttattgagatcatctccggtgctgccgccctcgagtaataacattcgcactcgttttgctgagacatctcgtggttttgtaattttttgtttatttacagtgaaattcgcttattatatgcaaatattaacaaaggtaaagctttgtaaaataaagatttatcaaaaacgaattttactggaaaaaaaatataacaattttggggcatttatccgatnaagttttggaaacttaatccggggga

SEQ ID NO: 97868 - DNA, 486 bp, Triticum aestivum
  unsure (1)..(486): unsure at all n locations
  Clone ID: PAT_TA_97868
gcaacaccatgaattctgccgaaggaaccaacctcgtagcaacgtactgcatcttgttgctgctgcttgtgtcactatggctcatgtattcagcattctaaggacgaaatgtaagtaaagtgtaaaagatcaagcttccagctttggattcgtgactgcgtgtactaaaatgtgtgactgtgaactgtgacgtcgtatcaaaaataacactgaaatcattgctgcggttattacataatatgtgagatttctaaagtttcatatgaagtgtattccgttctaattaattatccttattatttctaatgggagtccttgtattcttcacaaaatactgattccaattanggtgggataattttccgcctcaangattgggcccgattgggttgaaggaananaatgganggaatttgatttaagtaattttttggatgcaagntcaaatttngtaattttaaacccccttttggttttaananaaan

SEQ ID NO: 97869 - DNA, 452 bp, Triticum aestivum
  unsure (1)..(452): unsure at all n locations
  Clone ID: PAT_TA_97869
ggcgcttgtgacgttggctgcatttaactttgatattaaaaagtttatatttacattgaaaataaatcgtcatcgacgaagactacgacgatgacgacgcctgcgaagctgtacggacgagagctgtccacctacgacgaggtggacgtcgacgagctgctagccaagctgtcgcaggaagaacttacaatgctggcaaaggaggttgatccaagatgacaacttcctgccaccatcacaacgcaacaattatgactgcgagaaggatcccacggggcccctgaaccgcaagaagctaatagaacacattaacaaacaggccttggngacaccaaaccggncggggatcaagccttatgtcnctggagttgtacgggggaaaaantggattccgccgccggggccnganaaagtgcgcgacncggaggagcaaatttccatcgaactcgggg

SEQ ID NO: 97870 - DNA, 375 bp, Triticum aestivum
  Clone ID: PAT_TA_97870
gcgttttgcaaagtattatctaaaacctaatactttaattatttcaaaataatggatcaaatcgcgaagttcgtagagcctggcaagcagttcgccaaggactccatcagactggtgaggagatgcaccaaaccagacaggaaagaattccaaaagatcgccattgccacagccatcggtttctgcatcatgggcttcattggattcttcgtaaaactgatacacatccctatcaacaacatcattgtcggatcatagactgcctagtataagttttagacttaattctacatttaagacctccaacaactctataagttatctgtcgtaaatttcatttataattgtttcttaaaaaaataaattattccataa

SEQ ID NO: 97871 - DNA, 452 bp, Triticum aestivum
  unsure (1)..(452): unsure at all n locations
  Clone ID: PAT_TA_97871
gtgctcccgagatcacgaaattactctaaatctcctgatttaaaattcaggggttcgtgtttcgtgatttattccattccgtgtgtgtacctagattccacctcgacccgcgaggtaattaccaagtgagcacccacctaatcgaacaaaatgtcgaacctcgctgatccggtcgcgttcgcgaaagatttcctcgctggcggtatctccgccgcggtctccaagactgccgtggcacccatcgagcgtgtcaagctgctgctccaggtccaagcacgtcaagcaaacagatngccgccgaccagcgctacaagggtatcatcgatgccttcgtccgcattcccaaggagcanggtcccctgtccttctggcgtgggaacctccccaacgtcatcaagtacttccccaaccaagcgctgaacttcgccnttaagggaaagtacaaagcaagt

SEQ ID NO: 97872 - DNA, 452 bp, Triticum aestivum
  unsure (1)..(452): unsure at all n locations
  Clone ID: PAT_TA_97872
attaattgattaatttcatttattttttttattacaatttacttaatttttaatattataaattattatatttttaataataaaaatattaataaaaataataattttaaaaataaaattaaaaatctcaattgaaaatgataagtaatttattttcaatttttgatccctctactaatttatttaatatcccatttaattgaattagaacaattttaggaattatatttattccttattcattttgattaattcctaaccgacattttttattatgaaattttattttattaaaattacataatgaatttaaaacattattaaaaaataactattttcaaaggatnaacttttatttttaattcaaatatttacttttaacctaattaaaaaatttttagggncattccccttaaattttcacaaggnactangtcnntttacantaacct

SEQ ID NO: 97873 - DNA, 449 bp, Triticum aestivum
  unsure (1)..(449): unsure at all n locations
  Clone ID: PAT_TA_97873
gcggcgcgcgctccgtccgccgcctacatccacctcacgctcgcgttacgtaaatcaccagcatgccggactcagggccctccctctgcagtgtcctcaacccgatggagtcgctgatctactggcggtcggcggcgcacagcggggcggcgctgggcgcggggctggcgctgctggtagcgctggcgtgctgctccgtggtgtcggtgctggcctacgcctcgctgctggcgctgtccgccgccgtcgccttccgcatctacaagaacgtgctacaagccgtacagaagactaatgatggacaccccttcaaatggctgctggagcgcgacatcagcgtgccggcggagcgcgcgcantcgctggcgggcgccgccaacgcgcaactcaacgccgcgctcgccgagctgcgcaagttattcctggtggaggacctggtggactcgctt

SEQ ID NO: 97874 - DNA, 455 bp, Triticum aestivum
  unsure (1)..(455): unsure at all n locations
  Clone ID: PAT_TA_97874
gtttatgtaaagacgttgtaaggacgtcatgcctttcgcacggtttgtagaaccagggcgtgttgccctggtggcagacggtcccttgaagggaaagttagtgagcgtggtcgacgttattgaccagactcgcgctctcgtcgacgggccttgcagcggcgtctcacgtcaacagctccgcctcaaccaactgcatctcaccaagttccgtctcagctacccattcacagcacccacacgcgtcgtgaggaaagcatggacagacgctaagctgaccgaaaagtggacagaaagccaatgggccaccaagctccgccaacaaagagaagcgtgcacaaattaccgactatgaacgtttcaaagctgtcgtccgctcgcgtcaagaggaaacgcgcgagaacggcagtgttcaagaagcttgaaggcgaaagggaacccgctncggttccttcggg

SEQ ID NO: 97875 - DNA, 444 bp, Triticum aestivum
  unsure (1)..(444): unsure at all n locations
  Clone ID: PAT_TA_97875
cattatctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccagttgctgatatgtcattcctccggtcacaggtggtgcaacatagcagctgcttggtaatgtgggagcagtgctgtcagcaactaaaagcgatccccaagcaagtcaaagatgcgaggccatccacaacgttgtgcacgccattattttgcaacaacaacaacnantggtacaaagctactttcaacccaacctcaagaagcaagnaacaacnaagggt

SEQ ID NO: 97876 - DNA, 473 bp, Triticum aestivum
  unsure (1)..(473): unsure at all n locations
  Clone ID: PAT_TA_97876
cccaatctcgcacacctctcggagctaggcggagcggcgatgtcggggcgcggcaagggcggcaaggggctgggcaagggcggcgccaagcgccaccggaaggtgctccgcgacaacatccagggcatcaccaagccggcgatccggaggctggccaggaggggcggcgtgaagcgcatctccggcctcatctacgaggagacacgcggcgtgctcaagatcttcctcgagaacgtcatccgcgacgccgtcacctacacagagcacgcccgccgcaagaccgtcaccgccatggacgtcgtctacgcgctcaagcgccaaggccgcaacctctacggcttcggaggctagatcgtgggttccgcgggtggcggtancggtattgggactgtggtctgtcgtgtgtcctctgttaatgttttgctgtgggaagatgggaatttgctaccgccntttggccttccgtccttttn

SEQ ID NO: 97877 - DNA, 462 bp, Triticum aestivum
  unsure (1)..(462): unsure at all n locations
  Clone ID: PAT_TA_97877
atcgtcattgtggtgaataaaatctaattcgtctgagactctacatattaaagcaatatggctttaccccgagtttatttcgacgtcagcgctgacggttctgctttgggaagaatcgttgttgagcttagaacagatgtcactcccaagacctgtgagaacttccgcgccttgtgtaccggcgagaagggcttcggttacaagggctccactttccaccgagtgatccccaacttcatgttgcaagggggtgacttcacaaaccacaatggcactggtggcaagtccatctacggcgaagaagttccgctgacgagaacttcgtccctgaagcacaccggnccctgggtgtcctgtcgatggccaatgctgggtccaacaccaatgggatnccagttcttcatcancaaccgtgaanacctccctggcttggacgggaaggnancgntgtttnccggaant

SEQ ID NO: 97878 - DNA, 388 bp, Triticum aestivum
  Clone ID: PAT_TA_97878
attgcaattacataagattgaataaccgcaactgctgactctaaaattaataataaaatttgaattaaaataagaattataataaaatatgatcttatattaggtccatttcctcttaataaggttattaataagtgtcctgcaattatattagctgttaatcgcacagctaaagttccaggtcgaataatatttctaatagtttcaattaatactataaatggtattagaatagtaggtgttccttgaggaattatatgaataaatatatgttgagaattgtttaatcaaccataaattataaaacttaatcataatggtagggaaattgataaagataatgttaaatgactaagttcttgtgaaaatataagggaataagccctaa

SEQ ID NO: 97879 - DNA, 205 bp, Triticum aestivum
  unsure (1)..(205): unsure at all n locations
  Clone ID: PAT_TA_97879
atcgactcggagagcgagacggacccgctgtggctgcagcagaagacgatgatgatgatcgacgagttcaccgacgtcaatgagggagagaangagntcatgtagatntgnnacttgcacgtcatgaagtacaactacntgggcgactgtcagntccccatcgcntgtcaantgttcctacacatgctaggaaagganttgttac

SEQ ID NO: 97880 - DNA, 454 bp, Triticum aestivum
  unsure (1)..(454): unsure at all n locations
  Clone ID: PAT_TA_97880
gcaacctgagaaatccgggtcctccgggtccaaaccagctgagaagaagcctgctacggctaaaacccctgcagctgcgcctaaagctgcatctactagctctgctgctgcgcctaagccagcgtcagccaagacgccagcacctgctcccaaggcagctgcacccaaagcggcgccagcggccaagcccgctgctgccaagccaagcatccgccccggcggctaagcctgcagcaagctgcttccaagcctgcagagaaaaagccggcatcagtgcctactgccaaacctggctctgctaaggnagctgccctgaaagcgaagtctantgctaaaccttcaagtgaaaaaagctgcaactgcttccaaacctaaacctaaaccancancggntaaattgaaaattngaccccaacccaanaaaactggnaacaaagggnaaaagaaacaaatt

SEQ ID NO: 97881 - DNA, 430 bp, Triticum aestivum
  unsure (1)..(430): unsure at all n locations
  Clone ID: PAT_TA_97881
gagagaagagagagagaactagtctcgagtcaagatagtgtgcgtaattaaagggttaccatggttaagtgaaacaagtattttggtttcctatgtcgatattttgatattaatactgattaacaagttggttccccttgatggatcacatgggactattagttgtaagtttaaaataaaaacatctaattaaaatgctcgcatttatttggtaaatattggcagattgtaaaaacatgcaacaaactataccaaacagtatacaaagatttttgcatgtatcatgtgatttcagtcagatggcattatgatatgtaaattgattatttataaatttatataaaggaagttgattgaagttcaagaagacataaatactttagttgcttttgtcataaaattatncgaaaataaagtcattcatccggga

SEQ ID NO: 97882 - DNA, 447 bp, Triticum aestivum
  unsure (1)..(447): unsure at all n locations
  Clone ID: PAT_TA_97882
gctcagtctccctttgttttaatattaattgtgaaattcggtaactgaaataaaaccgaaatggcgactgaaactttaatcccattagaatcgaaccctgaggttatgaataagtttttgcagaaattgggagtgtctagtcaatggggtatcgtagacgtcatgggcttagagcctgaaatgctgtcttgggtaccccgtcccgtgctctctgtcatgttgctcttcccggtttccgatgcttacgaggaacataaacaaaaggaagagagcgatattctatccaaggggcaagaagtttctagtaatattttctatatnaaacagtttataagcaatgcctgcggcactgttgcacttgtgcaaagtgttgccaataacactgaataaattgaactggctgaaggacacatgaagaaattcctaaattaagncaaagatatgggg

SEQ ID NO: 97883 - DNA, 454 bp, Triticum aestivum
  unsure (1)..(454): unsure at all n locations
  Clone ID: PAT_TA_97883
caaagacgattaaaaagtgtcgataagccaatattctgcagaaattagccacaatcttcaggtatctacaaaatataataaataacaccctcgcatgtgagggtactatgtggtggtgctgtacttcttccgctagttcaggaccgatggctgcgatacgcaaaaaattagtgatcgtcggtgacggtgcgtgtggtaaaacatgcctgctcatcgtattcagcaaagatcagtttccggaagtgtacgtgccgactgtgttcgaaaactacgtcgccgacatcgaggtggacggcaagcaggttgagctcgcgctgtgggatacgggcggccaggaagactacgacaggttgaggnccgctgtcgtacccgacactgactgatcctcatgtgcttctcgggttggactcgccccgactccctcgaagaacatccccgggagaangtggacnac

SEQ ID NO: 97884 - DNA, 454 bp, Triticum aestivum
  unsure (1)..(454): unsure at all n locations
  Clone ID: PAT_TA_97884
gcagtcatcattagtgtcatttagccaaattatttgaattctggactccttccttttttccaattaataatctactgtaaaatggctgtgccgatccggaatttatcacggtttaaagatgtgttgaagctaggttctgtctcagtcagatactcatcagaatatgctagcactaatactaatttactgctgaccaaagacactaaagtcatcatacagggatttactgggaagcagggtacattccatgctcagcaagcaattgaatatggcacaaacattgttggtggagtatcaccaaagaaggcaggcaaagaacatctgggcaaaccggtgtttggaactgtgagggaagcgatggctgcaactggtgctactgctacagccatctaagttaccccaagggtggatctgnctcaagctgtcttanaaagccattgaagctgaaatgccc

SEQ ID NO: 97885 - DNA, 454 bp, Triticum aestivum
  unsure (1)..(454): unsure at all n locations
  Clone ID: PAT_TA_97885
gttttgttagctttatcaataaatagcttaattggtttttaactttcataacttaaacattttagtatttatacttagattatttaagattataagtgtgccgaaaatagttaactcgcgtattagtatttattaggacataacctctaaattaagtgccgataaaatgacaaccacggaagagaacgccgaaattgactggggaaatgaaaggttaagccgagcccaacgtgcagtggaagctaacacctacgatgtggactcatggtccctcctcatccgggaaagctcaaacgaggcccatcaacgaagtccggnctatgtatgagaagttaatcactgcattcccaactacagggcggtactgggnagatatatattgaacaaggagatgaaagcaaggaatttcgaaaaagtgggaaaagttgttccagcgctgtttaatgaaaatccn

SEQ ID NO: 97886 - DNA, 448 bp, Triticum aestivum
  Clone ID: PAT_TA_97886
aacacgtattttttaagattattttgatttttgtctaattttgaaaccacaatgagtattcagatcaatgacggtggtataagcgttgtagatgacaatgagggtggagtcaacatagctgaaggcgatgactccaggctccaaatcgtagacgacaacggtggaggcgtcaactttcccgacggcgaccaaggtggagtgcagttttccgacggcgaccaaagtggggtacaattttccgacggcgaccaaactggggtgcaattttccgacggcgaccagactggggtgcaatttgctgattgattagttgtgggtgccacgcctcttcaagactaatttaatttgaataagggctgatttttcaatcgtcagacaacttttacctgtagaatatttattagtttgacgttttgacaggtttttttgtatagaaaatatgtcaaac

SEQ ID NO: 97887 - DNA, 460 bp, Triticum aestivum
  unsure (1)..(460): unsure at all n locations
  Clone ID: PAT_TA_97887
gagagagagagagagagagaactagtctcgagttttttttttttttttttattagtattgtgaaagaattttgaaataattgaaaatttaaattatttaaaagtaattttaatttattgtatcttgtgtatcagagtttattaataaattttaanagttaataatttctcgaatttaaaagagataattaattataaaagttattgtancaaaaatattttaantaattaattggaaatgaaatgttantcgtttttaaacgatatcctagtttttttagaaaaaaatttaattttacattantatataaaattaattaactaattaataattttatataanaatttnataattttaagggganaangctttanattaaattttatataaaattatttnaaannaaattattggaaattanactaactttaacaattgntaaanaaattttaanttantg

SEQ ID NO: 97888 - DNA, 449 bp, Triticum aestivum
  unsure (1)..(449): unsure at all n locations
  Clone ID: PAT_TA_97888
atcgcacgtgaacgtgtcgcaaaaatctcaataaattagtgaaatcaccatgtcggacgaatatttctacggtgtaaccttgtcgacgtcacatcagtctgagacatgggacccagaggcaaaggcggactacccccgcagcaacaagctgctcatacgtcaagcactgttgggtcccgacgccaaggctgacgaactcaacgttgttcaggttgaaacaatgtcacttcaagaggcagtcaagatccccgtggcagtcctgaaggcaggagaatcaagacatgcacgtcttgacattgagttcccagatgccccantcacattcactcttattcaaggatnagggccggtgcatttgattggtcaacaactggttggtgcccttgttgagggagtttgaanatattgaagaaatggaggaagagatgtttttacccggggaaggggnt

SEQ ID NO: 97889 - DNA, 461 bp, Triticum aestivum
  unsure (1)..(461): unsure at all n locations
  Clone ID: PAT_TA_97889
gccgagcggaacagtctctccttcgtcgatcgtccaacacacaacacaatggcggataaagataagaaagtaaagaagaagaaggcaaaggaagatgcaccagcagaagaggcgccagctgcagctgcgcccgccgccactggtggcagcgacaggcagtcgtcgcgtggaagccgcaaggccaagcgcaccggctccaatgtcttctccatgttctcacagaagcaggtcgctgagttcaaggaggccttccagctaatgggaccacgacaagggatggcatcatcggcaagaacgattctgcgcgccaccttcgactcgctcgggaggctggcgtcggagaaagagctccgacganatggtcggttgagggnctctggncccatcaactttaaccaactccctgaacctccttcgcgaaaccgcaagtccgggcggttccnaacaagggacgacgtttt

SEQ ID NO: 97890 - DNA, 458 bp, Triticum aestivum
  unsure (1)..(458): unsure at all n locations
  Clone ID: PAT_TA_97890
gagagagagaactagtcaagtgtagttttattttaagtcgaactcaatcaaaatgagctggcaagattatgtcgataaacagttaatggcatccagatgtgtgacaaaagctgcgattgccggtcacgatgggaatgtctgggccaagtcagaaggcttcgaaatatcaaaagatgaagtcgcgaagatggtggccggtttcgacaatgaatcactgttaacgagcggtggcctgacgatagcgggtacgcgatacatctacctcagtggctcaagaccgcatcatacgcgcaaaactcggcaaggtcggggtgcactgcatgaagacacaacaagccgtccgtaatttctctgtatgaagaacccatccaaccccagcaagccgcatccgtnagtggagaagttagggagactatttaattncctgtggntattaagagattcaagcgcgcccgtgt

SEQ ID NO: 97891 - DNA, 452 bp, Triticum aestivum
  unsure (1)..(452): unsure at all n locations
  Clone ID: PAT_TA_97891
aatgagtaaagggaaatgaagagtttcgtagagtaccgtttatagagctgtgactattctaagttttgatcacaagaattaattgaaattattaataaacttaagaaactaataactaatattaaagggaagcaattcttcgttttgttataccttgaaaggcttgtagatagttttattgatattgtttgaattgatgtgttccaatttatttgaggaaacgtttattgtaacgttttatcgaacaatacttccttgttgtgactccaagtttttagatgtttactatatcattttggagtattttaagatttgagccacgtgccatatcttgttaagaatgatcccaaattatttatttctgaatttgctcaacgtttttcaaagacactatttaataaatatatatttaagggagngggaataaggaatgtaataaatagggatangaa

SEQ ID NO: 97892 - DNA, 404 bp, Triticum aestivum
  unsure (1)..(404): unsure at all n locations
  Clone ID: PAT_TA_97892
gtccccgtctcctctctcctttccccaacccaaaccaggagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccncgaggagttcaagcanaanaaccccaannaacaagtccgtcgccgccgtcggcaaaagcggtcgggtgagaggtggaaagagcttnatntnaatctgagaagggcccctacgtttgcnaaagggcaacangctcaagggncga

SEQ ID NO: 97893 - DNA, 493 bp, Triticum aestivum
  unsure (1)..(493): unsure at all n locations
  Clone ID: PAT_TA_97893
ctccgtcgattgtggacctgcaccaagccgtgccgcggagaaaggaccgacaccaagtgcctcttgcgacatcgccctctacaacacaaacatgaagatcctccccctgtttatactggtagcttgcgtggtgtgctcggcccgcggtcaggacgaggagcggccagctgcaccgtcgcggggcctgctgaagcggggctcgctggctaaaggcaaacccaccaccaccacgaccacacctgctcctcaggaggaagctgaatacgaagatgaaggtgactacccagctgagggtgaagcaagcaggaggcctcgaccgaagctccctcgtccaccaccgaagggaagaaagctngtccngnaacgggcgtcanggcctttcaagaaagcnacaacttaaactccctggagattccttaaaganaaaaaagangggctcaaaggcctgctnaaangccaaaanttgaaacggctncctttcnaacaangaana

SEQ ID NO: 97894 - DNA, 454 bp, Triticum aestivum
  Clone ID: PAT_TA_97894
attagtgcaaaaaagacgtgtttcatgtgttactgaaaatatttgctaatcagaatggcagctgaagtcaagcaaagggtcgtcaaagacagcaaaaatgaagaaaagactgaatcaggaaataatacaaagccaaaatactgggaacctctaacagatggagttaaatggattgagaaatatgcttctaatcttgagaatttcttcgaaagactgcccgaattcatcagtaccttcatagcaacactagctgtattcacatttggagctactttaagaggagaatgggtggtaatattagtggcaagcgctgaagcagctgagcggtcacacacaaaacaatacaaatgtgacgacaaatgtactggatttgttttcgtccaaaaacctgaagatggggaacttcaaccccatcttcaatgggggcacaatactggttccttcgccatgtctt

SEQ ID NO: 97895 - DNA, 451 bp, Triticum aestivum
  unsure (1)..(451): unsure at all n locations
  Clone ID: PAT_TA_97895
aattttggtcgcattttttcgagataaaaaatcaataaaatcaagatgttcgctgccaggagccttttcaaagccaatgcccaaatccttaaaaatgtggctcagactaggaacatgagcgtgatcgctactcccgctagaaacaaggtttcaactggagagatggtcttcctcatcagcgcaatggtcgtcggctggtctgccatccccgcctgggtccttatcaacatcaagaactacagggtcaaggaataaatgccacaattacaaactcttaagcctaagttcactaaaattataaactttcgtttacataaaccaatagtttaatacgaatttttgacgttcaattttcaaagtaaacgggggnttaaaaaatgggtgtttaatttggtaggtgaagttngggcgtttngcaattccattggtagaaacaagggtggtaacantt

SEQ ID NO: 97896 - DNA, 274 bp, Triticum aestivum
  Clone ID: PAT_TA_97896
gagagagagagagagaactagtctcagttttttttttttttttttgtaatataaaatatacaatttactaaagagattgttgagtaattttagcgaataatcgaataattattcgagatctgaaagcaaaatgtataagaaaaacaaagctttattgctattcttgttgacgaaactgttttgctaaattatgtagatactttaataaattgtatattttatattacaaaaaaaaaaaaaaaaaaaaaaaaaaaaaaaaaaaaaaaaaaaaaaa

SEQ ID NO: 97897 - DNA, 453 bp, Triticum aestivum
  unsure (1)..(453): unsure at all n locations
  Clone ID: PAT_TA_97897
cgaacatgtacgacgcaatcggtaacagctcgcccgcgaggaaatatcataatataatagtgctatagcaaatggttgatacggaaacgctaatattatgttaaagttaagacactaaataatcgtcaactaccggtgttgtggagtgtttgtttataaggtgtgtttttaccaatcaacaagatgagcgcccctataatcatcacggtgcccaacaactacctggccatggagtcggtcgaggagctggactcgaaggtggtggtggagctgccttcacctgcgccctccaagaagcgccgcctggaccacttaacaagggagggagaaaatgcaaagaaagaaactgaagaaccgcgtaacggntcaaacttcncgcgaaanaaagaangngaaaatggatnaaatgggaaagtccgntnaaatncttaagggcaatgaacgaacnggtgn

SEQ ID NO: 97898 - DNA, 452 bp, Triticum aestivum
  unsure (1)..(452): unsure at all n locations
  Clone ID: PAT_TA_97898
ccatatttgtctgtgcaaaagtagttccgtggagtgagtgtgtgcagatagtcatcacagtttttgggacctgtaaatactccctcaataaacctacaaaatggccgaaaatccaatctacggacccttctttggagttatgggggcggcgtctgctatcatctttagcgcgctgggagctgcctatggaactgccaagtcaggcaccggtatcgccgccatgtcggtgatgcggcctgagctcatcatgaagtccatcattcccgtcgtcatggcgggtatcattgccatctacggtctcgtagtggctgtcctgattgcgggttcgttggacgccccctccaacaactacaccctttacaaagggttcatccaccttggcgcttggtctcgccgtaagtttctccggtctaacgggctggtttcgccatagggatccttnggtgattcna

SEQ ID NO: 97899 - DNA, 402 bp, Triticum aestivum
  unsure (1)..(402): unsure at all n locations
  Clone ID: PAT_TA_97899
gagagagagagagagagaactagtctcgcaaacgccgtaatggaggacgggctaagcacggccgtggacacgtgaaagccgtcagatgcaccaattgcgcgcgatgcgtgcctaaggacaaggcaatcaaaaagttcgtgatcagaaatatcgtcgaagcggccgcggtcagggatatcaacgaagcatccgtatatgcatcattccagctgcctaagctgtatgcaaagctccactactgcgtgtcctgcgctatccacagcaaagtagtgcgcaacaggtccaagaagaacaggaggatccgtaccccacccaagaagcactttccctagggacatgcagcgccctcagaatgtgcaaaggaagtgaggtgtttantannaaaacataagaaaatccact

SEQ ID NO: 97900 - DNA, 281 bp, Triticum aestivum
  unsure (1)..(281): unsure at all n locations
  Clone ID: PAT_TA_97900
agagagagagagagagagaactagtcgttcgttaagtgatgtacaggcggcagatggcgccagcgcttgcgacacccgtgctcgctggcgccctctgtccgccgtcggcgagtcgggacgggcgctcggcgctacggttcgccctaacgttgccgtgtctccgcactactccggccaaacgccgaccgctcgtcccaacggacgtttttaatgtnacgctnattcaaccaaatanaggaaccaaanactttacagctttttttttcaatatttttctatta

SEQ ID NO: 97901 - DNA, 350 bp, Triticum aestivum
  Clone ID: PAT_TA_97901
cgcatattctattcagtgcaattcagtgcaaagtttattcatctattataagtaaaaatgggtcttctggcagcaattgctgttaatgttgtgggaggtgccgtcatttacggcaccggtggtctcctggcccctgtggtggcgccaatgctgggcttcggcagtgccggcatagcagcaggctccaccgctgccgccgctcaggcgtactacggcaatcttgccgcaggctccatcatatcgcagctcactgctgctgctatggtggcacccacaccataatttcgcatcatcgacattgcatttataacaatgtgattgtaatgctgaaataaaatattttgaacgtt

SEQ ID NO: 97902 - DNA, 453 bp, Triticum aestivum
  Clone ID: PAT_TA_97902
gctcgataacttgagggcgaggttctctgccggctacatctacacatatgttggctccatattaatagcactcaacccgttcaagttttacccgatctacaatccgaaatatgtgaagttatatcagaacaaacggataggagggtccagtcttcctcctcacatatttgcagttgccgacgccgcatatcattgtatgctccgagagcgaactaatcaatgcatagtaatcagtggagagagtggatcaggaaagactgagagtacgaattttcttctacatcatctgacagcgctgagtcaaaagggctctcatggtagtggtgtggaacaaacaatattgagtgctggtccaagtgttagaagcattcggtaacgcgaaaactgcccataacaataattcaagtcggtttggcaagttcatccaagttaattacaaaggagaatgggatg

SEQ ID NO: 97903 - DNA, 306 bp, Triticum aestivum
  Clone ID: PAT_TA_97903
gttacttttctgtaagttcttcacttattttttaaacttgttatatgaatatgtaaagatctctcttaatttgtcataatctcaaatgtaaattggctggatatttttaaagtcaaaagtgaacatacttattatgttatgatgaaccacagtgaacttatgggtttataaaagcattcaatgcatttttgagtttttcagttattgttatcaaacatttagaattatgttaggttttttaatcgttatacagatatgtaattaaattgcttcattttgttaaaaaaaaaaaaaaaaaaaaaaaaa

SEQ ID NO: 97904 - DNA, 474 bp, Triticum aestivum
  unsure (1)..(474): unsure at all n locations
  Clone ID: PAT_TA_97904
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaaactgcctatgtttcgggtgcactgaccgccaacnacaangtgattaaacgangtnggaggagggtcaagaaagggnttccctgacn

SEQ ID NO: 97905 - DNA, 460 bp, Triticum aestivum
  unsure (1)..(460): unsure at all n locations
  Clone ID: PAT_TA_97905
agtttttttttttttttttttttangtattactttaaactttattttatcattaataaaacttacataaaaatctatatatctaagctaaataatacctatctccaaaaacattaacgtccccagatttcgacaatatagttgaaccctctacccctcgctgactgcagcctgatcgtgatgaagttcctccccagggctccatcaaccactgaagctgtggcaccctgtgaggctcctaccacgttaacccttacagccagcacgatgatcgcgttagtgccttggtacctcacgtcttgagtcaacactgtatttgctactgcattccgcgtgtgagtagatctagaaagtattctatctccaaggcagaatacttcccaaactcaagtcctcttcgcggagccacgaacggggtttcgtcaccaaccanttttaagcattcncatgatgactggcta

SEQ ID NO: 97906 - DNA, 451 bp, Triticum aestivum
  Clone ID: PAT_TA_97906
atggcacgtcttagcgtagtttgtattgcactcctcgttattcttgcttatttggaagttagttatgcagcacgcatagcccgttcacctcaatactttggcggctacggtcgtccgccaccaccgctaccacccccgcacggcttcggccccggttgcggacctttcggcccccaacgaccggacttcgacgaccaccgcggccacggccaccacagccacggccaccacggccacgagtcgaagtacgacatccctgaaggcggttccatcaagtatttcgaagacgattaagtataagttcgggcaataatgcgcaatccaatgctgggtcgagcgctggttcaagtggaggtagtggcgggtcgagtgcacaatcgagtgcaacatccaatgctaatggcaaataatgtgttttgttatgaatgtgtgtttgaacgtttgaactgtc

SEQ ID NO: 97907 - DNA, 452 bp, Triticum aestivum
  unsure (1)..(452): unsure at all n locations
  Clone ID: PAT_TA_97907
gacaacatgaaactcttggctgtgactctattggcgttcgccgcggtcgtctccgcgaggaacatagacctcgaggatgtgatcgacctcgaagacattaccgcctacgattatcacaccaaaattggaattccattggctgaaaagatccgtctggctgaggaggaagctgaacgcaacccgtctagaattgtcggtggctccaattccaatctcggcgcattcccgtaccaggctggtcttctcgcttctttctctggaggccagggtgtctgtggtggttctttgttgaacgtaaggagagttcttaccgcagctcactgctggtttgacggtcccaaccaggccagcaatttcactgttgtactccggatnagtgcgcctattcagcggtggggactaaactggaacactggctagcgttgtcatgcacggtaacctggnaccccang

SEQ ID NO: 97908 - DNA, 282 bp, Triticum aestivum
  unsure (1)..(282): unsure at all n locations
  Clone ID: PAT_TA_97908
gagagagagagagagagaactagtctcgagttttttttttttttttttttttttttttttttttttttttttttttttttttttttttcaatttaaaattattttatgtccttaaatctcanccgctanaacagtggtcttcncaaacacatatanaccgtcnaanaactttcggatgtccttgtttttgactgtggttgattgttggataagggcanctgagctggacanatcctccaaagagttgccttcaatgatnanctcgtccttctgcttcgggga

SEQ ID NO: 97909 - DNA, 267 bp, Triticum aestivum
  unsure (1)..(267): unsure at all n locations
  Clone ID: PAT_TA_97909
ggaggaggaagaagaagaggaagaggaggaagaanaagaggaataaacgtacgcagcacgcattgatcagggaagctagatcgccgacactcacggntcggactgtactgttttgtaaccaatccattaacttattactattataaattatttttattatttatactgttgaatcattcgttacggaacatggacatttttgcacttanaacgtcgtgaacatctatggcgtaacaattaaactaatttatttcataccaanaatct

SEQ ID NO: 97910 - DNA, 308 bp, Triticum aestivum
  unsure (1)..(308): unsure at all n locations
  Clone ID: PAT_TA_97910
ataattccatttatttggcaaaaatcttaaaatggcaacatctaatcaaagtcagcaccgntgatctgaacagactgctcagtggatctttttcatgtttacattgtaactttaggacgattattaaaacatcccattatacnaaaanntttatttcatttcattttacaatctcacaggtttgatatcacaacangaggattattttaanacatttattattanatatgtgtanattaaaaaatacggcaccactgacacaactgacatanntatcgccataaanaatgttaagntaccgcaaacga

SEQ ID NO: 97911 - DNA, 448 bp, Triticum aestivum
  unsure (1)..(448): unsure at all n locations
  Clone ID: PAT_TA_97911
atacgcgtttagccgtaactcatttaaacgcaacgatgtcgggaggattagacatactcgccctcaacgaggaggatgtcaccaagatgctggcagcaaccacccatcttgggtcggaaaatgtcaacttccagatggaaacgtacgtgtacaagcgccgcgctgatggcacacacgtaatcaacctgcgccgtacttgggagaagctggtgctggctgcccgcgcggttgtcgctatcgagaaccccgccgacgtgttcgtcatctcgtcgcgtcccttcggtcaagcgcgctgtgctcaagttcgccgcacacaccggagctacccccattgctggacgtttcactcctggtgccttcactaaccaaattcaagctgcgttccgtgagccaagtctcctgatcgtgctggaccctggccaggaacaccaagccaacactgaggntt

SEQ ID NO: 97912 - DNA, 451 bp, Triticum aestivum
  unsure (1)..(451): unsure at all n locations
  Clone ID: PAT_TA_97912
gttgaaagtcagtttattccatcataaaataatcaaatggcgttaaaacgaattaatagggaattacaagatctgggcagagatccaccagcacaatgttctgcaggtccacacggtgaagatcttttccattggcaagccacaattatgggtccagttgacagtccttatcaaggaggagtattctttctgaccatacatttcccaacagactacccattcaaaccaccaaaagttgcattcacaacacgtatttaccatcccaacataaacagtaatggttccatttgtcttgacattctgcgctcacagtggtctccagcactcaccatatccaaagtgttgctttcaatctgctcacttctatgcgatccaaacccagatgacccgttggtgccagaaattgctangatttacaaaacggncagagaaaagtacaatgaactaactt

SEQ ID NO: 97913 - DNA, 465 bp, Triticum aestivum
  Clone ID: PAT_TA_97913
ccacagtgccagtttataattccggtaaaatataattcccacaagcacaatgtcagccaaattgcaggattacaaagacagcttggagcgcggtctcaatgacaaaagcaagccatggacgaaatatttcgaaacggctgaacaaaaaaccggcgtgaacagagtctatatcttcgttggtatggtcgcgttcactggtttatatttagtgttcgggtttggagctgaattgatttgcaactcgattggtttcgtatacccggcgtatatgtctatgaaggccttggaatcgcctcagaaggacgacgatactaaatggctgacgtattgggtggtgtatgcgtgcttctccgtcgtggagtacttctccgacttcattgttggctggttcccgctctattgggctaataaagtgcatcttccgtcatatggtgctacctgccgaccgacttcaacggctcgcct

SEQ ID NO: 97914 - DNA, 453 bp, Triticum aestivum
  unsure (1)..(453): unsure at all n locations
  Clone ID: PAT_TA_97914
atccatccataaaaatattaaaaatgaaattcttcgtcgcttttgtcgctgtcttggctgtcgccgctgcccaatacaggccccaggcccaacctggcaagcccattgctgtaaccagccgtgtgaacaacaacgatgctgctgctaacgttctccgctacgacagcgactccgctcccgacggcagctacaactacgctcttgagatcgacaacggcatcgccgcccaggcccagggtactcctcgtgacttcggtggaaacccccctattgtgccagtagtctcccagggatccttctcttggacctctcctgagggtcaagcccatcaagcatctcttacatcgctgacgagaacggttaccaagcttccggtgatgccatccccactcctcctgncaaccctgagggcaacgccaggtctctgggcttaactccaagaaaggggaaaan

SEQ ID NO: 97915 - DNA, 459 bp, Triticum aestivum
  unsure (1)..(459): unsure at all n locations
  Clone ID: PAT_TA_97915
ctcgtgccggtctgttaactttgacacacaagatgaaatccttcgtagccctcctcgccgtcgtggccgtagttgccgccgatgtctcccacctgtccgcgcaccctgatgccgcggctcagatcctgaagcaggatgctgatgtcctccccgaccagttccaatacgcgtacgagaccagcaacggtatcgccgcccaggaatccggagtcctccagaaagttggcgaccaggaagccatcgctgtccagggatccaactcttacaccgcccccggtggcgaacagatccaagctgtcttacgtcgctgacgccaacggttaccaaccccagggtggttaactccccaatccccctcccccccaagccatccctgagtaacatccagagggctatcccctaaatcgctgctcaaccccccccaagnccggagcctgggccaagaaataataaanttan

SEQ ID NO: 97916 - DNA, 453 bp, Triticum aestivum
  unsure (1)..(453): unsure at all n locations
  Clone ID: PAT_TA_97916
gtcaagatgggtatcgacatcaaccataaacacgacaggaaagttaggcgcaccgaagtcaagtctcaggatgtgtacctgagattgcttgtaaaactatacaggtacttggctcgccgtacaaatgccaagttcaaccagattatcctgcgtaggctgttcatgagccgcatcaaccgccctccgctatcgctgtcgcggttggctcgtcacatgaagaagcctactcgcgagggcatgattgccgtcgtggtcggaagcatcaccaatgatgtgaggctgtacaaggtgcctaagctaacagtcgccgctctgcacgtcacagagaaggcccgtgcccgcatcttggccgctggaggagagattttgaccttcgaccaactggctctgcgcgcccccaacggcgccaagaccgttctgctgcaaggtccccgcaacgcncgtgaaggctnt

SEQ ID NO: 97917 - DNA, 459 bp, Triticum aestivum
  unsure (1)..(459): unsure at all n locations
  Clone ID: PAT_TA_97917
gtttcccgcggttccaaccggatcaaaaataacttgtcttttctcagattctaaaccatctgtccaccaaatttcatttcgaacaattcagtagttgtataccttctacctgcgatttcacctgcttcctgaagaattttcttcccggtactggttagaaagtatcctatatgttattctgatgtaactgccaagttttatctaaattaaacaagtagtttttatgtgaaaaaggaacaaacattcatacatcttaagacacagacttccacacttataatttaagtaggataaaagataaaactgtgtttttctttgctaaacttacacatttcttcagtcttcatttaataatttccagggtcggttgatgaacgcangcgtcggtnccaagaaagcaaatagaagctnaaacttggcaatctcagaccgcgctaactaagggctctcanttaggnc

SEQ ID NO: 97918 - DNA, 457 bp, Triticum aestivum
  Clone ID: PAT_TA_97918
caagctcgccaagatggtgaacaaccgagtaccttcggtattctcgaagacgtacgtgacgccgcgccgtccgttcgagaaggcgcgtctcgaccaggagttgaagatcatcggagagtatggtctccgcaacaagcgtgaggtgtggcgcgtcaagtacacgctcgcgcgcatccgtaaggctgcccgtgagctgcttacgctcgaggagaaggaccctaagagactgttcgaaggtaacgcactcctgcgtcgtcttgtcaggatcggagtgttggatgagaagcagatgaagctcgattacgtgctcggtctgaagattgaggacttcttgggagcgccgtctgcagacccaagtcttcaagggtggtcttgccaagtccatccatcaagcccgtttcctcatcaagcaaaagacaaaatccgcgtttcgcaaagcaagttgtgaacaatccct

SEQ ID NO: 97919 - DNA, 461 bp, Triticum aestivum
  unsure (1)..(461): unsure at all n locations
  Clone ID: PAT_TA_97919
gtaaaatatctttcaaaatgaattctcttttgagaaaagctgcgattgaatacctgaagaccaatgcgcgttcttccacccacgctgctaccgccggtggtcatggaggtggctacaagctatggaagaagatgactttcttcgttgcattccccgctgtcggtcttggtatgctgaatgcttacctggcccaccaggagcatgctcatgctgcacagcctgagttcgtgccctacgacttcatgcgcatccgttctaagcgcttcccgtggggtgatggccagaagtccctcttccacaacccccatgtcaatgctctcccaatccggctatgagcactaatttaattttgaaatgctagagcaagtgttgcaaaacatgcctattaagataacaaaattaatgtattgtgataagtaactaaaattaaattggtttaaaaattgtaaaaaaaaaaaaan

SEQ ID NO: 97920 - DNA, 455 bp, Triticum aestivum
  Clone ID: PAT_TA_97920
gttaaacacacaacaccctttagaacaaaagggtatcgtagtgaaacagatatttacgaaaattggaaaaatgaagttcgtaatttcgctggtggttttaagttgcgcggttttcgaagctagaggatatccgtacgcatattatccttcttatggaaatgttgacaccttttcgtacggcgatgccagccgcggcggtatggcgctgagtcgctactacaacccgtactacaaccccagtgcagtcggtggaggcatggcagccttcatggtccgccagcctgaagcccaggccacgccctcccaatccggccagtactacgtccccgacaggcgccgccaaacacagcaagaagtcaactacgcccctccccagcagaacgaagtctactacccccaacaacctggataaacaagccttcaaccccactgaaagccaacgaactcgcttaacc

SEQ ID NO: 97921 - DNA, 252 bp, Triticum aestivum
  Clone ID: PAT_TA_97921
gagagagagagagagagagaactagtctcgagttggctttatgttctttcaatttcattcttttatctctaatcgattttacatttgtatgataccatggattgtaaacttggtctcgttatgtaactgattcaatattcctttatgatttgttacatatattttgtggaagtttcacattaaaaaaaaaaaaaaaaaaaaaaaaaaaaaaaaaaaaaaaaaaaaaaaaaaaaaaaaaaaaaaaaaaaaaac

SEQ ID NO: 97922 - DNA, 454 bp, Triticum aestivum
  Clone ID: PAT_TA_97922
gtcagatcggcgatttttaataaaagccgcaaccatgggtcgtatgcacgcacctggtaagggtatctcccaatcggcgctgccataccgtcgcagtgtgccaacctggttaaaactgaccgctgatgatgtgaaggaacagattttcaaacttggcaagaaaggcctcactccctcccaaattggtgtcatgcttagggattcccatggagtcgcacaggtcagattcgtcactggcaaaaagatcctgcgtatcatgaaagccatgggtctcgctcccgacctaccggaggacttgtactacctgatcaagaaagccgttgccatgaggaagcacttggaacgcaacaggaaggacaaggacagcaaattcaggctgattctcgtcgagtccaaaattcacaggctagcccgttactacaaagacaaagaagcgtgctcccacccaactggg

SEQ ID NO: 97923 - DNA, 449 bp, Triticum aestivum
  Clone ID: PAT_TA_97923
gaaattcgttggctagttagttttatacagttattaatttgttagatttattatctacagaaaattactggtaaaacaggtgccgcgcgccaagatcgctctgcaacacaacctaggactcggaggagcagtcgtcgtcaccatgtaccgcaaaggattcgctgacatcacccccagggcggtcgccgcctctggcaaccccgaggacttcaaggtcttcaaatacatgaagattctcgaagaggccatggaaaatgacaccgaaaacctcatcgagaaagtacgaggcatctacggattcaaagtgaggaatggccccaacggctcagagggttactgggtcattaacgccaaggaaggcaaaggtaaagtgacgtacaacggctccgagaaacctgacgtcaccttcaccatcagcgacgaagacgtcgtcgacctcatctccggca

SEQ ID NO: 97924 - DNA, 481 bp, Triticum aestivum
  unsure (1)..(481): unsure at all n locations
  Clone ID: PAT_TA_97924
ctggaacctgagagtattttctggaagatttgcttaccaatcataacgcacacactagcacttatcaaagggttgatgaatgaagattaaaatattggcacaataaatcgtcatcatcatcataactttttactgccccactgctgggcataaccctcctcccgtaccgagaaggattgagcgctaatcaccatgcttgcttaacgggggttgctgatttcagactttatattcaagatttactccacacgttttccttaaccttttaatcagtcattggtgtctaagatataagtacttgggctgcggggttgttcgaaaagagttaccgcgggccctggcgcacaaagggctncccgaaaggaacaacggtgggttttaagtcaagtaaaaagtcctgacaactccccttcccgctgtccacccaaaagccgggaggggggcaataactggattaattggttcccgtttaaaaaaaaaa

SEQ ID NO: 97925 - DNA, 465 bp, Triticum aestivum
  unsure (1)..(465): unsure at all n locations
  Clone ID: PAT_TA_97925
aaaatgggtcgttactctcgggagcctgataacccagcgaagtcatgcaaagcgcgtggctcaaacctccgtgttcacttcaagaacacatatgagacagccatggcgatcaggaaactgcccctgcgccgcgctgtacgttacctgaagaatgtgacagagaagaaggaatgcattccgttccgccgcttcaacggtggcgtaggccgttgtgcacaagccaagcagtttggcaccacacagggtcgttggcccaagaagtccgctgagttcttactccagctgctgagaaatgctgagtccaacgctgactacaaagggcttgggatgtttgacaagcttgttatttgattacattcaaggtgaaacgcgccccctgcctggcgcaaaacgcaaataaccggcgcgcaacgggcctatcaaanccttaanatgtnaatcctcccttgncaacatcnnaggncc

SEQ ID NO: 97926 - DNA, 427 bp, Triticum aestivum
  unsure (1)..(427): unsure at all n locations
  Clone ID: PAT_TA_97926
aagtaagtaatagttaacataaatccaccatgaagaccttactcatcctgacaatcattgcggtggcactaactaccaccaccgccaatatacaggtcgaccctagtggccaagtacaatggccacaacaacaacaaccattcccccagccccaacaaccacaacaaatttttccccaaccccaacaaacattcccccatcaaccacaacaagcatttcctcaaccccaacaaacattcctccatcaaccacaacaacaatttccccaagccccaggaaccacaacaaccatttccccagcaaccacaacaacaatttccccaagcccaacaaacanaacaaccatttccccagcaaccacaacaacaatttccccaggcccaaacaaccanaacaaacaatttccccaagncccnacaaacccang

SEQ ID NO: 97927 - DNA, 425 bp, Triticum aestivum
  unsure (1)..(425): unsure at all n locations
  Clone ID: PAT_TA_97927
ggaagatatatcagtgattatgcttcgaggctagtcataagctacaacaatgcaagcaaaccctgcatcttcttatacccctacctaattgctccaatcccaacaaactccaattcaaaacaaattaacacacacataagagttgcatcctctaggaacggtaggaatcgaaaatggggacaccttacggctctggatcactcgagcgcaacggcagctccggcggccttgagcttggcggcgagcgcctcggcctcctccttgggcaggcccgcgcgcaccacgaccggcgccttctccaccaagctccttggcctccttgagccccaggtccgtcatcgcgcgcacctccttgatgatcttgatcttgggcgccgcgtccgtacttctcgatcttgacgtcgaacgccgttcttcaccgccgn

SEQ ID NO: 97928 - DNA, 427 bp, Triticum aestivum
  unsure (1)..(427): unsure at all n locations
  Clone ID: PAT_TA_97928
gccacccggtctcgatccacctcgggatccattctcctcgttttcctccacccaccaaccaaggctccccactgctcctccctgattcgctctgcccgatccaccatcgcagcaagccgccgctccagcaggaccttgcgtccccgctccatctccccgttcttccctggttctctctctggtgctcatgtccatcgttctcttcttgcaacaggaacaaccatggccgctgtgttcacaagtagcaagctgccatcgtcttcccccgcctcgcctgtgacctcctctgcatcggttccggccccgacgcccgatncccaagcctcctcgttcccctgcctgcaagcaaccgagcaagggacctcgcgcccggattcttcccctcgtccaagagggtaaggagcccgagctccctcgattcctcccg

SEQ ID NO: 97929 - DNA, 439 bp, Triticum aestivum
  unsure (1)..(439): unsure at all n locations
  Clone ID: PAT_TA_97929
tttatgtaaaaaactatttcaattcgccacaataatataaatgtttcgccaaatatttatccagttcgctgaattttaggttcaaaaaatttaaaaacagccacctgggacctgggaccgatcctggggcgtcggctgggaaccaagatcgccccaggccgatttttagcgccgggttcgccctcaggcggcgatttttcgangccgcctgggcggggcaacgggtggagatgctcttacaccaagacgcaagggattagcaggggacatatatatacggggacctactaggacaaagcatgtcattgctgttgggtntnagcaacaatgaacccgggaaagtcttttaaccaatganaaacangccctcctcctcccaancccaaagtgaacccaactcaaggatncctttgacaccancctgtaacctgcctttggg

SEQ ID NO: 97930 - DNA, 427 bp, Triticum aestivum
  Clone ID: PAT_TA_97930
acacaactagcgcacaagcatcaaatccaagtaggtagtagttaacgcaaatctaccatgaagaccttactcatcctgacaatccttgcgatggcaataaccatcgccaccgccaatatgcaggtcgaccctagcggccaagtacaatggccgcaacaacaaccattcctgcagcctcaccaaccattctcccagcaaccacaacaaatatttccccaaccccaacaaacattcccccatcaaccacaacaacaatttccccaagcctcagcaaccacaacaacaatttctccagccccgacaaccattcccccaacaaccacaacaaccatatccccagcaaccacaacaaccgttccctcaagactcaacaaccccaacaaccatttccccagtccaagcaaccacaacaaccttttccccaagc

SEQ ID NO: 97931 - DNA, 427 bp, Triticum aestivum
  Clone ID: PAT_TA_97931
ctccatggccaccaccatcaggagcggagtcaccatcaccatctgcactgcttgggctgccatccgaccttgccggcggctaccacttgatcggacaagaaggttactccaactccaaccaccatacttgtccaccgcattctcgcctcaagtaagatgtcaaggcgtgtggcgatcgagagtccgttgcacctcagacacgagtggggctcctccggtgactgccccggggacatctgatgccgccgccgccgacgaggtgctgctggagaccccggggagcttccgcatctacaggagcgggaagatagaccgcctcaacgaccccaccatcctgcccgccggcgtcgacgaggccaccggcgtcgcctccaaggacgtcgtcctcgacgcgggcaaggggcctctccgtgcgcctctaacttcc

SEQ ID NO: 97932 - DNA, 448 bp, Triticum aestivum
  unsure (1)..(448): unsure at all n locations
  Clone ID: PAT_TA_97932
ttcgtactcgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcaagcctgatggccaagatgcccggtgacaagaccgttgggggaggtgatgatgctttcaacaccttcttcagcgagactggtgctgggaagcacgtcccccgtgctgtcttccgtagatntcgagcccactgtgattgatgaggtgaggactgggcgcttaacgccaagctcttccaacctgagcaacttatcaagtggcaaagggagggattcaaccaaacaaacttccnccgttggtcaatacaacaatttgncaaggggg

SEQ ID NO: 97933 - DNA, 425 bp, Triticum aestivum
  unsure (1)..(425): unsure at all n locations
  Clone ID: PAT_TA_97933
gataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgtggccccctccaagggcaccccgtcgttcgaggccgccgccgagaacggagggtgcaagtgcggccccaactgcacctgcaacccgtgcacctgcaagtgatccatgaggcctcaatcaaatcagatnaaggagatggcatggatggacctgatgaaggagcgagtaatanttatgcaatgaaatcccaagcgtgtgtttcgttttaaatttgcacccanaataanacgagatntatcgtatcctatcngagctaagttaatgggg

SEQ ID NO: 97934 - DNA, 465 bp, Triticum aestivum
  unsure (1)..(465): unsure at all n locations
  Clone ID: PAT_TA_97934
ttatnatttntgtccaatcnncacagtttatcngcatctcanaaacntngtccacagncncaatacnggcanacagctanagcnccaagaaatgtcataattcggaaccgagtacatggctgagtacattccaaagggcaacaatacatcacaaaattgtggtacaagggccgccaagccgtgagcaagagaaatggaggagatcatttatgacgaaagaacacttttatctagctagcttcctccacacggtacgggcacggtttgatctcgtgtccgttggctgcaaatctcaagcaatgcaggaactggctggccggctncttctttgtngaggcggctggctngcaagaanccaagaagcccgttcaatggcttttctncctctccctttcctcctatgcaaggtnaggngaaatnaannttatatcaatcccctgtttgacaactnccttcctggttatg

SEQ ID NO: 97935 - DNA, 420 bp, Triticum aestivum
  Clone ID: PAT_TA_97935
gcaaggtctttcgctgccatgtccgcttcttcttcctccgctgccgggcaccgagctgaccccatgcgggaaaaagccaggtgatcggtactactggtgcatcctttggagttctcgtcagtgttccgagtggcaagagatttatcctgctatgttggattccgttagatcttggtctttgccgcgcccaccatccccagcttctcctgggctgctagcctgcaacaccggagcttgcgtcaggaaggagtcccagagttcatcggttgttctgtttcgaatggatgccaagcatgtcaccccggccaaggccagcaccattgttgatttctccaggattgcgctgctcatgctcgccactatcttgatgctctttgtgttcttgcttggcaatgtctgtccggacactgggcagtcgtt

SEQ ID NO: 97936 - DNA, 429 bp, Triticum aestivum
  unsure (1)..(429): unsure at all n locations
  Clone ID: PAT_TA_97936
attctcataagtagagcgcatcatttaagccaagcantgcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctgcaaccatttccacagccgcaactatcatatccgcagccgcaancatttcgaccacaacaaccatatccacagccgcaancacaagtattcgcaancacaacaaccaatttcgcagcaagcaggcagcaagcagc

SEQ ID NO: 97937 - DNA, 471 bp, Triticum aestivum
  unsure (1)..(471): unsure at all n locations
  Clone ID: PAT_TA_97937
acaacaaccaccatttttgcagcaacaacaacccgttctaccgcaacaaccaccattttcgcagcaacaacaacaatttccgcagcaacaacaaccacttttaccgcaacaaccaccattttcgcagcaacaaccaccattttctcaagcaagcagcaacaaccaccattttcgcagcaacaacaacaaccaattctaccgcaacaaccaccattttcacaacaccaacaaccagttctaccgcaacaacaaataccatctgttcaagccatcctatcttggcaagcaagctaaaccccatggcaagggtattcctccaagcaagcaaatggcannccctggtggggcaaatggccacaaaaggtccttggctanggtccgcaaaatggtttggtgggnnagaagtaaanttgccaatggttnattgcaaccaaacaaatgnttgncccggncaagctggccgcaaaaatc

SEQ ID NO: 97938 - DNA, 428 bp, Triticum aestivum
  unsure (1)..(428): unsure at all n locations
  Clone ID: PAT_TA_97938
gaaaggcgggacctttcggctcgtctctttggttggggtagcggtggatctcgggtgaggtggtgtcaaggtcttggatgccaaggcggcggccttggtggtggtagcgcggtgctcttgggcagagcccgtggcttggtgctgcccggaggccatggccgtgtgggcggcgtggttgctggggtgtggcgttcggtggcggtgagtgttggccggggtgaaaacctgctttatcttcggaaggaccggcgacggcgaatctcgttcccttcttgaanggcgtcgttgcggctctcactgcccatcgtgcggctccaaggggaaactcttattctcggatcaagcggcggtggcgctccgggtgtcaaatccttcctgaaggngcccccntgggagtcccatgggttccgccaatatgtgggcntnaa

SEQ ID NO: 97939 - DNA, 335 bp, Triticum aestivum
  unsure (1)..(335): unsure at all n locations
  Clone ID: PAT_TA_97939
cccttcctcatctggtcctccctccgaccggcgggcggcggccatggaccagcaagtgttcctcggcgtctcctggggcgatttgctcacctacctgaagcgcaacagcggcatggatcccgagctggtggtctacggccataacctggtgctctcctacgtctacgactacatcccggaccctcccgtctcccccatcgccacactctcgctctccggcttgccgtgggtccccgacggggtcgaacgcatcagctggctcccggaaaaggtcctccgtaaaatcgtcctcccgggcccccgccaaggaaggcggcgngcaaggggcctncctc

SEQ ID NO: 97940 - DNA, 265 bp, Triticum aestivum
  unsure (1)..(265): unsure at all n locations
  Clone ID: PAT_TA_97940
ggaagccatagttcgaagcttcgaacccggttgtgatggaggtggtctttgatggaggaggaggtgctggcggtgccaacaactggnggtcccaaatcagggaanagtttcgcaacgtcccgtatctcagaactatcagaggctctgatgcaagcactgtcgccagacgaccccgagacattgnctgntcttctgaatgttgctgtcanattanatagantnatttttcatactatctgnttngcgacgnctggattagtaactt

SEQ ID NO: 97941 - DNA, 353 bp, Triticum aestivum
  unsure (1)..(353): unsure at all n locations
  Clone ID: PAT_TA_97941
cctcgatcccctttgggcctagcatatctctctctccctcacccatccttctccaaccccggccgccgccacggccaggccggcgtggtggtgcgccttcgcctcccatccatccaccagcgccaccatcttcttctccttccccgaatccaccatcatccatccacaccgccgtcaccagcgccaccatctccagccaccaagcaccacagcgcctccccacacctcacgcancccaccaagacangatgggcgcagggcgtctgatgncccgcgcgattctcctccccaaatctggactgctgctggtcctccaacttttcttcttcccccaaattttgnctgntgctctc

SEQ ID NO: 97942 - DNA, 337 bp, Triticum aestivum
  unsure (1)..(337): unsure at all n locations
  Clone ID: PAT_TA_97942
caacactatttaacaccactccaccatgangaccttcctcatctttgccctcctcgccgttgcggcgacaagtgccattgcacaaatggagactagccacatccctagcttggagaaaccattgcaacaacaaccattaccactacancaaatattatggtaccaacancancancccatccaacancanccacanccatttccacaacagccaccatgttcacagcaacancaaccaccattatccgcagcancaagaaccaccattttcacaacgancaaccaccatttntgcatgcagcagcatccngttctagcngcaggagncaccattttc

SEQ ID NO: 97943 - DNA, 451 bp, Triticum aestivum
  unsure (1)..(451): unsure at all n locations
  Clone ID: PAT_TA_97943
caagtgccattgcacaaatggagactagccacatccctagcttggagaaaccattgcaacancaaccattaccactacaacaaatattatggtaccaacaacaacaacccatccaacaacaaccacaaccatttccacaacagccaccatgttcacagcaacaacaaccaccattatcgcagcaacaacaaccaccattttcacaacaacaaccaccatttttgcagcaacaacaacccgttctaccgcaacaaccaccattttcgcaagcaacaacaacaatttccgcaagcaacaacanccantttcacaggcaccaacaaccaagttctaccgcaacaacaantancatctgttcaagccatcctncttgcagcantttgaaacccatgccagggttntccttccaagcaggaaatggcaggccctggntggcaaaaggccccaaang

SEQ ID NO: 97944 - DNA, 449 bp, Triticum aestivum
  unsure (1)..(449): unsure at all n locations
  Clone ID: PAT_TA_97944
agaatcaaatccaagtaagtagtacctaacgcaaatccaccatgaagaccttactcatcgtaacaatccttgcgatggcaacaaccatcgccaccgccaatatgcaagtcgaccccggctaccaagtacaatggccacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgcctgcaatgtgcaatgtctacatccctccatattgctcgaccaccattgcgccatttggcatctttcggtactaactgagaagagaangaactcctagtnctaagattatatggnaacaccgtttttcntanttcgacagnttt

SEQ ID NO: 97945 - DNA, 444 bp, Triticum aestivum
  unsure (1)..(444): unsure at all n locations
  Clone ID: PAT_TA_97945
ataagtagagcgcatcatttaagccaagcaagcagtgctcaatacaaatccaccatgaagacctttctcatccttgcactccttgctattgtagcaaccaccgccacaattgcagttagagttccagtgccacaattgcagccacaaaatccatctcagcaacaaccacaagagcaagttccattggtacaacaacaacaatttccagggcaagcaacaaccatttccaccacaacagccatatccgcagccgcaaccatttccatcacaacaaccatatctgcagctgcaagccatttccgcangccgcaactaccatatccggcaagccgcatctaccatatccgcaggccgcaaccattttcganccacaaacanccatatccaacaaaccgncaacccaacagtntttcggcanccnacaagcaaancaaattttngcag

SEQ ID NO: 97946 - DNA, 438 bp, Triticum aestivum
  unsure (1)..(438): unsure at all n locations
  Clone ID: PAT_TA_97946
ccaagctccaccgccgtcgaagcacccatggcgcccaaggccgcagagaagaagccggtggagaagaccccggcgggcaagaagcccaaggcggagaagaaggtgccggcgtccaaggagggcggaggcgagaagaaggggaagaatnaaggccatgaagagcgtggagangtacaatatctacatcttcaaggtgctgaagcaggtgcacccggacatcngnatctcctccangggccatgtccatcatgacntccttcattcaacgacatcttctagnaangtccgccggtcnnagtnccggcaangctccgtcnccggttatanacaagnnatgcctaatctantcactttcgaggggnaagnttcnangatcttcnntttctggttnngtttntccccacggtngattttgtccaanacnaacnccgttttctt

SEQ ID NO: 97947 - DNA, 443 bp, Triticum aestivum
  unsure (1)..(443): unsure at all n locations
  Clone ID: PAT_TA_97947
cctagcctcctcctcctctcgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttggaattactggctctgcacaattaagctccgttgctactggtggaaacaagacanaaactcccaggtcctggtgcctcaagctngcgcttaagagctcttggcacgttctgggcatgaaggattggganngcatttgaggg

SEQ ID NO: 97948 - DNA, 380 bp, Triticum aestivum
  unsure (1)..(380): unsure at all n locations
  Clone ID: PAT_TA_97948
accccaacaacaacaaatcccccaacaaccacaacanttcccgcagcaacaattcccccaacangcagcaatttccccaacaacaagaattcccccaacagcaattcccgcaacaacaattccaccaacaacaattaccacaacancaatttccccaacancaattcccccaacagcanttcccccaacancaacagttcccccaacagcancagnttaacgcaacaacatttcccccggncacagcaagtcccctgaacagganncagttcccccagcaanagttcccccagcanccagcnanaaggaanttcccccaagcaganaatttccaantaccagtacccacccccaggcaaatnacaaggacnttcccccat

SEQ ID NO: 97949 - DNA, 445 bp, Triticum aestivum
  unsure (1)..(445): unsure at all n locations
  Clone ID: PAT_TA_97949
ccaacccaaaccaggagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggncggcanggaccccaacangcccaanagggcngccctccgccttcttcgtcttcatgggcgaagttccgcgaggagttcaancagaagancnccaagaacanagtcccgtcgccggcccgtnngaaaaagccgggcccggttgnngaaggtgggnatnngttgaccnctttcgtgaagaagtggcccncctaanngttngtccaagggncnacnacggctcaaanngggcngagttanaacaaagggctattncccgccctacanacaaaggcgc

SEQ ID NO: 97950 - DNA, 476 bp, Triticum aestivum
  unsure (1)..(476): unsure at all n locations
  Clone ID: PAT_TA_97950
ccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcaaaacgacgaggaccangcctacaggaagatcagactccgtgctgaggatgtgcaagggatgaatgtcctcaacaacttctggggcatggacttcaacactgacaaagctcangtccctttgtgagggaagtggnaanacaactccanttgaggntcaatgttgggatgtngaaagaaaaactggacaaactaaattccttccgcaatgntccgccaatttgggtttcaaccaaagnagacccccccggaaccaaagttgnangcgcaacnttgctatgccccaaagcnaagttccagnttaaggacangattccgcccgcaaagattg

SEQ ID NO: 97951 - DNA, 435 bp, Triticum aestivum
  unsure (1)..(435): unsure at all n locations
  Clone ID: PAT_TA_97951
ctacatagtacagccatggcccccaccgtgatggcctcgtcggccacctccgtcgctcctttccaggggctcaagtccaccgccggcctccccgtcagccgccgctccaacggcgctagcctcggcagcgtcaagcaacggtggaaggatcaggtgcatgcaggtgtggcccatcgagggcatcaagaagttcgagaccctgtcttacctgccaacgctcancaagggaggncctcctcaaagcangtggactaactgatccgctccaagtgggtgncttgccttgagttcaacaanggtccggttcatcttccgttagcaaaatgcntctnccgggtnataagacnggccgctactnggacaatgtnggaactggctatgttcgggtggaccggcgccanaaaangntatnaacgaggtggaggaaggcaaana

SEQ ID NO: 97952 - DNA, 361 bp, Triticum aestivum
  unsure (1)..(361): unsure at all n locations
  Clone ID: PAT_TA_97952
gttgcccttgttctagttgttgcccttgtcttgtttgttgcccttgtcctggttgttgcctttgtcctagctgtcctatttgttgtccttgtcctacctgctgcagagaagctgggtaatgcccttgttgcccttgtcctgnttgctgcagagaagctgtgtaatgcccttgttgcccttgtcctgggttgctgcaganaagctgggtantgccgttgttgccccttgtcctggctgctgctgaataagctagggtagntgcccttgttgccccttgncctggcctgttgttgaagaancttgnggtaactgcccttgttggcccttgtngcctggnngcctggcctgaanaatacttggg

SEQ ID NO: 97953 - DNA, 335 bp, Triticum aestivum
  unsure (1)..(335): unsure at all n locations
  Clone ID: PAT_TA_97953
cgattccctcctcctcccccgtcgcgtgatcanggncaaggncgcctccaaattgctctgggnctcccgngccgcctcctanctcaagatttccgccttccccaaggncttctccancgtgctgaaggntntgaagtatgntgaaacccangaatgggtcaaggntganggggattccgcaatcnttgggattacanaccangcccaagaccaattgggtgangttgngtatgtggaactgccaaaagttgggngcctcngtcncccanggaancaactttgggtgctgttgaaagtgngaagggaaacaancgacaatnaaaatnnccccggtg

SEQ ID NO: 97954 - DNA, 207 bp, Triticum aestivum
  unsure (1)..(207): unsure at all n locations
  Clone ID: PAT_TA_97954
acgaaggccacgcccgcctgcctctcggctctcaagcatggacgcggcgngataaggaagntaanctcgcgtcacggggtcanctcctgccctcctccctcccgctccgcctctgcccctctcctcngcgccgtcncccggctgctgcntcgtcgtcgccccgccggngatanataacggccgccnnacggggnaangttcnatggg

SEQ ID NO: 97955 - DNA, 453 bp, Triticum aestivum
  unsure (1)..(453): unsure at all n locations
  Clone ID: PAT_TA_97955
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactaactgattcgctccaaagtgggtgccttgccttgaagttcaacaaagggtcgggtttaatcttccgttgagcaaaaatgcgtctcccggggtaactaacgaacgggccggcttactgggncaattgttggaaagctgcctatgtttcgggttggnaccgacgccaaaacaaggtgattaan

SEQ ID NO: 97956 - DNA, 449 bp, Triticum aestivum
  unsure (1)..(449): unsure at all n locations
  Clone ID: PAT_TA_97956
gccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcaacaaccatttccaccacaacaaccatatccacagccgcaaccatttccatcacaacaaccatatctgcaagctgcaaccatttccggaagccgcaactaccatattcgcagncacaaccatttcggaccacaancaaccatattccacaaaccggcaaccaacagtaattccgnaaaccaacaaacaagccaaattttcaacaagcaagcaagcaaggcaagcaagccaancaaccaaccaacnaaaccaagcaac

SEQ ID NO: 97957 - DNA, 462 bp, Triticum aestivum
  unsure (1)..(462): unsure at all n locations
  Clone ID: PAT_TA_97957
caacaacacagcatagcgtatggaagctcacaagttttgcaacaaagtacttaccagctggtgcaacaattgtgttgtcagcagctgtggcagatccccgagcagtcgcggtgccaagccatccacaatgttgttcatgctattattctgcatcaacagcaacaacaacaacaacaacaacaacaaaaacaaccattgagccaggtctccttccaacagcctcaacaacaatatccatcaggccagggctccttccagccatctcaagcaaaaacccacaggcccagggctctgtccagcctcaacaaactggccccaagttttgagggaaataaggnaccttaccgctagaagacgcctaccctggcaattgttgcnatngtcctattttccctccataattgcaccaatttgccnccaagttgggaatccttcggggtacnaacctggngaaagnagaag

SEQ ID NO: 97958 - DNA, 430 bp, Triticum aestivum
  unsure (1)..(430): unsure at all n locations
  Clone ID: PAT_TA_97958
cgagggattaaagaagctcaagaaaagtgctgtagatggtgacatcaatgaatcaattgatgatgaatctaataaagcttcagaaaggggaaaggggattgaaaggttatcagctataagtgatcttatggaaaaaattaataaagcccgaactgaggaggatttgaagccgtgcttagagatgaagacccaactcttcaatttggacgaaggcgctagcgtgaaagaccttcaagacaatgaaatgcatgagaatgaaactgttgtaactgatgtggtaccagcagaaggattggattattctttaccgaaatttgttaccaccactgagattgatctagaaactctcaacaccatagacaaacacttttctacccangatatagagcaattatgangtctagatttcttaaacattgtgatttacctt

SEQ ID NO: 97959 - DNA, 160 bp, Triticum aestivum
  unsure (1)..(160): unsure at all n locations
  Clone ID: PAT_TA_97959
tcctgctagggttttggncctttgttttcggcggcgcaagatgggggagacggtcaagggaanttccaactgcgtcaacganaccaaggggntcngnctcatctccccngtcgacnggntacgngtgncattttatccaaanatgttgtccatcaagtcc

SEQ ID NO: 97960 - DNA, 330 bp, Triticum aestivum
  unsure (1)..(330): unsure at all n locations
  Clone ID: PAT_TA_97960
gccgccggttcacgcagcagcccaccagcgacgacgacgacgacgacgacgaagccgtcccgcagccgctcagaaccaccaagcccacagcccccctctccccgggcgccaagaagcagcagcgtcaccgtgccgacgaggacgacctggaactcgangganagaggaagaggatgagaaggacctggcggagttgaggaagaacgaggaggaagagagactggaggagacgcaatccnccgccgcatgggncgcaaanccaaagcgcccccgccgaggagaagcgacgagggatccgggagggagaaaaangcgggnaattaagagggc

SEQ ID NO: 97961 - DNA, 452 bp, Triticum aestivum
  unsure (1)..(452): unsure at all n locations
  Clone ID: PAT_TA_97961
aagtagttagcaccaatccatcatgaagaccttcctcgtctttgccctcatcgccgttgtggcgacaagtgccattgcacagatggngacnanctgcatctctggtttggagagaccatggcagcagcaaccattaccaccacaacagtcattttcacaacanccaccattttcacaacaacaacaacaaccattacctcaacaaccatcattttcgcaagcaacaaccaccattttcgcagcaacaancaattctatcgcaaggaaccaccattttcacaagcaacaacaaccaagttctaccgcaacaatcaccattttcggagcaacaaanaaactaaggttttactccacaacaacaacaacaaacnaactttgtgcaacangaaaatcccctattggntcaancaatccggtttttgcagcaancntaaaccccaangcaaaaggtt

SEQ ID NO: 97962 - DNA, 434 bp, Triticum aestivum
  unsure (1)..(434): unsure at all n locations
  Clone ID: PAT_TA_97962
atcaaatccaattaagtagtagccaacacaaatccaccatgaagaccttattcatcctaacaatccttgcgatggcaacaactatcgccaccgcgaatatgcaggtcgaccccagcggccaagtacaatggccacaacaacaaccattccgccagccccaacaaccattctaccagcaaccacaacaaacatttccccaaccccaacaagcattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacaagcanccacaacaaccttttccccaagccccancancgcn

SEQ ID NO: 97963 - DNA, 445 bp, Triticum aestivum
  unsure (1)..(445): unsure at all n locations
  Clone ID: PAT_TA_97963
cccgcctcttccggtccagttcacccctgcttcccgccgctttcctccccgctctgtgcactgtaagcgtgcacgcgcgcacctgccctgcctctaacggcggtggtataaatcaagagctcccctggctccggcagacgcctcggtttctctctttcttcacgctccctccccacaagctgacgtcctgaccaccctctgcaagctcgcctctccccaacgctggcaaccgggatgaactgcggnggggggcaaaaagngggaaccgggaaacggnaagggcacgccctcgctgcatccccaaaaanaaggggggtgctgaagggganccgttcgcgggggcgctccgctttctcctttttcccgggtgaaacggcgcaaccggcggtccgggggncgcgttgcaancaagccccccccgcccaaaaccggggggggaaggtga

SEQ ID NO: 97964 - DNA, 437 bp, Triticum aestivum
  unsure (1)..(437): unsure at all n locations
  Clone ID: PAT_TA_97964
gccagatgtagggtaggaaagatcaaccgttctccccagcggtttttttctttttttgcgggtagttgttttttgacaacaacaaaacaaagtctcccgggcagtttgattatcacgcgcgtgaccgacggattgggtctacgcatcgtcctcccatgtctcgcacagcggcacccgtgtgcccgcagaggatgctcccttctgcggcagcgctcctcttccactcgccgcgattcgacacgtagcacggtggtgctcctcgtacctttggatcactacaacaatggaccttccaacatctggctcgggagcacggngacgctcctcgcaactctaatccgcaacaaccaagggccttgaagcatcttgctcaaaagcacgacaagggcccctttgcanctctggttcgcaacacctaacgggccntgcatcaacnn

SEQ ID NO: 97965 - DNA, 436 bp, Triticum aestivum
  unsure (1)..(436): unsure at all n locations
  Clone ID: PAT_TA_97965
gctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggcccggggctgctgcaccggcatccagaacctgctggcggaggccaacaacagccccgaccgccgcaccatctgcggctgcctcaagaacgtcgccaacggcgcctccggcgggccctacatcacccgcgccgccgcgctcccctccaagtgcaacgtcgccctcccctacaagatnaagccccagcgtcgaactgcaactcgattcactgaacgaactgaagccgcctttggcccgttgtttcgacggtacnttntgn

SEQ ID NO: 97966 - DNA, 325 bp, Triticum aestivum
  unsure (1)..(325): unsure at all n locations
  Clone ID: PAT_TA_97966
atcccccancancatcaaatcccccagcacgccacaacaattcccccagcaananttcccccaacaanagcatttcccccaacannaccaatccccccaacaacaattcccacangcagcanttcccccancagnaattgctgcagcgggaattctcacaancaacaaatctcccagcanccacancanctcccccatgcaccagtaaatcccccagcanccacaacantttctccaatancancanttcccccancancaatccccccatcancatcaatttccccaacaagtatttgccccaacanganncaaatcccccang

SEQ ID NO: 97967 - DNA, 457 bp, Triticum aestivum
  unsure (1)..(457): unsure at all n locations
  Clone ID: PAT_TA_97967
caccaatccatcatgaagaccttcctcgtctttgccctcatcgccgttgtggcgacaagtgccattgcacagatggagactagctgcatctctggtttggagagaccatggcagcagcaaccattaccaccacaacagtcattttcacaacaaccaccattttcacaacaacaacaacaaccattacctcaacaaccatcattttcgcagcaacaaccaccattttcgcagcaacaaccaattctatcgcagcaaccaccattttcacaagcaacaacaaccaagttctaccgcaacaatcaccattttcggcaagcaacaacaactagttttacctccacaacaacaaacaacaacaacttgtgcaaacaagcaaaatccctattggttcaagccatcccgttttgcagcaagctnaacccatggcaaagtattcctncagcnngcaagtggcagg

SEQ ID NO: 97968 - DNA, 462 bp, Triticum aestivum
  unsure (1)..(462): unsure at all n locations
  Clone ID: PAT_TA_97968
gcaaccccaacaaccacaacaaccttttccacagccgcaacaaccatttccctggcaaccacaacaaccatttccccagacccaacaatctttccctctgcaaccacaacaaccattcccccagcaaccccaacaaccattttcccagccccaactacaattcccccagcaaccagaacaaataattccccagcaaccccaacaaccattcctcctggaatcgcaacaaccattcccccaagcaanccccaacaaccattttcccagccccaacaactgatccccatgcaaccacaacaanccattcccccaggnantnccaacaatcacaacaaaccttttcccggggccccaacaattatttcctgganctccancaaccaattccccaagcaaccaacaaacaaaccnattcccccctgcaaaccggcaancaaccattcccccccagcnattggcaag

SEQ ID NO: 97969 - DNA, 444 bp, Triticum aestivum
  unsure (1)..(444): unsure at all n locations
  Clone ID: PAT_TA_97969
cgagcgacagccagctccgcctcaacctcccggcgcatctccgacatggcccgcaccaagcagacggcgaggaagtccaccggcggcaaggcgccgcggaagcagctggcgaccaaggccgcccgcaagtccgccccggccaccggcggcgtcaagaagccccaccgcttccgccccggcaccgtcgcgctccgtgagatccgcaagtaccagaagagcacggagctgctcatccgcaagctccccttccaagcgcctcgtccgcgagatcgcccaggacttcaagaccgacctccgcttccagtcctccgccgtctccgccctgcagggaggcgccgnggnctatctcgttcgggcctctttcgaggancaccaanctcctgngnccatccaagccaagngnggtcaccaatcatggcccaagggnaatcanctnnccccgcn

SEQ ID NO: 97970 - DNA, 431 bp, Triticum aestivum
  unsure (1)..(431): unsure at all n locations
  Clone ID: PAT_TA_97970
cttactcatcctaacaatccttgcgatggcaacaaccatcgccaccgccaatatgcaagtcgaccccagcggccangtacaatggccacaacaacaaccattcccccagccccaacaaccattctgccagcatccacaacaaactattccccaaccccatcaaacattccaccatcaaccacaancaaacatttccccaaccccaacaaacatacccccatcaaccacaacaacaatttccccagacccaancanccacaananccatttccccagccccaagcaaacattcccccaancaaacccccaactaccaatttccccaacaaccccaancaaccattncccccaagcctcaagcanccccaaaaaanncattttccccaagtcacaacaanncanccaacaanccttttnccncaaggcccaac

SEQ ID NO: 97971 - DNA, 204 bp, Triticum aestivum
  unsure (1)..(204): unsure at all n locations
  Clone ID: PAT_TA_97971
tcgggcggaaggtagagattgtcgtctttttattgagcgccccctgccctggtttctctgccgctattggattgatttgggatccgcgatcgagattgctccgtgaagtttttggtcctagggatattttttgactggcccggatcaggaatagagggttctcttgcggggncanaangccaatacngcgggcanacccaatgt

SEQ ID NO: 97972 - DNA, 401 bp, Triticum aestivum
  unsure (1)..(401): unsure at all n locations
  Clone ID: PAT_TA_97972
ggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacaagactgaaatatgctctcacctaccgtgaagtgcaatctatccttaagcangcgtcatatcatggttnatggaaaggtccgcactganaagacctaccctgctgggttcaaggncaacaattccantcccaagactggtgaagaactaaangcttcnttatgacancaaggggncgcttncggcttnaatctgtcaaggaatg

SEQ ID NO: 97973 - DNA, 417 bp, Triticum aestivum
  unsure (1)..(417): unsure at all n locations
  Clone ID: PAT_TA_97973
tcacactctctgatcagagtagcactagcttcagctagccagcctctgccactccggtcattttcttgcatccacgacggcaatggccaccgctgatgtccagaacccatcggccgcgctgacggagganggcgcccgcggtggagaagccggtcgccgccgaggaggtcgcgaagacggaggaagcccccgcgccggtggaggccgaagtccaggngcctgcccccgtcgaggttgangaaaccaaggaggaggcgccggcancanttgangcaaaggaaacnaangaaccccanccaacaaactgnnggcgaaccggagggcnagggggcccgcccgttgtcnangacaaanaccaaaggaggccgtgtgttnaaggaaaaaccccgggggggggccganagangtnaaaggaaa

SEQ ID NO: 97974 - DNA, 443 bp, Triticum aestivum
  unsure (1)..(443): unsure at all n locations
  Clone ID: PAT_TA_97974
gcctcctgcttctcgccttccccaccaaatttccgccgaagcagaaaagcatcgtctctcgtctcgtcgaggaatcaacaaccatgggcggtggcaacgcgcagaagtccaagatggcgagggagaggaacctcgagaagctgaagggcgggaaggggagccaagctcgaggccaacaagaaggccatgaacatccaagtgcaagatatgcatgcagactttcatnttgcaccaacctctgaaagcaaagttgnaaggagcacgccgggggcnaagcatccgaaagnagcgacctcgtncnagttgnttccccancctcaangccgtgatatctgccaaatcnggncggggaananagaaaaanctgncggtaatcaancttantatttntcatnttnccgcnaatgnctggttntttgaacctaaancatggggtccngaaa

SEQ ID NO: 97975 - DNA, 450 bp, Triticum aestivum
  unsure (1)..(450): unsure at all n locations
  Clone ID: PAT_TA_97975
gccgcgcctcccgcctcgtcttctccgcgtttaagcgaaactgaactgcaagttcgaggcgtacgcgcctcgcgttgcgggttttcaggcggcagacagaggtgtcgacggccggaccatggagcggtggccctgcgaaatccagatcgacgatgaatcggctgcttcattggctataggaaagggatcaccctgcaaacacgatggcaagacaaggaaatattcaaggccagaacttccagangtctttattccatggtgacaatcttcatgagcattctatacaagaggttgatatggacacanaggataacgatnacgctgatganacagcagttaacacccagtctggaaagctcaaagaangccaatacctnaatcagcaagattgatgttctggatcaagantttcaantctaattttgaangttctaatgnaantgttgtccn

SEQ ID NO: 97976 - DNA, 460 bp, Triticum aestivum
  unsure (1)..(460): unsure at all n locations
  Clone ID: PAT_TA_97976
cgccgcctcctctcggttccttctccttcctcggagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtggaagttcgagaacaccaagtactactgcacccgtcatttgatgctcctgggcaaccgtgacttcaatcaaagaaacaagatttactggtaacctcccaaagctgactgtgctgtgctcaacaaatgnactncaaccaactngggggggttttgagggtgggnatctccaangggtnggcaaaacccgtg

SEQ ID NO: 97977 - DNA, 445 bp, Triticum aestivum
  unsure (1)..(445): unsure at all n locations
  Clone ID: PAT_TA_97977
gttcatccatctatcttgcngcagctaaacccatgcaaggtattcctccagcagcantgcanccctgtggcantgccacaaagtcttgctaggtcgcaaatgttgcancanagcagttgccatgtgatgcaacaacaatgttgccagcagttgccgcanatcccccagcaatcccgctatgaggcaatccgtgctatcatctactccatcatcctgcaagaacaacancaggttcagggttccatccaaactcctcagcagcaaccccaacagttgggccaatgtgtttcccaancccaacagcagtcacaacaacanctcgggcaacaacctcaacaacaacaattggcacaaggtacctttttgcagccacaacaagatagctcagctttgaggtgatgacttccaatgcgctccggtaccctgccaacgatgtgccgtgtnn

SEQ ID NO: 97978 - DNA, 439 bp, Triticum aestivum
  unsure (1)..(439): unsure at all n locations
  Clone ID: PAT_TA_97978
aacaaccaccattttcgcagcaacaacaaccaccattttcgcagcaacaacaacaaccaccatttacacagcagcagcagcagcaacaacaacaacaaccatttacacagcaacagcaaccaccgttttcacaacagccaccaatttcacagcagcaacaaccaccatttttgcagcaacaacgaccaccattttcacggcaacaacaaataccagttattcatccatctgttttgcaacagctaaacccatgcanggtattcctccaacagcagtgcatcctgtggcaaatgcaagcgatgtccttggctagggtcccaaatggttggcaggcangagcaatttgccaatggtggatggcnagccaacaatggtttgccangcnagtttgcgggnaantccccnggggaaatccccgnccatggnggtccaanccggt

SEQ ID NO: 97979 - DNA, 489 bp, Triticum aestivum
  unsure (1)..(489): unsure at all n locations
  Clone ID: PAT_TA_97979
gtctcctcccgccgccgccgcagccgccgcctgcctcgagccgccgtcgccatggggagaagacctgcgaggtgctatcggcagatcaagaacaagccgtaccccaagtcaaggtactgccgtggtgtgcctgaccctaagatcaggatctangatgttggcatgaagaagaagggtgtcgatgagttctctcactgtgttcaccttgtctcatgggaagaaggagaatgtgtccaagtgaggctcttgaggctgcccgtattgctttgcaacaagttacatgaccaaagcattgcagggaaaggatgccttccacctcaaggggtccaggggttcaacccgttccaatgtgctnccgttatcaaacnanagattgcttttccttgcccccngggggctnataanggctccnanaactggntantgagggggttgctttttnggggaaanccccccaagggaaatccngtnccccgtgnttggncaatt

SEQ ID NO: 97980 - DNA, 412 bp, Triticum aestivum
  unsure (1)..(412): unsure at all n locations
  Clone ID: PAT_TA_97980
gcgagccggcagatcctccatgcttcgcccgccgctgcgcctccgacctctcctcctcctccccgcccagccggtaccgccgccgctgcttcccgccgaataatccataataaaagtagcccccgataaaacgggccggccgcctccctcggccccgacccgcacgccacgcgggactcacccacccaccctcttcctccccctccctcccatcttcctgcgcgcctccccccgcctcctccggccggaaccctagccaggcgtgcaggcgcgcagnaggcggggcccccgcgccncgccgatgggggaggcggggtantgacgctgcccatcttcgcggtgctccgccgcgatcggctangtctactacacangggtctttcgtcgccgtngccnggcttggatncgggct

SEQ ID NO: 97981 - DNA, 469 bp, Triticum aestivum
  unsure (1)..(469): unsure at all n locations
  Clone ID: PAT_TA_97981
acactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccatcattttcgcagcaacaaccaccattttggcaagcaacaaccaccattttctcaagcaacaaccaattctaccacaggaaaccaccatttttcgcagcaacaacaaactagtttctaccgcaacaaccaaccattttcacaagcnaacaancaaaccaagtttttaccttccaaaaacaatcaccttttccancaaacaacaacaaccaccaacaaggntggggggcaaaaacnaaatnccctggttggttcaagcccntccn

SEQ ID NO: 97982 - DNA, 453 bp, Triticum aestivum
  unsure (1)..(453): unsure at all n locations
  Clone ID: PAT_TA_97982
gccacacgaaccccccacccaacccgagcgagcaccggccgaggaggaagagaaggtgagatggctcgcggcgcggcggcggcggcggcggccgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccggcaacctcgggcgactccgtcaccgtcacgcgcgacaagagcaaggtcaccgtcaactccgacggcgccttctccaaagaaggtacctcaagtactttgaccaaaaagtactttaaagaancacaaacgtggggggactggcttcgcggtgatngcagccaacaaaggagcgcnacntgttcanctccgggtacntcaacatncnctganaatgaagggcgaagang

SEQ ID NO: 97983 - DNA, 433 bp, Triticum aestivum
  Clone ID: PAT_TA_97983
cccagttcgagttccgccgccagcaccaaccgaagccaagtttcgaggccgccgccgccgaggagcagtagacgcgccgccatggcccgtaccaagcagaccgcccgcaagtccaccggcggcaaggcgccccgcaagcagctcgccaccaaggcggcgaggaagtcggcgccgaccacgggcggagtgaagaagccccaccgctacaggccgggcaccgtggccctccgggagatccgcaagtaccagaagagcacggagctgctgatccgcaagctgcccttccagcgcctggtccgcgagatcgcgcaggacttcaagacggacctccgcttccagtcccacgccgtgctgggccctccaggaggccgccgaggcgtacctcgtggggactcttcgaggacaccaaaccttgtgcgccatcaacgccaat

SEQ ID NO: 97984 - DNA, 275 bp, Triticum aestivum
  unsure (1)..(275): unsure at all n locations
  Clone ID: PAT_TA_97984
caaagtgtcactttgttgccattgacatctttaatggaaagaagcttgaggatatcgttccttcatcccacaactgtgacgtcccccatgttgaccgccaagattatcagctgattgacataactgatgatgggatatgtcagccttctcaactgaagagtgggtaaaaactaaagggattgancttgaaagcctnccaactngatnaatgttcctgcctngccaanattaaannatggatttgntnaatgggaaagggcctngattctggcctg

SEQ ID NO: 97985 - DNA, 452 bp, Triticum aestivum
  unsure (1)..(452): unsure at all n locations
  Clone ID: PAT_TA_97985
cctcggcggcgctgtcgtgcgggcaggtggactccaagctcgcgccgtgcgtggcgtacttgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttccccatcaagcatgtccaccaactgcaacaatgtcaactaagttcaatatataatccttcctacgtgcatgcatggacgcgcttgcgttggagcttaatttctacgttgatggagtgctcataccaatgttggancctacttaaaaatnaaatgaaagttgcctgtggtgttgttatttcantaagngtgtccaatgtncgt

SEQ ID NO: 97986 - DNA, 222 bp, Triticum aestivum
  unsure (1)..(222): unsure at all n locations
  Clone ID: PAT_TA_97986
ccgacgctcaagcccccagacgccgcagcgccgccactccacccgcagcggcaaccatggcggtcggcaagaacaagcgcatctccaagggganggaatgntatcatccacnttgttntcgntgtcttttntnaaggaatcacnntnagtgttttctttcgnncttctctgttgttcactnatcctntnacntgcttgnantttcncttttttnnaatacgt

SEQ ID NO: 97987 - DNA, 434 bp, Triticum aestivum
  unsure (1)..(434): unsure at all n locations
  Clone ID: PAT_TA_97987
gctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcagtacgtgcagcagggcggttcgccggcccggggctgctgcaccggcatccagaacctgctggcggaggccaacaacaagccccgaccgccgcaccatctgcggctgcctcaagaacgtcgccaacggcgcctccggcgggccctacatcacccgcgccgccgcgctcccctccaangtgcaaacgtcgccctcccctacangattaagccccaagccgtcgaatgcaactcgatncaantgaacgaactgaagcgccttggn

SEQ ID NO: 97988 - DNA, 279 bp, Triticum aestivum
  unsure (1)..(279): unsure at all n locations
  Clone ID: PAT_TA_97988
gcgcaacgcatcgatcgccttcgatgagagcgaggaagaagaagaagatgagaccaatgacttgtggttcgtcatcggccaggaggaggtggcgtgcgagcgttcctgcatcgccgcgctagcgaagccgctcaacacgctcctctacggcgggttcgccgaggcgcgccgcgaccacattgacttcagccgcgacggcatctcggcgcgtggcatgcgcgccgtcgccgcctacaagccgacacggnccgcctcgacgacttccctccggacaccatg

SEQ ID NO: 97989 - DNA, 408 bp, Triticum aestivum
  unsure (1)..(408): unsure at all n locations
  Clone ID: PAT_TA_97989
aacaccaatccacactgaagaccttcctcgtctttgccctcctcgctcttgcggcggnaagtgccgttgcgcaaatttcacagcaacaacaagcaccgccattttcgcagcaacaacacccaccattttcacagcaacaacanccaccattttcgcagcaacaacantcaccattttcgcaacaacanncancaaccaccatttgccgcagcaancaacaaccaccgttttcacaacaaccaccantttcacagcagcaacaaccaccattttcacaggcaacagcaanccacattttncacaggcatcannaaccaccatattcgcaggnaacancaggcaccatattcgcagcaacaatnaaccaccattttccgcngtaaaaancaaccaaccaatttntcgcag

SEQ ID NO: 97990 - DNA, 432 bp, Triticum aestivum
  unsure (1)..(432): unsure at all n locations
  Clone ID: PAT_TA_97990
atcagaacnaagcaacactagttaacaccaanccaccatgaagaccttcctcgtctttgccctcctcgccgttgcggngacaagtgcaattgcgcagatggngactagatgcatccctggnttggngagaccatggcagcagnaaccattaccaccacaanagncatttccacaacaaccactattttcacaacancaacaactatttcctcaacaaccatcattttcgcagcaacaaccaccattttggnaagcaacaaccaccattttctcangcaancaaccanttctaccacagcaancaccattttcgcangcaacaacaacgagttctaccggaaacaaccaccattttcacaggcnacaacaagccagttttacctcccacaacaatcanctttttccacaacaagcaaccaccaccaaccatgc

SEQ ID NO: 97991 - DNA, 453 bp, Triticum aestivum
  unsure (1)..(453): unsure at all n locations
  Clone ID: PAT_TA_97991
cttaaccacactcatctgatcacccactanctacccagctagcancttaangaactancttgcagctancgatccatggntcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcangggctgaacggcctggcccgcagcagcccggaccgcaagatagcgtgcaggtgcctcaagagcctcgccaccaagcatcaagtccatcaaacatgggcaaggtctccggcgtgcccgggcaagttgcgggcgtcaagcgtgccttccccatcaagcatgtccacaacttgcaacaatgtcaactagtta

SEQ ID NO: 97992 - DNA, 451 bp, Triticum aestivum
  unsure (1)..(451): unsure at all n locations
  Clone ID: PAT_TA_97992
ggtaatctantccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcaagcgccttccaccgcgtgatccccgacttcatgtgccagggcggcgacttcaccaagggggcaacggcaccggaggccgantccatctacggcgagaanttcgccgacgaananttcgntccacaaggcaanaccaatcccggggaatcctcnccatgggtnaacgcnggggccnnanaccaacgggntcccngtttcttcaancttgtn

SEQ ID NO: 97993 - DNA, 445 bp, Triticum aestivum
  unsure (1)..(445): unsure at all n locations
  Clone ID: PAT_TA_97993
ggatcccacccccctcagccgccacacccgcgccggcctcccattcctccgccccgcccaccacgccgcgacgcggagcagcagcagcagcaggagatctcgggaggaggcggcgcgcgagatccggcgccggagcggcggctgtctgtctgattgattgagtgatcggtcgattggttggctcgacgatggtgcgggagaccgggtactacgacntgctcngggtcaagcccggngggcaccgagggccgacatcaagaangcctactacgtcaaggngaagcaagtccaacccgacnagaancgnaatgacccctccgggccgagaaattcaaggaactgggggganggnataccaaantattantgaccccttgcacaagcgttaaancataatgactcaaattgggaaaattctgggtattttaaacgggnaagnaattnt

SEQ ID NO: 97994 - DNA, 455 bp, Triticum aestivum
  unsure (1)..(455): unsure at all n locations
  Clone ID: PAT_TA_97994
agctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcancagctcggaccgcaagatagcgtgcangtgcctcaaagaagcctccccaaccaagcatcaaagtccaatcaacaatgggcaaggtctnccggcgtggcccggcaaagtgcggngtcaagtgtgcctttccccannaagcaatgtccaacaaactggccaacactgttcaaatnagttcaaatatataaanccctttcctanctt

SEQ ID NO: 97995 - DNA, 302 bp, Triticum aestivum
  unsure (1)..(302): unsure at all n locations
  Clone ID: PAT_TA_97995
ctccggagagcgggcaaggcggagaccgagatggcgcgcggcgtggcggcggctaccaagggcggcgcgggcgccgggaagaagaaggggtcggtcaccttcgtgatcgactgcaccaagcccgtcgacgacaagatcatggagatcgcgtcgcttganaanttcctgcaggagcgcatcaangtcgccgggggcaaggncggcaacctcgggggactcngtcaccgtcgcccncgacaagagcaangtcaccgtcacctccggacggggccttcttcaaananggtacttgaaatacttga

SEQ ID NO: 97996 - DNA, 440 bp, Triticum aestivum
  unsure (1)..(440): unsure at all n locations
  Clone ID: PAT_TA_97996
acaacaaccattcccccagactcaacaaccccaacaaccatttccccagctccagcaaccacaacaaccttttccccagccccaacaacaattgccgcagccccaacaaccgcaacaatcattcccccaacaacaacggccattcattcaaccatctctacaacaacagttgaacccatgcaagaatatcctcttgcaacaatgcaaacctgcgtcattggtgtcatccctctggtcaataatctggccacaaagcgattgccaagtgatgcggcaacaatgctgccaacaactagcacagattcctcaacaagctccaagtgcgcagccatccatagcgtcgtgcattccatcatcatgcagcagcagcagcaacaacaacaancaaacaaggcatgcatntctttctgccactatctaagcangcaaacagggtgggt

SEQ ID NO: 97997 - DNA, 456 bp, Triticum aestivum
  unsure (1)..(456): unsure at all n locations
  Clone ID: PAT_TA_97997
caactagagcacaagcatcaaatccaagtaagtagtatttaacgcaaatccaacatgaagaccttactcatcctaacaatccttgcgatggcaacaacaatcgccactgccaatatgcaggtcgaccctagcagccgagtacaatggccacaagaacaaccacccccccagtcccaacaaccattctcccagcaaccacaacaaatatttccccaaccccaacaaacattcccccatcaaccacaacaagcatttccccaacctcaacanacattcccccgtcgaccacaacaacaatttccccagccccagcaaccacaancaaccatttcctcagccccaancaaccccaactaccatttccccaacaaccacancantcattcccccagcctcaacaacccccaacaaccaatttccccaagtcacagcaaccaacaacaacctttttccccg

SEQ ID NO: 97998 - DNA, 452 bp, Triticum aestivum
  unsure (1)..(452): unsure at all n locations
  Clone ID: PAT_TA_97998
gaaatctctccctcgcccaaaccctcgccgccgccatggccgcagccacctcccccgccgtcgcattctcgggcgccgccgccgccgccgccgccatacccaaacccgcccgccagcctctcccgcgccaccagcccgcctcgcgccgcgcgctccccgcccgcatcgtcaggtgctgcgccgcgtcccccgccgccacctccgtcgcgcctcccgccaccgcgctccggccgtggggcccctccgagccccgcaaagggcgccgacatcctcgtcgaggngctggagcgctgcntgcatcgtcgacgtcttcgcctacncctgggcgggcgcgtccaatggtagatncaccangcgnctgacgcggctcgccangtcantcatcaancaacttcttcccgccacnnagtcaaggggggaangggtttcgaggncgnnccggggtnagnctg

SEQ ID NO: 97999 - DNA, 430 bp, Triticum aestivum
  Clone ID: PAT_TA_97999
gatcgagctgctgctgtccgcccacgcccacggccaacccacgcaccaccgtcagagtgagctcccctgcatcctcacgacccctctttctgacacactggagattcatacagtgagagagagagtgcagagcaaggcagtgcgagcaaccaggcggagcagagcagacggggaattattagtgacgacagcactagcagagcacagacaccacggcagagctgatcagagctgctaatctagaagaatgcaacagctgggggccgccacgcccagcacgagaaggcgcctcacggtgccgaggcggtctcccgcggcggcgtcggtgtgggagacgcggatggagatggacgaggtgaagggcggcgtcaaggtcttcaacgaaggcgccgacgacgcccgacgaggagggcatgcgggtgtacagccg

SEQ ID NO: 98000 - DNA, 438 bp, Triticum aestivum
  unsure (1)..(438): unsure at all n locations
  Clone ID: PAT_TA_98000
cctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccaacaactgtgacgtcccccatgttgaccgccaaagattaacaagctgaanttgaataacctgaatggatgggantatgtcaggcctttctaactgaagagtgggaan

SEQ ID NO: 98001 - DNA, 451 bp, Triticum aestivum
  unsure (1)..(451): unsure at all n locations
  Clone ID: PAT_TA_98001
tggcccaagctatcccggttttctctatgtcatgttttaaactcccagagaagtttgtgtgatcatatcaaatccttcattaggaaattttggtggggatgtaagcagggtgaacgcaaaccggcttgggtgtcatgggacgtgatgacacgtccaaaacatttgggagggcttggctttagacgatcttgagattttcaacctatctttgttggtacgacaagcatggagactcttgcaagaaccaacaagccttgagtggcaaaaatactgaaaagcctcatactaccctgacaggacgattctcaatgctgangttggggtctaggccttctcaaanttgggcgttgctatcctgggaggggcgggatttggtaanancangggaaatcanccgcccgaatctgggtaaaggggccaaaccnccgggtnanctgggaaccntnacntg

SEQ ID NO: 98002 - DNA, 448 bp, Triticum aestivum
  unsure (1)..(448): unsure at all n locations
  Clone ID: PAT_TA_98002
atcaaggcccgtccctgcaaggttgttgaggtctccacctccaagactgggaagcatggtcacgcaaagtgtcactttgttgccattgacatctttaatggaaagaagttgagggatatngttccttcatccccacaaacttgtgacgttcccccatgttgaccgccaagattatcaagctgattgacataactgatgatggatatgtcaaccttctcactgangagtggtaacactaagggatgacctgaaagcttcccactgatnatgttctgcttgggcaaatnaanactgggatttgctgatngcaaaggacctgattctggtcctgtgatgtcccgccaagggttaaagaacanatttgcgctgttaaaggaaatcngtngggnggcaantaaanaacttgttccttgggttcccnaccttnngaatacctnggnaacnaatg

SEQ ID NO: 98003 - DNA, 322 bp, Triticum aestivum
  Clone ID: PAT_TA_98003
cgacggccacatatccagtgggattcatttcatctcttctgcaatgtgaggctgctaacctcgcgtcctttttttgctgcatttacttttctttcaagtccaatctcattgttattacgaattaggaatagacatttttttgttaactgatggatgagtggttggacttgctcactatgtagctacacaaatcaaattttcacacaaacgggcacagaactttgtaaacctgatggcaaattatgatgtgttttccatcatgacttaagtttcgatgcgtggaaattatgatatgtttcccaaggaaaaaaaaaaaaaaaaa

SEQ ID NO: 98004 - DNA, 449 bp, Triticum aestivum
  unsure (1)..(449): unsure at all n locations
  Clone ID: PAT_TA_98004
gccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcaagcccgtggtacggctccgaccgcgtgctctacctcggcccgctatccggcgaccccccgagctacctcaccggtgagttccccggcgactacgggatgggacaccgcggggctctcggccgaccccgagaccttcgccaagaaacggggagctggaggtgatcactgccggtgggccatgctgggcgccgctcggctgcgttttcccgggagcttgctncccccgcaaacggngtcnaagtttggg

SEQ ID NO: 98005 - DNA, 460 bp, Triticum aestivum
  unsure (1)..(460): unsure at all n locations
  Clone ID: PAT_TA_98005
agagagagagagagagagagagagagagagagagagagagagagagagagatttcacancancanctaccaccattttcacagcancaatcaccgttttcgcaacaacaacaaatagtactacagcaacaaccaccatttttgcaacaacaacaaccaagtctaccgcaacaaccaccattttcgcagcaacaacaacanctanttctaccgcancaacaaataccatttgttcatccatctatcttgcancagctaaacccatgcaaggtattcctccaagcagcaattgcacccctgtgggcattgccacaaagtcttgctaggtccgcacatgttncanncagaagcagttgccatgttgctgcaaccancactgttncccancaagtttgccggcaaaatcccccaagccaatccccgcttattgaggcantcccnttgcttattcatnctacnnc

SEQ ID NO: 98006 - DNA, 445 bp, Triticum aestivum
  unsure (1)..(445): unsure at all n locations
  Clone ID: PAT_TA_98006
cccctccctccctcttcgatctctctccctcctcagccgccacaaaccctagccccctttcctacgatccagccgtcgctacccctcctccatccaacctccatcgtcagccgccgccgccgctacggctcctccgtccaccgactccgtccgtgcaggtggccagtttccttccgcctcgaccttctccacggtctccccagttcaccccccatcccttgctgcccgaggtgctcatcttcccaagtcgtgaggaaagccgcgtgggggatggaaccaccacgtcgtgcccgctggggggaagcctttggattcangcaagggggcctccccgggggcccaaaggaaggggtttgtggaggcgttagggcaanaaggaccctccttgcgtnggcncgtccccaactcaaattcggggaatcttggttgccggcaatanattnag

SEQ ID NO: 98007 - DNA, 436 bp, Triticum aestivum
  unsure (1)..(436): unsure at all n locations
  Clone ID: PAT_TA_98007
gcgctttgccgccgggacaatgggaatgcacggcgggacaagctggcgccgacggacgcaagaagccgtcgccatggtgcttgctctggctacgctagcagctcttgctaccgcgggagagcaacaagagacgacggcctccagggttctcggcggcaacgtcacggtcgtctcgtcgacggaggcgtcaggcgtgaacatcaccgccatctgctcgtcgacgccgtacccggccgcgtgccggacggcggtgtcctcgtcggcgtcgggggcggccaaggaccccttcgaggcctccgtgcagtttgccatggcccgggctgcgtcngcgcgcgcgctggcgcgcaacctctcgtcagnatcgtccgattgncgggggcncgctgccgccctccgggatggncgaactgccnccgagnctgntcgncgtnaacca

SEQ ID NO: 98008 - DNA, 439 bp, Triticum aestivum
  unsure (1)..(439): unsure at all n locations
  Clone ID: PAT_TA_98008
caccagcttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaagggctgaacggnctggcccgcancancccggaccgcaagatancgtgcangtncctcaaagagcctcnccaccancatcaagtccatcaacatgggcaaggtctcccggngtngcccgggaaantgcggggtcnggngtntcccttccccaatcangatgttccaacct

SEQ ID NO: 98009 - DNA, 392 bp, Triticum aestivum
  unsure (1)..(392): unsure at all n locations
  Clone ID: PAT_TA_98009
cccacccagtccattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccaagtgccgatgagatttgctgtttgctgctcancaaagcangatacaagtggagaaggtttgtgaaattgttaaaaaacancttgctgttcctgaaggnaatgaaagtttgcggtaccancaagttttcctgaccttggagctgnttcacngggcacngtccaagantgtnttggggccttgaggagggagttccanatnancgtgga

SEQ ID NO: 98010 - DNA, 445 bp, Triticum aestivum
  unsure (1)..(445): unsure at all n locations
  Clone ID: PAT_TA_98010
cgaagtgcccccgccttcaactccggcgcccccctccgccgcggccgcccgttcgggcctccagcctccgccgacgaccagatggattacctcaagacggtggtgccgtcgcagctcctggccgagcgcggctccaacctcgtcgtcatcaacccaggctctatgaacgtgcgcatggggttcgctagccaggacgtgccgttcaatataccgcactgcattgcccggcacaagaacgatgcaccgaagctgtcggtgcgagaccaagaggctcaactgtcgcgctgggtcgacgcacaacgcagagcgggagagggcgtatgatattattgcttcantgctcaaaatcccatttttgggtgaagtatcaccttcangagaaccanccattacctcctaagatgggacgtcttgatggtctttcttcacagcaaaacaaagatnn

SEQ ID NO: 98011 - DNA, 363 bp, Triticum aestivum
  unsure (1)..(363): unsure at all n locations
  Clone ID: PAT_TA_98011
gcaaccctgtgtcattggtgtcatccctcgtgtcaatgatcttgccacgaagtgattgccaggtgatgcagcaacaatgttgccaacaactagcacagattcctcgccagctccagtgtgcagccatccatagcgtcgtgcattccatcgtcatgcagcaagaacaacaacaaggcatacagatcctccggccactgtttcagctcgtccaaggtcagggcatcatccaacctcaacaaccagctcaatatgaggtgatcaagatnattggtattgagccgccccgagggacagcgtcncgagggaagacagacagacanncgccncgggaggnannggggcatggctttccctgcaangggg

SEQ ID NO: 98012 - DNA, 405 bp, Triticum aestivum
  unsure (1)..(405): unsure at all n locations
  Clone ID: PAT_TA_98012
tctcttctcatctcatcatctgacgaccagcggaagggcggacacggtacttgcaaaacccacgtcgacggnaccttcctcccctcccctcccctcccctcccacaaatagccggacggggacgactcctctccagcgaagcaaaccccacctcgattcctattcctcctctcccttcctccccccaccactttcccccaacctccccccagccagattccaccgccagccgcgacctccccccgccccctcgccatgcgcaactccggtgccaccgccgcctcggnccctccgggcgcctccatgcacgggtcctacgccgcgcccggncggcnaatccgncggttacgccangtattcccanctaancnggcggngggccgtcctcctcctccctaagcccaa

SEQ ID NO: 98013 - DNA, 436 bp, Triticum aestivum
  unsure (1)..(436): unsure at all n locations
  Clone ID: PAT_TA_98013
gctctgtccgttgagaagtggagcagctccgttcccatcggccggcatctcaggttaacaagaaacattgtattcccattggtatttaactaggatgtgtgctcctgtggcatgatctattataaacattgtgtgctagctggtaaacaaagtaacctaaccaattttgaagcgaagtgttacttgtgtggaggaatatgcgaatttatgtttctgaggcaagccatatacatattttactgggcaatcatcatggctcgcttcctttctttgccgaaattccaaaataattcctcaatacttcagtctaatgtaaatgttccatgtaagatttaagcccganggttctgagccgtaaaaatcctccgccattcctgcaaccccaactggatgaacaacccacaacatngttgtgtccaagcaacaagtaacaacc

SEQ ID NO: 98014 - DNA, 432 bp, Triticum aestivum
  unsure (1)..(432): unsure at all n locations
  Clone ID: PAT_TA_98014
cccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaacccccgaagctacctcaccggtgagttccccggggactacnggtgggacaccgcggggctgtcggccgaccccgaaaccttcnccaagaaccgggaagctggaggtgatccaatggcggtgggccatgctgggcnctctcgggtgcntttcccgnagctgctcgcccgcaaacggggtn

SEQ ID NO: 98015 - DNA, 441 bp, Triticum aestivum
  unsure (1)..(441): unsure at all n locations
  Clone ID: PAT_TA_98015
tattcctccagcagcaatgcagccctgtggcaatgccacaaagtcttgctaggtcgcaaatgttgcagcagagcagttgccatgtgatgcaacaacaatgttgccagcagttgccgcaaatcccccagcaatcccgctatgaggcaatccgtgctatcatctactccatcatcctgcaagaacaacaacaggttcagggttccatccaaactcctcangcagcaaccccaacagttgggccaatgtgtttcccaaccccaacaagcagtcacaacaacaactcgggcaacaacctcaacaacaacaattggcacaagggacctttttgcaagccacaccaagatagctcagcttgaggtggtgacttccattgcgctccgnaccctgccaacgatntgccgttgtcnatgttgccgttgnnttaaaacccaccannagtgt

SEQ ID NO: 98016 - DNA, 437 bp, Triticum aestivum
  unsure (1)..(437): unsure at all n locations
  Clone ID: PAT_TA_98016
cagagagcgagagcaaatcaccagcctccacgccgcctctgcgctgcgcgagcagcgcaccaccaccggcgttccctcgttgctaaggctgcgcgggccctcggcccattagggctcccgggctttaaaagggtacgggcggaataaaaccgaagtggcaggggtttggactggggcaggcaatttccgttcagtttccggggttttcctctgctccgccgtctccgccaccgccggccgccgcgacctcgattccccccggctccggngcgcgcagggggcgatctgaggcgcaccttcccgtcaggcgggggagggatttacttccgccccgacctccacgggatnctcccccgaactggtccccccatngtccgtctccccggacgcccgccgatncgcggnccgggggnccnccgctnaaggaattgggaact

SEQ ID NO: 98017 - DNA, 449 bp, Triticum aestivum
  unsure (1)..(449): unsure at all n locations
  Clone ID: PAT_TA_98017
gaggagcccatcccgtcccgaaccaatcacacccctcggcggcggcgcggaccgccgcgccggccatggcggacgccgtcaagcagccgctcctccaccaccaccagccctacgcgtacccgtcttacgccgcgtcagcctcgtcccccgcgctcccctccgtgccccactccgggaccgccacccccacccccgggggcgggggcgggggcgcggcctcctccttcgccgggggccgccgcttcccgggcggcctcgacgtgcccaacctcaanaagcgcggcggcggcacgcgcagcttggatccgcgtcgagggccgccacgggcctccggtgcagacgctcgaaggtcnacaanggcaccatgatgcgcccgctgcgangctcccccgccccggngaantncggnctcctcgaanccggntttttcgttctancccctccaaact

SEQ ID NO: 98018 - DNA, 344 bp, Triticum aestivum
  unsure (1)..(344): unsure at all n locations
  Clone ID: PAT_TA_98018
cactctctatcagtcacgtcaggctcggtggatcacggtagcactagcttcagctagccagcctctgccactccgggcattttcttgcatccacgacggcaatggccaccgctgatgtccaagaacccgacggccgcgctgacggaggaggcgcccacggtggagacgcccgtcgccgccgaggaggtcgcgaagacggaggaggcccccgcgccggccgaggccgaggtcaaggggcctgctgcccccgtcgaggtcgaggagaccaaggaggtggcaccctgccgccgcttgagacngaggaggccaaggagccccanccaacagcngcggccgagccggga

SEQ ID NO: 98019 - DNA, 459 bp, Triticum aestivum
  unsure (1)..(459): unsure at all n locations
  Clone ID: PAT_TA_98019
ctcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtngtnatnaccanggctgtganggtggttgacattgttgacaccttccgtcttcagtgangaaacctgcttttgacaaganncagtttanctcctcacatgangcgctacantcaaagnaaccctcnctgncaaagcttgaagggggatgancctangatncttttcaaacgnagaaangtttngntccgccanaaagnttatnnttccttt

SEQ ID NO: 98020 - DNA, 438 bp, Triticum aestivum
  unsure (1)..(438): unsure at all n locations
  Clone ID: PAT_TA_98020
atctactactagagttcttctcttctcagttagtaccgaagatgccaactggagcaatggtgcaatatggagggatatagacattgcacattgcaggtagcgtctctagcgctaggttccttatttcctcaaactggggcagttgttgaggctggacagagccctgggcctgtgggttttgctgagatggctggaaggagccctggcctgatggatattgttgttgaggctgttggaaggagacctggctcaacggttgttgttgttgttgttgttgttgttgttgctgttgatgcagaataatagcatgaacaacattgtggatggcttggcacccgcgactgctcggggatctgccaacagctgctgncaacacaattttttncaacaactggnnaattacttttgtttccaaaaacttgtgaagcttccanaacg

SEQ ID NO: 98021 - DNA, 285 bp, Triticum aestivum
  unsure (1)..(285): unsure at all n locations
  Clone ID: PAT_TA_98021
gggggcagatgatgaagttaggaaagttgcgattcagatcattgcacttttcttcaatatatcactgtcacttccaaaacagaagacatctgctaatgacatcgatctagaatcttcatacggtgctttgtcctccctagaggacataagtctccatcatcagaagggcatctgttgatcagatcgaangtatttcatagaagttgtctcctcctgtgtgtattcctactatctaaggacgagctgggttgtcctggctacaactccttggcaacgttaagccgg

SEQ ID NO: 98022 - DNA, 444 bp, Triticum aestivum
  unsure (1)..(444): unsure at all n locations
  Clone ID: PAT_TA_98022
atctaacacaaatcaaccatgaagaaattcctcgtccttgccctcattgttgtcgcggcgaccaccacggccgccgaaccctttactgcattccgtagtgcttgggagccgcaacatccatcatctccggagcatcaaccaactccgcagccacaagaacatccagttccacatcaaaagttgaacccatgcagggatgccctcctacaacagtgtagcccaagttgctgatatgtcattcctccggtcacaggtggtgcaacatagcagctgcttgggtaatgtgggaagcantggctgtcaagcaactaaaagcgattcccaagcaagttaaagatgcngangccatccaacaacgttggtgcaanccaattnttttncaacnacaacaacaattggtaaaagctacttncacccaaacctcaanaagnaggcaacaacaag

SEQ ID NO: 98023 - DNA, 412 bp, Triticum aestivum
  unsure (1)..(412): unsure at all n locations
  Clone ID: PAT_TA_98023
gcncaactaccatttccccancaancanaataatcattcccccagcctcaacaaccccaacaaccatttccccagtcacagcaaccacaacaaccttttccccagccccaacaaccgcaacaatcattcccccagcaacaacaaccgttgattcagccatatctacancaacagatgaacccttgcaagaattacctcttacagcattgcanccctgtgtcattggtgtcatccctcgtgtcaatnatcttgccacnaacgtgantggcaaggtgatgcaagancaatgtttgccaaacaactnncacaaganttcctcngccangcctccnagtggtggaagcncaattnaanagcggtcgtggcaattcccaatngttcattgcaangaatgngagcaatccanccaggg

SEQ ID NO: 98024 - DNA, 436 bp, Triticum aestivum
  unsure (1)..(436): unsure at all n locations
  Clone ID: PAT_TA_98024
ccccgatcgacaaggacgcgccgccgggaagaatccgaccatgagcgccgccgcggccaacgtcgccgtcatcggagccggaatgacgggcgccgtgtgcgcctcgctcctggccgcgcgcggggtggcggtgacgctcttcgactccggccgcggncccggcggncgcatggcgcaacggagaaaggtgatggacgaanggaacgganctngngttccaacaacggggcgccctaattnaacgttaanaaacgaanaagtnctccgggttntnggcngattggaaggcccgggcctcctcncccaatggaaaggcatgttccgcctgcttcnatnggganaacgggnaaattcaaagacttcgatnnaggagggaaccatgaanaaatatgttggngttcctggcatgaactcaatatgcaaatctctgtgntaa

SEQ ID NO: 98025 - DNA, 449 bp, Triticum aestivum
  unsure (1)..(449): unsure at all n locations
  Clone ID: PAT_TA_98025
gcgattcctctcccctcgcctcctcgtcctccccctcctaggggatcgccggagaggaatcgcgacgagggcttcctcctatcagttaaatcaaagccatggagcacaaggagaccggctgccagtctcgggagggccccatcctttgcgtcaataattgtggcttcttcggcagcgcggcgaccatgaacatgtgctccaagtgccacaaggagatggcgatgaagcaggagcaggcaaagctggccgcctcctctttcgacaagcatcgtcaacggtggcgatgccgccaaagaacatctttgctgctggcancacgggggtggcaagtttgctcangttgaaggnngaaagacncttaattaccggcnaaancctgcngatatcccctgggtccaaagcgaaggggggncgaatnggaacaaccccaaaggggccaaagtccggtt

SEQ ID NO: 98026 - DNA, 435 bp, Triticum aestivum
  Clone ID: PAT_TA_98026
ctttacaagatggtatcaccccagcagtcactgatgacaggaaagcatcaggaagaccaagttccttcaaagcaggaaagcatgtaggatccttatgtattatctcactcataacagtaactgaagagaagtatatatcaccaccaaactttccaacattctggaatataagggaaagtgacatgggcaaagagttatcattggaactttgagagcgagcaggattcgcaggagaatatgtagcggaacctaatgccttgagcaaagccttaatcaagtcgcttctgtgagtacagatggtcaatcttcctgatttcgatgtatcactaagcaaccactgaagtaatttcaagcaacaccaataacacgctgcacctccacaatgttacctctgagaaaaaagttctacaccacccaaatctttaaaacagggaa

SEQ ID NO: 98027 - DNA, 435 bp, Triticum aestivum
  unsure (1)..(435): unsure at all n locations
  Clone ID: PAT_TA_98027
aacactagttaacaccaatccaccatgaagaccttcctcgtctttgccctcctcgccgttgcggcgacaagtgcaattgcgcagatggagactagatgcatccctggtttggagagaccatggcagcagcaaccattaccaccacaacagacatttccacaacaaccactattttcacaacaacaacaactatttcctcaacaaccaacctcagcagcaacaaccccaacagtcggtccaaggtgtctcccaaccccaacaacaacagaagcaagctcggacaagtgttntttccaacaacctcaacaacaacaactgggtcaatgggcctcaacaacaacaagtaccccagggtaccttgttgcaggcaaaccaaatagntcaacttgaggggatgacttccaatgcacttcgtacctgncaacgaatgtggag

SEQ ID NO: 98028 - DNA, 436 bp, Triticum aestivum
  unsure (1)..(436): unsure at all n locations
  Clone ID: PAT_TA_98028
gagagagagagcaccgagaggagggtcacttgcactgcacacctgagaggcagtgttgttcgttcttgaacatctgccagatgtttcatgcaggatctggacctttattttggtggttttacccttccaatgtgagcatgcgaagcatcaggatgataagcacctgcatgaggaagatactcggtgctggaaacaataatagccaaggttcccttcgatcggattcaaagatggaggaatttgagaattttcacaccatatgttctttccgaagtgcagtgctgaagaatgcttggaccaactatntacgangacaagttatgagtacgtttcaactgaattgctgcangncaacagcgcggagaatgaactggntntgcctcaccccctcaaatggctttccaacaccccngcgaatantccnanggggggnttt

SEQ ID NO: 98029 - DNA, 446 bp, Triticum aestivum
  unsure (1)..(446): unsure at all n locations
  Clone ID: PAT_TA_98029
ctcgcccgcccgcccgcgccgccgccgcctcctccatccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaaggacaagaacaaatacaatacccccaagtaccgttttgttgtgcgatttaccaacaaggatgtcactgcacaaattgtgtatgctaccattgctggtgatatcgtgatggccgctgcttactcccaagaattgcctcgctatgggcttgaagttggcctcaccaantatgctgcancctactgcactggtctgcttttggnccntngtgtgntcaaaaaccntgatnttgatgaggaagtatgaaagnaatgttgnggccactn

SEQ ID NO: 98030 - DNA, 430 bp, Triticum aestivum
  unsure (1)..(430): unsure at all n locations
  Clone ID: PAT_TA_98030
agaccatcaccttggaggtggagtcctcggacaccatcgacaacgtgaaggcaaagatccaggacaaggagggcatccctccggaccagcagcgcctcatcttcgctggcaagcagcttgaggatggccgcaccctggctgactataacatccagaaggagtccaccctccacctggtgctcaggcttcgtggaggcatgcagatttttgtcaagacgctcaccggcaaagaacatcaccctgganggtggagtcctcgggacaacatcnaaaatgtgaaaggcaanattcaagacaaggggggtntccccccggaccaacaacgcctcatcnttgctgggaancnactggnggatggccncacccttgganacttaaacattcaaaangngttaccccttaacnggnggctccgcctgnntggngggca

SEQ ID NO: 98031 - DNA, 434 bp, Triticum aestivum
  unsure (1)..(434): unsure at all n locations
  Clone ID: PAT_TA_98031
gctgggccatgctcggcgcgctcggctgcgtcttcccggagctgctcgcccgcaacggcgtcaagttcggcgaggccgtgtggttcaaggccggctcccagatcttcagcgagggcggcctcgactacctcggcaaccccagcctggtgcacgcgcagagcatcctcgccatctgggcctgccaggtggtgctcatgggcgccgtggagggctaccgcgtcgccggcggcccgctcggcgaaatcgtggacccgctctaccccggcggcagcttcnaacccctgggcctcnccgaggaccccgaagngttcgcggagctcaaggttaaggaaattaagaacgggcgcctcnccatgttctccatgttcggcttctttctggcaagggcaacgtcaccngnaagggggccctgggagaaactcgccgaccaactn

SEQ ID NO: 98032 - DNA, 446 bp, Triticum aestivum
  unsure (1)..(446): unsure at all n locations
  Clone ID: PAT_TA_98032
gagcgcatcatttaagccaagcaagctgtggtcaatacaaatccaccatgaagacctttctcatccttgccctccttgctatcgtggcgaccaccgccacaactgcagttagagttccagtgccacaattgcagccacaaaatccatctcagcaacagccacaagagcaagttccattggtacaacaacaacaatttctagggcagcancaaccatttccaccacaacaaccatatccacagccgcaaccatttccatcacaacaaccatatctgcagctgcaaccatttccgcaggcgcaactaacatattcgcaagccaacaatcatttngaccaacaaacaaccaatatccacaaccggaaccaaangtntttcgcaancncaaggaacccaatttcaaaagcaggaagcnaacaancaacaannancaacaacnaaattctt

SEQ ID NO: 98033 - DNA, 172 bp, Triticum aestivum
  unsure (1)..(172): unsure at all n locations
  Clone ID: PAT_TA_98033
aagaacgaagcacaacacatctgtctgtcttccttcattcacacgcgcgtgcgcgaaagagggggagcncggtcnttcttntgattcagtggtcgttnnncacatgtggnngttncaatanctcnggatnagcagntggggtagtctcttggggcancngccactgnaatgg

SEQ ID NO: 98034 - DNA, 423 bp, Triticum aestivum
  unsure (1)..(423): unsure at all n locations
  Clone ID: PAT_TA_98034
atctcctccccctccagccccctcgcgccccagccgacgccgccgccgccgtcgccgccgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgcctgatggcggtggtgcacaaccccgcgccaagttcaaggtgccgggactggttcctcaacagaaagaaggactacaaagggacgggagggttctcccaaggtccgtgtccaacgccgttgggacaataaagctcaagggaangacctttgagg

SEQ ID NO: 98035 - DNA, 435 bp, Triticum aestivum
  unsure (1)..(435): unsure at all n locations
  Clone ID: PAT_TA_98035
ccccgctccaaaatccccaaatcccctctcttccgaagctactcagccatgtcggggcgcggcaagggcggcaaggggctcggcaagggcggcgccaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcangcccgccggaagaacgttacccgccatggacgttgtctacgcgctcaaagcgccangggaagcaccctgtacgggattccngcgggctgangancccccgggggctttgctgggcgggccgttggngnaanaaaccctgggttcnnnggtccaanaaan

SEQ ID NO: 98036 - DNA, 411 bp, Triticum aestivum
  unsure (1)..(411): unsure at all n locations
  Clone ID: PAT_TA_98036
cagatccgcctccgctccccctcctgcccccccgcccgagtccaagtccacccctccccaccgcggcgcgcacgcacccggccaccacccacccggatccagatccgcccggcggcggcggcggcggcggcgcaggggggagccatggccggcaccggcggcttgtcggagtcggtgatgcggaaggtgctgctgtcctactgctacgtggcggtgtggatcttcctctccttcgccgtcatcgtctacaacaagtacatcctcgaccccaagatgtacaactggcccttccccatctcgctcaccatggtgcacatgagcttctgctcctcgctcgcccgtggggctcgtccgcgtcctgcgggtcgttgagccggcctcctccccggcccatgaacgccngcaactcna

SEQ ID NO: 98037 - DNA, 420 bp, Triticum aestivum
  unsure (1)..(420): unsure at all n locations
  Clone ID: PAT_TA_98037
cctcctcctgtctcgtcctcgtcccccgtcccccgtcccctcgtcggngcccgatctaagtcaagatgagtcgtggcgggagtgctggaggtggtcaaagttctctgggttacctgtttggagatggtgagcctgcaaaagcctgctgcagcaccagctgcgaagccagcacctgctgagaaaccagcactggcagctgccgatgtaaccaagcagattccagctggcattccagngtagccgggcgancaactactaccgtgcanatggccaggnacacgggcaacttccttacggancgtccttcaancaaggttcatgctgctcccggcggtggctcgtccctgggctacatggtttgggngggnaagtgatccctgttaaatgatngttgncnatgaagttgggcctgntnntctt

SEQ ID NO: 98038 - DNA, 425 bp, Triticum aestivum
  unsure (1)..(425): unsure at all n locations
  Clone ID: PAT_TA_98038
catagtacagccatggcccccaccgtgatggcctcgtcggncacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagacngctgtcctacctgccaccgctcagcacggnggccctcctcangcaggtcgactacctgatccgctccaagtgggtgccttgcctcgagttcaagcaaggttgggtttatcttccgtgangcacaacgnatcccctgggtactacgatggccgggtactggaccaattgtggnaaggctgcnatattgttcgggntgnacccgnncgaccncgcaggttgatnaaacngng

SEQ ID NO: 98039 - DNA, 261 bp, Triticum aestivum
  unsure (1)..(261): unsure at all n locations
  Clone ID: PAT_TA_98039
caccatctcccccggcctcagcagccgccatggccgacggcgccaacccaaacccaacatccacacccaggcagaaggcagtcccggactggctcaacagcccgatctggtccgcccctgcccctagcccgcgccaccgctcccctccccgcgccccctcccctcccccacctcnccctcccaagccgcagcacgatccgaccccgccgccccctcgtcaacccgcgcggcgcgncggtgcaagctctgactccgactccg

SEQ ID NO: 98040 - DNA, 385 bp, Triticum aestivum
  unsure (1)..(385): unsure at all n locations
  Clone ID: PAT_TA_98040
ccaccttccgtccttcccccgtcgtcgcggatccagctagggtttctcgcccccgccctcccgcctcaccgccggccccgtccgccatgtcgaagcaaggagggaaggccaagccgctcaagcaggccaaggtcgccgatgaaggactacgacgagaatgacctggnatacctccagaagaagaaagatgagcaaaaggccctgaaggatctgaatgncaaggcaggccangaagggtgcgctgggaggatccggtctcaagaagangtgtgaagaaatgagtctgcncacccattcgntaanacccaggaaantgatantctanctatctacctatctgngtcgcggcttcactctctgtgggntgtaacnagaccnnccttca

SEQ ID NO: 98041 - DNA, 404 bp, Triticum aestivum
  unsure (1)..(404): unsure at all n locations
  Clone ID: PAT_TA_98041
gcaaagtcctctctctagcgcagcggtcagtgccctctgttctatccaggaggtcctgggttcgagtcccaggcgcccctatttttgcctcttatttaccttttttgcacaccacacagccagccgcttgggcttggcccgattctgctgctgctgttgccttgcgcacagagcgctctatatctatctaccgctggcctgtgtagcccgtgcagctctagattcaagcccgtttagattttttcctgttctgttttttcacctaaatttccagtgcttgcatatttacagtaaatgccatcattttaaaatgctcataactaaatgtccatgcatccaaataaaacatgttatatatgtaaaatgctcagaattttatctactttcaaaatctaccaatttcn

SEQ ID NO: 98042 - DNA, 360 bp, Triticum aestivum
  unsure (1)..(360): unsure at all n locations
  Clone ID: PAT_TA_98042
cccacccaccagcagcaatccatccatccctcgcagctccggcggcgatgccggcgggccagcagccaccggngcgcgagcccgacggcggcgactccaaccaccacccccacccgccgccccccangcccgcgctcccgtccgaggtggtgccggnctanccgccgcnggtgtcggaggacgacgagtcctgggtgtggncgcacatcaaggcggnggcccggcgngacgccgacgcctgngnaggggctcggcctctttcctctacggcaaccggtgttntcncacccccctccnntgtncccgnctctgctcctcctntctaatntcggnncaaaganaagctcctgnctccctcca

SEQ ID NO: 98043 - DNA, 416 bp, Triticum aestivum
  Clone ID: PAT_TA_98043
ggtcataaacccaagtcggactcgccttcctcctcgccaactactcctctcctctcctccgcgcatcgcaccggggtcacctgaggtagatcacacacacaatggtgaaggctgtggctgtgcttaccggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacccgaaagatgaaattcgccatgctggtgatcttggaaatgtgacagctggagtgggatgggtgttgctaagcaatcaaataattacttgactgccaat

SEQ ID NO: 98044 - DNA, 418 bp, Triticum aestivum
  unsure (1)..(418): unsure at all n locations
  Clone ID: PAT_TA_98044
aaaaccaagcaantctagttagcaccaatccatcatgaagaccttcctcgtctttgcncttcnagccgtngtggggacatctgccattgcanagatggagactagctgcatccctggnttggcgagaccatggcagcancaaccattacaacaaaaagagacatttccacaacaaccaccatcttcacaacaacaacanccatttcctcaacaaccaccatttttgngngcaacaaccttcattttcgcagcaaccactattttcacagaaacaacaaccaagttctaccacaacaaccagcattttcgcagcaacaacaaacagttctaccacaacaaccaagcattttcgcagcancaacaccaancaggcttctgcancaacaanatcccctattgttcatccatcccaattttg

SEQ ID NO: 98045 - DNA, 311 bp, Triticum aestivum
  unsure (1)..(311): unsure at all n locations
  Clone ID: PAT_TA_98045
gccaagcgaaaggcccacccggcagccgacagctcaccaccaacccccccaatggcgaagacgcaaccccgcgggccgacggcggcggagccgctgctccccccgccgccgtacctcggnccccactcgccatcccacctccacgacgccgacctccacgactcctacgtcctcctcgtccccgtgcgcctccgccgccgcctgcgcgggggctgcggntgnggncgcgtngcggcggncctcgccgccctcgcgctcctggnnntcgccttcctcctctggccctcagantcctgngcgtccagngtggt

SEQ ID NO: 98046 - DNA, 328 bp, Triticum aestivum
  unsure (1)..(328): unsure at all n locations
  Clone ID: PAT_TA_98046
tttttttttttttgtttttttttttttttttttttttttttttttttttttttttttttagcacacaacaaaagaacagatatcttaataccatcttaaaacgcatgcacactacagagtggagcaagctccaaaatcncaaaatcgtcgnatgcattacctccttttacatatcccgtacatgtcagcattttcaagtttacaagcaaaaccaaggcaagggcaggggcaaagatggattaaccccttccttnccaaggagggtcaaccccgaacgcctnaacccccnccccccccngtctgggacgttaaantncgnccccgagaa

SEQ ID NO: 98047 - DNA, 473 bp, Triticum aestivum
  unsure (1)..(473): unsure at all n locations
  Clone ID: PAT_TA_98047
atcaaatccaagtaagtattagttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacaaactattccccaaccccatcaaacattccaccatcaaccacaacaaacatttccccaaccccaacaaacatacccccatcaaccacaacaacaatttccccagacccaacaaccacaacaaccatttccccaagccccaaacaaaacattcccccancaaccccaacttaccatttcccancaaccccaacaaccattcccccaagcctcagcaancccaancaaccanttccccaagtcacaacaancacaacanccttttncccaggcccaacaaaaanttccg

SEQ ID NO: 98048 - DNA, 465 bp, Triticum aestivum
  unsure (1)..(465): unsure at all n locations
  Clone ID: PAT_TA_98048
gtgtgaaaagaaattaatattacttaccgactttagctccttaaacttgcgggtgtattcttcctttaggagttgtccttgggtgccaaacaacttgcgatcttcccatatgtcaacctgcaacacttacataatttaacaccacaggcccacaattctagcccctgcgtaaatggtgtgtcatgggatttcatactcgcttcgcccaaaatagttaactctaaactgctacaatttgagccaagaagagactatatgctagtgtaacattatgcaaagtaacaagatgaagggtnaaacataaatgcaaaatcacatcaatgcccaaagtggagtgaaactcctanggatntggagatgtacaaggaaaaancanttctccgcttcctanccanaatacttcnctgggacaggttttacacaagaataacatnggggtgcatgncancaaaattttcaaatgta

SEQ ID NO: 98049 - DNA, 302 bp, Triticum aestivum
  unsure (1)..(302): unsure at all n locations
  Clone ID: PAT_TA_98049
ctagtcttgagttttttttttttttttttttcgactaaaaatttaattatgaaagagatcacagcaggccgatgatctgaactacaaccgaggagttctttcctccttctttctctaaattacatgtctgcaaataagtttcagaacaacagggatggcatggagttcattgaatgaaaaatgaataaatttatgggctggacaatccctggtttaacctncgaangatncaanccaaaaagttggactnataaacaattccaagatgccaaaatccttggnaagnncaacaagctttggaa

SEQ ID NO: 98050 - DNA, 299 bp, Triticum aestivum
  unsure (1)..(299): unsure at all n locations
  Clone ID: PAT_TA_98050
ccccaaccgtccccctctctcgctcgcatcacaacaaacgcgctctctcctcgcccagcttccggaactcgccccccgtccccgtcgccaccggnatggcctccgccgtctccctcgccgcctcctcctcgcccctcgccgccacctcgccctcgcgcgcgccgngcccccaccaggcgctcncgcccgcccgcggcccgcggtctcaggnccaaggccctcagtgncggtctccggccccgccngnaagccngccgggtgggggaggtccngtcgngggagangngggtcngtcttgt

SEQ ID NO: 98051 - DNA, 407 bp, Triticum aestivum
  unsure (1)..(407): unsure at all n locations
  Clone ID: PAT_TA_98051
tgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgaagggngtgatgaccangctgtgaaggnggttgacattgttgacaacttccgtcttcaggagcaacctgcttttgacaagaagcantttatcnctcaaaatgaancgctaaatcnaagaacctcncctgcaagcnttgaaggggaanaaccaaaatnttttaaaaaaaaa

SEQ ID NO: 98052 - DNA, 483 bp, Triticum aestivum
  unsure (1)..(483): unsure at all n locations
  Clone ID: PAT_TA_98052
ctcccttccaaccaatccaccaagcaaacccgatggcccgcacgaagcagacggcgaggaagtccaccggcggcaaggcgccgcggaagcagctggccaccaaggcggcgcgcaagtcggccccggccacgggcggcgtgaagaagccgcaccgcttccgcccgggcaccgtggcgctccgggagatccgcaagtaccagaagagcacggagctgctcatccgcaagctgcccttccaagcgcctcgtccgggagatcgcgcaggacttcaagaccgacctccgcttccaagagctccgccgtctccgcgctggangaggncgccganggcgtaactcctcngggtcttcnaggaaaacaacctctgggccatccaagccaagcgcgttancaatcatgcccaaggacatccanctngcaagacgcatccggggcnanagggcctaagatantgtctgnntcttctgcaagtgtnaaattanc

SEQ ID NO: 98053 - DNA, 458 bp, Triticum aestivum
  unsure (1)..(458): unsure at all n locations
  Clone ID: PAT_TA_98053
gcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcaatctatccttatgcagcgtcatatcaaggttgatggaaaggtccgcactgacaagacctaccctgctggtttcaaggacatcatttccattcccaagactggtgagaactacaggcttctgtatgacaccaangggcgcttccgccttcantctgtcanggattaggntgctaaattcaanctctgcaan

SEQ ID NO: 98054 - DNA, 450 bp, Triticum aestivum
  unsure (1)..(450): unsure at all n locations
  Clone ID: PAT_TA_98054
aagttctttggcatgccttgccatgccgccagtcctcggttccatgcgccatcttgctctagcttcatgtaagggtgcaatgaaagccgtgctcccttccaaggcgattcaccacgggtcttgggcgtctgtcgtctctgctaccgttggctcagcaaccccacccgatattgatgttgcggtcctttttggccgatcagacaacattgttgcagagttgtctggcacgggttcanagttttctccgagcgggncggnggctgctcttagnaggctctcccttgcaccggctaggtcgcaaaccactccgatgtcaangcccttctggcgtggangatnttggtgnttgggananatgcccctatangcaatnaataaantggggtantanttggtanntttccttnttcatggataactttcctattgttcaaaaccanaaaanttgtt

SEQ ID NO: 98055 - DNA, 461 bp, Triticum aestivum
  unsure (1)..(461): unsure at all n locations
  Clone ID: PAT_TA_98055
cctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattggtgttgaagttcacccgttggatttcaccactaactgtggaaagatccgtttctactgctgggacactgctgggcaagagaagtttggtggccttagggatggatactatatccatggtcagtgtgcgattatcatgtttgatgtcacttcaaggctgacctacaagaatgttcctacgtggcacagggacttgtgcagggttgtgagaacatccccattgtgctgtgtggcaacaaggttgatgtgaagaacangcangttaaggncaagcaagtgacatt

SEQ ID NO: 98056 - DNA, 473 bp, Triticum aestivum
  unsure (1)..(473): unsure at all n locations
  Clone ID: PAT_TA_98056
ctatttaacaccaatccaccatgaagaccttcctcatctttgccctcctcgccgttgcggcgacaagtgccattgcacaaatggagactagccacatccctagcttggagaaaccattgcaacaacaaccattaccactacaacaaatattatggtaccaacaacaacaacccatccaacaacaaccacaaccatttccacaacagccaccatgttcacagcaacaacaaccaccattatcgcagcaacaacaaccaccattttcacaacaccaacaaccanttctgccgcaacaacaaataccatctgttcaagccatctatcttgcagcagctaaacccatgcatngtnttcctccaagcaagcaatnnnttcctggggnaatggcannntcgcctggctnagtcncaantgttggtgggaagaggtanttgncatgttgtggcancaacaatgntggccgggaactggcg

SEQ ID NO: 98057 - DNA, 465 bp, Triticum aestivum
  unsure (1)..(465): unsure at all n locations
  Clone ID: PAT_TA_98057
agtctcctatcacccagaggtgctgaaatggcaggtgtagaaggtcaccaccaaactctatttacaccctgggtacagagcaacgggggggtcaccatatggggttgctacggtttcagaggtcctcttagtttctcagctttctaagctaacagcagattgatgcgggcaccgcatgatccgccatgctggttaaatgttcatgtcccaagcaaaaaagatccagcctgatcaccctccagcagttatcatccagtagagttgttttaccgtacagacatcggtgggcaaagaatccctaggtagtgcgagaagctgagctagcccaccctaggtagtgcgagaagctgagctaggccactccagattcctgtacttcaggacatcaaccttgtccaagtcgtacgtctggcatatccttgaaataatgtcgcaatccanaccctgggtccaagnctctcctcn

SEQ ID NO: 98058 - DNA, 453 bp, Triticum aestivum
  unsure (1)..(453): unsure at all n locations
  Clone ID: PAT_TA_98058
agatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctgggtanggaaaaatttgctgcggttccatctggtggtgggggtgtggccgtttcaactgctgcccctgcctgctggaggtgctgctggccctgcagctgagtcaaagnaagaatgagaaggtccgtggangaaggaaagagagtgatgaanataatggggcttcangtctgttncgaactaangtttgttgggggcactttgtgtcctgaaggaatcna

SEQ ID NO: 98059 - DNA, 488 bp, Triticum aestivum
  unsure (1)..(488): unsure at all n locations
  Clone ID: PAT_TA_98059
agctatatacctacatagtacagccatggcccccaccgtgatggcctcgtcggccacctccgtcgctcctttccaggggctcaagtccaccgccggcctccccgtcagccgccgctccaacggcgctagccctcggcagcgtcagcaacggtggaaggatcaggtgcatgcaggtgtgggcccatcgaggggcattaagaagttcgaagaccctgtcctacctgccacccgctcaancacgggagggcctcctcaagcaagtcgaactacctngatccgctccaaagtggggtgccttgcctcngagttcaagcaagggttgggtttatcttcccgtgaggcacaaacgcatcccccctgggggtactaacgaatggggccgggtactgggacaaatggtgggaaagctggcctnatgtttcgggggtngaaccggacgccaacccaaggtnantnaaaccagggtngnagggaaggtcnangaaatg

SEQ ID NO: 98060 - DNA, 465 bp, Triticum aestivum
  unsure (1)..(465): unsure at all n locations
  Clone ID: PAT_TA_98060
atcaaaaccaagcaacactatttaacaccaatccaccatgaagaccttcctcatctttgccctcctcgccgttgcggcgacaagtgccattgcacaaatggagactagccacatccctagcttggagaaaccattgcaacaacaaccattaccactacaacaaatattatggtaccaacaacaacancccatccaacaacaaccacaaccatttccacaacaagccaccatgttcacagcaacaacaaccaccattatcgcaagcaacaatcaaccaccattttcacaacaancaaccaccatttttgcagcaaacaacaaccgcggttctaccgcaacaaacaccaattttccgcaagcancancaacaatttcccgcaagcaancaacaaccaacttttaccggnaacaaccaccaatttttcgcaancaagcaacccaccaatttttctcaagcaagcaggg

SEQ ID NO: 98061 - DNA, 268 bp, Triticum aestivum
  unsure (1)..(268): unsure at all n locations
  Clone ID: PAT_TA_98061
cccaccgccgctccccaacccccgcccctcccgccgcgccgcccccctgccgctcctcccgccgcgccgtctccctgccgctcctccccaccccgccgtccaccgtaccgccccagccgcgcggnccttccccaccgacggnatcgattgtgctacgacggtgctccaagcggtggtngagaacnaacgcggtcgnggcnatgatgntggatcaacgacgcnttnaacggcccagngagnatctngacatccgatttncattnntcaa

SEQ ID NO: 98062 - DNA, 413 bp, Triticum aestivum
  unsure (1)..(413): unsure at all n locations
  Clone ID: PAT_TA_98062
gttaacaccaatccaccatgaagaccttcctcgtctttgccctcctcgccgttgcggcgacaagtgcaattgcgcagatggagactagangcatcnctggnntggtgngagcatgggatggancatgcattagnagnagatnaggcatttccacangnaggactnttttcacantgacaanaagtatttcctcaacnaacatcattttcggaagcnancaaccaccaattttgggagnaaacaaccaacatttttctcaagcaaacanacaaattctaccaaaggaaaccaccaattttcggcaggcaacnaaanaactangtttntaccngcaacnaacccaccaattttcaaagggaacnaaccaacccangtttttccctccaaaaaaaaaatcaccctttttcccacaa

SEQ ID NO: 98063 - DNA, 382 bp, Triticum aestivum
  unsure (1)..(382): unsure at all n locations
  Clone ID: PAT_TA_98063
cccntttcnacacncgttcncaccancgaccccaccgcncggctcttcnatggncggcctccagcgccggcccgcggcggcggccgccgcgagcgcgaggggcgaggggcagcctccgggcgggcagcgcgtcatccactgcgacntcnagccggcgccgcgggcgtggcccgggatgcagatgctggccctcgccgccgtcctcgtgctcgggggcctncagttcctgccgggcacccacttccgccaccccgccgacccctcccgcacctgggggtccnccttcganatcctcgcgccaacccccaaggatctgtnncaatnaaggttaaacatggtaggatgtcnaactcatccgataanctgtnggggatntttccca

SEQ ID NO: 98064 - DNA, 457 bp, Triticum aestivum
  unsure (1)..(457): unsure at all n locations
  Clone ID: PAT_TA_98064
cctccacctgcanccatcaatattgtctacgatctaaccatattctcctccatccgtcgccgccaccaccactccttagacctaactatcttctcctccaccggcaaccatgaacattgtccagatctaactatcttctcctccatccaccgccgccacttccactctctagatatgtttgccctcgtaaatccatcatctatgtgtttcctcttatgtgangattgtggtattctaaggcaccggcgcactgcaccatccggccctttcccgacgcaccacagtcgcttggccaggccatcctctttttacatcttggatgnagacggcgagatccaangtcnaaaggcttccatgggaaatctcattggttcaagtgcagttaagttncgttcaggctattcaagctngggaatttanagcaangggcccaagacgccgncgcaccnatttcacg

SEQ ID NO: 98065 - DNA, 445 bp, Triticum aestivum
  unsure (1)..(445): unsure at all n locations
  Clone ID: PAT_TA_98065
cccaaccccaacaagcattcccccatcaaccacaacaacaatttccccagccccagcaaccacaacaacaatttccgcagccccagcaaccacaacaaccatttccccagccccaacaagcccaactaccatttccccaacaaccacaacaaccattcccccagcctcaacaaccccaacaaccatttccccagtcacagcaaccacaacaaccttttccccagccccaacaaccgcaacaatcattcccccagcaacaacaaccgttgattcaagccatatctacaacaacagntgaacccttgcaagaattacctcttacagcaatgcaaccctgtgtcattggngtcatccctcgtgtcaatgatcttgccacgaagtgattgccaaggtgatgcaagcaacaatgttggcaacaactagcacaggttcctccncaggctcn

SEQ ID NO: 98066 - DNA, 471 bp, Triticum aestivum
  unsure (1)..(471): unsure at all n locations
  Clone ID: PAT_TA_98066
aaaccaagcaacactatttaacaccaatccaccatgaagaccttcctcatctttgccctcctcgccgttgcggcgacaagtgccattgcacaaatggagactagccacatccctagcttggagaaaccattgcaacaacaaccattaccactacaacaaatattatggtaccaacaacaacaacccatccaacaacaaccacaaccatttccacancagccaccatgttcacagcaacaacaaccaccattatcgcagcaacaacaaccaccattttcacaacaacanccaccatttttgcagcaacaacancccgttctaccgcaacaaccaccattttcacancaccaacanccannttccgcccgcaacaacaactaccntntggtncaagccatctantctttntcgnaagncnaaaacccatgnattggcnttcccnccaagnaagcaaacgncccgccttgttgg

SEQ ID NO: 98067 - DNA, 454 bp, Triticum aestivum
  unsure (1)..(454): unsure at all n locations
  Clone ID: PAT_TA_98067
caccaatccaccatgaagaccttcctcgtctttgccctcctcgccgttgcggcgacaagtgcaattgcgcagatggagactagatgcatccctggtttggagagaccatggcagcagcaaccattaccaccacancagacatttccacaacanccactattttcacaacaacaacaattatttcctcaacaaccatcattttcgcagcaacaaccaccattttgggcagcaacaaccaccattttctcaagcaacaaccaattctaccacaagcaagcaccattttcgcaggcaaacaacaactcagntctaccgcaacanccaccattttcacagcaancaacaaccagttttacctccacaacantcaccttttccacancaagcaacaacaccaaccagntgggtgcaaacaacnaaatccctgttgttcaagcccatccatttttgcagg

SEQ ID NO: 98068 - DNA, 318 bp, Triticum aestivum
  unsure (1)..(318): unsure at all n locations
  Clone ID: PAT_TA_98068
tcctcctcctcctgccaccgatcccgaaccagggaggaacccggcgcgaggagggcaaaggaagagaagaggagatcaccgagcccagcgcgcgcacagganatcaggngccgcgatctcncncaggngcggagatggggctcacgttcacgaagctgttcagccggctcttcgccaangaaggagatgaggatcctcatggtcggtctcgatgcggctggtaanaccaccatcctctacaannctcaaagctcgggagagattngtcaccaccaatccccacaatccggngtttantgtcgnncagctggttcacgt

SEQ ID NO: 98069 - DNA, 459 bp, Triticum aestivum
  unsure (1)..(459): unsure at all n locations
  Clone ID: PAT_TA_98069
gtcatggagggagagaatggcaaggtgatgaagaagaaggcgcatgagtggagggaaaaggcggtcaaggcgaccaagcccggcggctcgtctcgccgcaacttcgaagagttgatccatgaggtgctagctcctactcctcgccgctctgcataaagaaataatagtgtacctgctccaaggtttcacaatcccggtttttcggaggaggccggaaaatcccttcttttggaggaggtcgtaagaaccaagttttgaagaatatctcggtaattaccgcccaataaaattcaataaattgtgaatttagaaactttggtgccaaaaataaatgttaattgccccgttggttttgtgattagtaagttttttgtccccggtggccccgcccaacttccgttaaaaaaaaggggggggcccgggtaccccaattccgcccctaatangtggangtccgnt

SEQ ID NO: 98070 - DNA, 453 bp, Triticum aestivum
  unsure (1)..(453): unsure at all n locations
  Clone ID: PAT_TA_98070
cgcctctctccgcgcaaccgagccttcgccctcgtcctccccatttcgccagcggcgcagcccaccaaccacccccacccgccgccatgagggagtgcatctcgatccacatcggccaggccggcatccaggtcgggaacgcgtgctgggagctctactgcctcgagcatggcattcagcctgatggccaagatgcccggtgacaagaccgttgggggaggtgatgatgctttcaacaccttcttcagcgagactggtgctgggaaagcacgtcccccgtgctgtcttcgtagatctcgagcccactgtgattgatgaggtgaggactgggcgcttaccgccagctcttccaacctgaagcaagcttatcaagtgggcaaggaggatgcaaccaacaaactttcgcccgtgggtcattacaccaattggcaaaggagattggttgatcttctn

SEQ ID NO: 98071 - DNA, 466 bp, Triticum aestivum
  unsure (1)..(466): unsure at all n locations
  Clone ID: PAT_TA_98071
ctgagcttgagcgcgaccctgatcccctgttcgccatggatcgnccgccacatctcgacatcgacctcaacgagccgcccccgccgtcaccaccgccggcggttcaccagccgcccccgcacgagttcgctgccgccatccccattgctgctcctcctcctccgccgccgccgccaccccagctcccgcctctcgccaacgtgcatgcccagccgctgctcccgcaccangcccgcgaagctangcgctggcgtnaccancggtgcgggatcctgggaaattagctggctgctaagggcaagtgcgcccgcgaccgctggttcatcgctggaggtgctgccgccaccggttcttcagtccgcccgcttttgctcctccgctgctgccgccgcgggcgccaacgcggtcaacaaaaggtcccgccctcccggccgacgttgcagggctcancgggctgctcgcgcaa

SEQ ID NO: 98072 - DNA, 432 bp, Triticum aestivum
  unsure (1)..(432): unsure at all n locations
  Clone ID: PAT_TA_98072
ctagagcacaagcagaaaatcaaagtacgtagtagttaacgcaaatccaccatgaagaccttactcatcctgacaatccttgcgatggcaataaccatcggcaccgccaatatccaggtcgaccctagcggccaagtacaatggctacaacaacaactagtcccccagctccaacagccattatcccagcaaccacancaanacatttccccancctcancagacattcccccatcaaccacatcagcatgttccccagcctcaagcaaccacancaaccatttctccagccccaacaagcattcccccaacaancacaacaaccattcccccagactcaacanccacaacanccattttccccagcanccacaaacaagcatttccccangactcancagctcccaancnagccatttncccaaccaacca

SEQ ID NO: 98073 - DNA, 450 bp, Triticum aestivum
  unsure (1)..(450): unsure at all n locations
  Clone ID: PAT_TA_98073
aacaccaatccacaatgaagaccttcctcgtctttgccctcctcgctcttgcggcggcaagtgccgttgcgcaaatttcacagcatgcaacaagcaccgccattttcgcagcaacancaaccaccattttcacagcancancaaccaccattttcgcangcaacaacaatcaccattttcgcaacaacaccaacanccaccatttgcgcagcaacaacaaccaccgttttcacaacaaccaccaggtttcacagcagcaacanccaccattttcacagcaacagcaanccacanttttcacagcagcaacatccancatatttcgcagncaacaacagccaccatattcgcangcaagaacaaccaccattttcgcagcattaacanccaccaatttttcggnagcagccaaccagcaaanccaccattttacacnggcaagccaggcag

SEQ ID NO: 98074 - DNA, 445 bp, Triticum aestivum
  unsure (1)..(445): unsure at all n locations
  Clone ID: PAT_TA_98074
cgtcgtccaatcgttggttccacttgtcaagaatcgttccagttccaaaccgtgcaacccaaatgcccaagcatcaaggccactcgactaggaaaccgagtgtgacggctatttttctgggatttctatccagaaactaacagtgggcagtggttgctgagatgatgcgatctgtatgcttctttattactgtacatgatatcttccacttctggtggcgttctcgttctggaaggtgcctggtaagcaggtaggtttataatttaagcatggattcagtctgatggtcccgaaaactagttttgagtttgaangggaagttctcaangtcatgtgccggtaatgatgatgttagggtggcgggaaagttcatcacaagtgttggttatgggccggcgaaattccaatgtgaatgtttaatttttnattttaatttgggcntgan

SEQ ID NO: 98075 - DNA, 465 bp, Triticum aestivum
  unsure (1)..(465): unsure at all n locations
  Clone ID: PAT_TA_98075
tctctgatcagagtagcactagcttcagctagccagcctctgccactccggtcattttcttgcatccacgacggcaatggccaccgctgatgtccagaacccatcggccgcgctgacggaggaggcgcccgcggtggagaagccggtcgccgccgaggaggtcgcgaagacggaggaagcccccgcgccggtggaggccgaagtcgaggcgcctgcccccgtcgaggttgaggagaccaaggaggaggcgccggcagcagttgaggcagaggagacgaaggagcccgagccagcagctgcggccgaaccggaggccgatngcgcccgccgtggtccgagacagagaccaaaggaggccgtggctgangcaagagcccggcggnnggccgaggaggtgaaggaaaangcnggcgcctggctgccganggccgagccggncgctccccccttgctgctgaaggaann

SEQ ID NO: 98076 - DNA, 471 bp, Triticum aestivum
  unsure (1)..(471): unsure at all n locations
  Clone ID: PAT_TA_98076
cccgtgctccctcttctctccaccggatctccacctccccgagcagtagcacaccgccggccagtgccttcctctctcctgctccctcctccctagctacgtctcccctgagcagccacaggccgctgggctgagcccagcgcccgcccgtcaccaagcaagccgcacgccgcgggcaagcgccctcccgctgtncgttcaccgccgcgcccaacaccctcccgcccgtccgtccgccaagagcaagccacgcgctgagaccaagcaaccgcccgtccccaaagcaaggcacacggcaaggncagngtcctcccgccgtncgtccancggcgcggccaaaaacctcccgcccngtccgtccggcaacgagcanntgggcgcttgagnccangggccggtcanncccaaaggnagncgnacgcccgcgggncaaaggnccctcccggccggtncgttccaacggccgnggcc

SEQ ID NO: 98077 - DNA, 450 bp, Triticum aestivum
  unsure (1)..(450): unsure at all n locations
  Clone ID: PAT_TA_98077
cccaaccccaacaaacattcccccatcaaccacaacaacaatttccccagcctcagcaaccacaacaacaatttctccagccccaacaaccattcccccaacaaccacaacaaccatatccccagcaaccacaacaaccattcccccagactcaacanccccaacaactatttccccagtcccagcaaccacancaacaattttctcangccccangcaacaattcccgcagccccancaaccgcaacaatcattcccccaacaacaaccaccgttcattcagccatctctacaacancaggtgaacccatgcaagaatttcctcttgcagcaatgcaaacctgtgtcactggtgtcatccctctggtcaatgatctggccacaaagcgattggccaagtgatgcggcancaaatgctgccancaagctngcacaagattcctcangnag

SEQ ID NO: 98078 - DNA, 452 bp, Triticum aestivum
  unsure (1)..(452): unsure at all n locations
  Clone ID: PAT_TA_98078
gtctcgagttttttttttttttttttgaaattcaaagcatttttcatatataaagtttttacangcnangcacggttggtgagatatgacatgcatgaaacttagggggttttctgcaaatctggtaatctctggataatgctaaaattgcaagatctgaaaaaaaacaattgggccgaatctaaacagtgcactgggcgctgggtctgtggtggctcaccatgggccaacatcaactgggccggctaggtgggctgcagcaggccagctggatggaaggacgaggtggacgttgtgcctggcgcaanaacgtggcctagggcgcggtcaacgttctttgggatgacgtgggctgcgtgcacctatgggcnaagcaanacatcaacggggtgaaagcaagggggtcncccggccgaagggcaaccggtgggcaagggggcngggggcccaan

SEQ ID NO: 98079 - DNA, 446 bp, Triticum aestivum
  unsure (1)..(446): unsure at all n locations
  Clone ID: PAT_TA_98079
cactagtccaccatgaagaccttcctcatctttgccctcctcgccgttgcggcgacaagtgccattgcacaaatggagaatagccacatccctggtttggagagaccatcgcagcaacaaccattaccaccacaacaaacattatcgcaccaacaaccacaacaacccatccaacaacaaccacaacaatttccacaacagcaaccatgttcacaacaacaacaacaacaacaacaacaacaacaacaacaacaacaacaacaacancaacaacaacaacaacancaacaacaacaaccattatcgcggcaacacagaaaggtcatcatttccctccttgctatcgtgggcgaccaccgccacaactgcagttagagttcagtgccacaatttgcaagccacaanaatccatctctgcaacaaccacaagagcaagttccattggg

SEQ ID NO: 98080 - DNA, 452 bp, Triticum aestivum
  unsure (1)..(452): unsure at all n locations
  Clone ID: PAT_TA_98080
cactagttaacaccaatccaccatgaagaccttcctcgtctttgnnctcctcgccgttgcggcgacaagtgnaattgcgcagatggagactagatgcatccctggtttggagagaccatggcagcagcaaccattaccaccacancagacatttccacaacaaccactattttcacaacaacaacaactatttcctcaacaancatcattttcgcagcaacanccaccattttggcagcancaaccaccattttctcaagcaacaaccaattctaccacagcaaccaccattttcnnaggcaacaaacaactagttctaccgcagcaaccaccattttcacagcaacaacaaccaagttttacctccacaacaantcaccttttccacaacaanaacancaccaanaggctgggtgncagcaacaaaaancctggttnnttcagccatcccg

SEQ ID NO: 98081 - DNA, 359 bp, Triticum aestivum
  unsure (1)..(359): unsure at all n locations
  Clone ID: PAT_TA_98081
gccatggntgcgccgccgccggcggcgacggagaagaagaagacgttcgtgctctacccgtcgctgggcgtgggccacctgaaccccatggtggagctggccaagcacctgctccgccgcggccacagcgccgtcgtcgccgtcgtcgacccgcccgacggcgaccccacctcggccgccgcggtggcgcgcctcgccgaggccaacccctccatcgccttacggctcctcccggccccgcccagcccggaccccgccggcgcaccccatcaagcgcgcccacgacacccttcggcctcgccaaaccccgcgctccgggncttcctgnncngcggctggcgggcccctgcccaagccaa

SEQ ID NO: 98082 - DNA, 436 bp, Triticum aestivum
  unsure (1)..(436): unsure at all n locations
  Clone ID: PAT_TA_98082
caccaatccaccatgaagaccttcctcatctttgccctcctcgccgttgcggcgacaagtgccattgcacaaatggagactagccacatccctagcttggagaaaccattgcaacaacaaccattaccactacaacaaatattatggtaccaacaacaacaacccatccaacaacaaccacaaccatttccacaacagccaccatgttcacagcaacaacaaccaccattatcgcagcaacaacaaccaccattttcacaacaccaacaaccaagttctaccgcaacaacaaataccatctgttcagccatctatcttgcngcagctaaacccatgcatngtattcctccagcagcaatnnagccctgtggcaatgccacatngtctttgctaggtcgcaattgttgtgggcaggagtatttgccatgtnntgcag

SEQ ID NO: 98083 - DNA, 444 bp, Triticum aestivum
  unsure (1)..(444): unsure at all n locations
  Clone ID: PAT_TA_98083
gagcccttgggcagccaggcctcaaaagatcagttcgagttggtgagaccggttttagagaggttgctgcataccttctggactatgataactttgctaatgtccccccgacagttcttgttaagatttcacatcctgtatttaatgtgaatgaaggcgtcggctctaccaacaagaaggcttctgtgggtgatccgcgaactgtcagcaaaattgcctcatttcagcagttcgctcctcatgattttgatgctagtgaccttggcacttcaagcttccctgtaagctgctattcacaggattggtattcttgacatcccgaatcttcaacactgatagacatgctgggaaatcttctggtnagaaaagggtgacaagagcccgatnaaattcgggaaatcaagactggagcttgantcctaattggaccnatggggccnctng

SEQ ID NO: 98084 - DNA, 456 bp, Triticum aestivum
  unsure (1)..(456): unsure at all n locations
  Clone ID: PAT_TA_98084
gccgtctcgtccccgcccggatcgcctgccctccgaccagcccgcgcggccgcccctcatcgccggggaggcccccctccaatcccacgcgagcggcgacgaaccaaggagcagcgaggncgaggaggaggagtcatcgccatcagcattaactccctgccctccctcgaaagcgccaccacaccaccggatccaatccaaccacctcccccggcgcccgcctcgaggccgctctctctccccgtaggttcgctttctccgatcctcaccgaatccgccgcgcccttttcccacccgcgccccgccccgcccgggccatgcccctgccgccggagcaagcagcaagtcggcgattggcgcgtttgcggcgttgggnngttaatcccccangnagnggggctngctccaaggncggctccttcccccgggnatnnaagcccctccctcgggncctnt

SEQ ID NO: 98085 - DNA, 455 bp, Triticum aestivum
  unsure (1)..(455): unsure at all n locations
  Clone ID: PAT_TA_98085
ccgcgacccccctcaaaaccccaccatcccgctgcaaccggcgccccgtcctccccgcccgcgcgcactcgtccttcacccccgtccctcagtgcggccacactcacctgacccacggaatgacgtccggtgcctctggccgcaccgccacggccggaaccgcggcgctgctgccgctgctgttcttgctgctgcaggtctccgcgggcgcgggcgcgggcgccgactgccatttcccggccgtgttcaacttcggggactccaactcggacacgggcgggctgtcggccgccttcggcgccgcgccgccgcccaacggcaggaccttcttcggcaaggccgccggccgctactgcgaagggncgcctccgtcatccgacttcaatcgctgaaaaacctngggaataactttactnaagngggnanctcnactcaaataaggggngcaaatttct

SEQ ID NO: 98086 - DNA, 393 bp, Triticum aestivum
  unsure (1)..(393): unsure at all n locations
  Clone ID: PAT_TA_98086
gaatcagaaatctcaagctcagcacagcaacaatggccgagcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggaggggcaagagcgtcgtcgccactgggacgcaagatcattggcgccaccaaccccctggactctgagccccggcaccaatccgtggtgacttttgcccgtcgacaatcgggnagganacgttcaatccatgg

SEQ ID NO: 98087 - DNA, 313 bp, Triticum aestivum
  unsure (1)..(313): unsure at all n locations
  Clone ID: PAT_TA_98087
gttaacaccaatccacaatgaagaccttcctcgtctttgccctcctcgctcttgcggcggnaagtgccgttgcgcaaatttcacagcaacaacaagcaccgccattttcgcagcaacaacaaccaccattttcacagcancaacaaccaccattttcgcagcaacaacaatcaccattttcgcaacaancaacaacanccacnatttgcgcagcaacaacatncaccgntttcacaacatgccancantttcacagcaggcaatnanncaccattttnacaagtancaatcattgcacanttttcaanaggca

SEQ ID NO: 98088 - DNA, 423 bp, Triticum aestivum
  unsure (1)..(423): unsure at all n locations
  Clone ID: PAT_TA_98088
ccccagncccagcaaccacaacaaccatttccccagccccaacaaacattcccccaacaaccccaactaccatttccccaacaaccccaacanccattcccccagcctcaacaaccccaacaacaatttccccaagtcacagcaaccacaacaaccttttccccagccccaacatcaattcctgcagccccaacaaccgcaacaatcattcccccagcatcancaaccgttgattcagctatctctacaataacaagatgaacccctgcaagaattttctcttgcagcaatgcaaccctgtgtcattggggtcatccctcaangtcaatgatcttgccacgangtgggtctgccaagggtggttgcaacaaccaatggttggcaaacaaacnggncanaggattcctccaagnaagcgncaag

SEQ ID NO: 98089 - DNA, 472 bp, Triticum aestivum
  unsure (1)..(472): unsure at all n locations
  Clone ID: PAT_TA_98089
gcctcaacaaccccaacaaccatttccccagtcacagcaaccacaacaaccttttccccagccccaacaaccgcancaatcattcccccagcaacaacaaccgttgattcagccatatctacaacaacagatgaacccttgcaagaattacctcttacagcaatgcaaccctgtgtcattggtgtcatccctcgtgtcaatgatcttgccacgaagtgattgccaggtgatgcaagcaacaatgttgccaacaactagcacagattcctcgccaagctccaagtgtgcagccatccatancgtcggtgcattccatcgtcatgcagcaagaancaacaacangggcatacaagatcctcccggccanctggtttcangctcggccaaaggtcanggggnaatcatccaaccttcaacaagcncagntcnattatggngggggttaangtttaatngggnnttgggggaaccc

SEQ ID NO: 98090 - DNA, 453 bp, Triticum aestivum
  unsure (1)..(453): unsure at all n locations
  Clone ID: PAT_TA_98090
gttaacgcaaatccaccatgaagaccttactcatcctaacaatccttgcgatggcaacaaccatcgccaccgccaatatgcaagtcgaccccagcggccaagtacaatggccacaacaacaaccattcccccagccccaacaaccattctgccagcaaccacaacaaactattccccaaccccatcaaacattccaccatcaaccacaacaaacatttccccaaccccaacaagacatacccccatcaaccacaacaacaatttccccagacccaacaaccacaacaaccatttccccagccccaacaaacattcccccaacaanccccaacttccatttccccnacaaccccaacaanaatttcccccaagcctcagnaaaccccnaacaacccattttccccagtccnanaacnaccaacaacaaacctttttncccagaccccaaaaaat

SEQ ID NO: 98091 - DNA, 353 bp, Triticum aestivum
  unsure (1)..(353): unsure at all n locations
  Clone ID: PAT_TA_98091
caacaatcacatcanncattcctcctacaaccacaacanccattcccccaacaaccacaacaatcattcctcctaggaccgcancaaccatttccccaacaacccgaacaatcacaacaatcatttccccagccccaaccccagcaaccccaacaaccatccatcctgcaaccacaacaaccattaccccancaaccacagcaaccatttctacagccccaanaacanttatcccagcaaccaagagcanacaatttcccagcannccccaagcagccacaccaacctcancaaccaatatccacancangcaaccatatgnganntagtcttacaaagcatcgggtgggcca

SEQ ID NO: 98092 - DNA, 442 bp, Triticum aestivum
  unsure (1)..(442): unsure at all n locations
  Clone ID: PAT_TA_98092
cccaagtcataaacccaagtcggactcgccttcctcctccccaactactcctctcctccgcgcatcgcatcgcaccgggggtcacctgaggtagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatgggngcancaagaagatgaaatccgccatgctggtggatcttgggaaatgtnacagcttggagcggntgggtgtttgctancatcaanggttactgnnctgggcaatatccccccttactggggcn

SEQ ID NO: 98093 - DNA, 453 bp, Triticum aestivum
  unsure (1)..(453): unsure at all n locations
  Clone ID: PAT_TA_98093
agacctttctcatccttgccctccttgctattgtggcgaccaccgccacaactgcagttagagttccagtgccacaattgcagctacanaatccatctcagcaacagccacaagagcangttccattggtacaagaacaacaatttccagggcaagcagcaaccatttccaccacaacagccatatccgcagccgcaaccatttccatcacaacaaccatatctgcagctgcaaccatttccacagccgcaactatcatatccgcagncgcaaccatttcggaccacaacaaccatatccacagccgcaaccacaagtattcgcanccacaacaaccaatttcgcaagcaancaagcaagcaacaagcaagcaaacaacaancaacaacnacaacaaaatccttcnacaaatttttgnaacaaacaaactggnttccatgccnggggatngtt

SEQ ID NO: 98094 - DNA, 462 bp, Triticum aestivum
  unsure (1)..(462): unsure at all n locations
  Clone ID: PAT_TA_98094
agtgcaatggccactactacaataatatatgtagctatggttctcgccgtgtttgccgtcatgtcctattcagcccacgccgacgacgacttcatctcccgcacatgcaagaagaccaagaatgctgaattgtgtgtggacgtgctccaccaaaatatagatagcgacgacgcctccagcgagctcgacctcgccaacatctcgctaaaaatagccaagtgctaccgctgacttaaacgtcgagtacaccaaagactgggtcaggcacagccgccacaagccccagcggggaagcgttggttgcctgccgcttggcatatgctgacgctgtaaatgaccttaaagcttcgcgcccatacccaaggtttcacaagngggggactatgtntggcggcgataaaagcnatgtgtttgggctgcctaaagggggccgcttgatgctttgcgaanaaacgnngttna

SEQ ID NO: 98095 - DNA, 446 bp, Triticum aestivum
  unsure (1)..(446): unsure at all n locations
  Clone ID: PAT_TA_98095
gcccggagcactggccgtgcagcagcaagtcgttgcatccgccttggtagtgaaccacatcgtccggttcaggttggtggagatggtggccaagttcgtccagggcctggacaaggtcgtcgccaccattgatcgcgtaaggccgacgagttgcaggggaggtgggaggaattcaaggaagcgcacaagttttggggcggcgttgagctgtggcgtttcgaggccgacatcaaagtgatggtgaccggcctgctgcatggcggcggccgatccggggtggcatacctctactcatggggtgtccagctaccaagatgcagcgggcgacgaccaatggggctccacngagaaggtcccccgccggagttcctcaacgcggggaagatgggtttcatgctnaaacggaggnncncaaaaacttncgggttnggctttggtgnaanaat

SEQ ID NO: 98096 - DNA, 418 bp, Triticum aestivum
  unsure (1)..(418): unsure at all n locations
  Clone ID: PAT_TA_98096
cagagacacagagcagagcggataaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcaggacaaggagatggcatggcatggatggacctaatgaaggagcactagtagtacttatgcatgggggtgttgcgtttgtgttctctttttaattgccgncggagnaatta

SEQ ID NO: 98097 - DNA, 432 bp, Triticum aestivum
  unsure (1)..(432): unsure at all n locations
  Clone ID: PAT_TA_98097
gccaagcaagcagtgctcaatacaaatccaccatgaagacctttctcatccttgccctccttgctattgtggcgaccaccgccacaactgcagttagagttccagtgccacaattgcagctacaaaatccatctcagcaacagccacaagagcaagttccattggtacaagaacaacaatttccagggcagcaacaaccatttccaccacaacagccatatccgcagccgcaaccatttccatcacaacaaccatatctgcagctggcaacatttccacagccgcaactatcatatcccgcaagccgcaaccatttcgaccacaacaaccatttccacagccggcaaccacaagttattcgcaaccaacaacaaccaattttcgcaagnaagcangcaagcaagcaagcaagcaaacaaacaaacaaccang

SEQ ID NO: 98098 - DNA, 158 bp, Triticum aestivum
  unsure (1)..(158): unsure at all n locations
  Clone ID: PAT_TA_98098
gaccgancccccatgctgcgctgccacatcccgccgcaatgcggcccggccccgctcggncgccgcggnctgccccgggcggccacggcgcccgcggnggtgcgctgcgccgngcgggccccgtcgcgggggancgtggcggctgccgnggcggtcgt

SEQ ID NO: 98099 - DNA, 453 bp, Triticum aestivum
  unsure (1)..(453): unsure at all n locations
  Clone ID: PAT_TA_98099
gggatctcctgtacgtacatccaggctgaggcagcttgtgcgcaccaagcaacggcaatggaaaacagcgcgccgccggtgatcatcgttggggcggggccgtcggggctggcggcgtcggcctgcctggcgcggcgcggggtggatagcatcgtactggagcgggatgactgcgtcggctcgctatggcagaagcgcgcctacgatcgtctccaccttgcacctccccaagcaagcaaagcgcgctcccccaccttgcccgcacgcccgacgacgccgccggcctaacccttcccccgcgaaccaactttcgtcccgctaacctccgaacccctaacgnccgaacnggctttcncccgttgcggcgcggcggccttccggccttcccggccggngangggtccngattccccgcnnctttcattnttnggacnaanggggcccnatngggaa

SEQ ID NO: 98100 - DNA, 337 bp, Triticum aestivum
  unsure (1)..(337): unsure at all n locations
  Clone ID: PAT_TA_98100
tgcaancttttccccagccccaacaacaattcccacagccccaacanccgcaacantcattcccccagcaacaacgaccgttcattcagccatctctacaacaacgtttgancccatgcaagaatatcctcttgcaacantgcaaacctgcgtcattggtgtcatccctctggtcgataatctggccacaaaggcgattgccaagtgatgcagcancaatgctgccangaacnagcatagagttcctcagcagctctagtgcgcagccatccatagcgtcgtgcattctatcatcggtgcangcatcagcaacagacatccaanaatcancatctac

SEQ ID NO: 98101 - DNA, 322 bp, Triticum aestivum
  unsure (1)..(322): unsure at all n locations
  Clone ID: PAT_TA_98101
nttcagcaccaacnttngcanagncgatgtggtcctcgngcccaccaatccccgcgacgagtaccagcactggttcaaggacatgaggcanagcaaccgcatcaatgatgagganggntacccggccttcatctccgtcaagcaaggtgacaggccagggcatcanacactcncagnggcgacgngcacccnggttaaggctggtgccatacaangncgnctaccaccacnaatcagtttntgtttgcctgggagcctaccgacggtnngtngggcgggggctntcccgtggggattccgnnatncgggggaanaatcatcc

SEQ ID NO: 98102 - DNA, 438 bp, Triticum aestivum
  unsure (1)..(438): unsure at all n locations
  Clone ID: PAT_TA_98102
cccgctacagtaggagaggcgattttttccccttccccgttcgatntaattcgccggcggcggctcgctggtttccccccctctgccgggccgcttcggcgggggggaaggtggggaaaactccngttccccgtctggtaaataaaataagaatggagttggggtggttcncccggcaaacgccccttggaaaaagaaaaggcgctgttccgggttggtgggtttgtnggcgggccggtgatttttctccgggtgggnggggttcttgcggaatccgaacaanttccccncctccttcctggtgctncgtaacncggggganttgccgngngccttnttcccgntgcccggantccgtaaggcggggggctccggttgttgaaantttggaaaaatgcaagtgatnanggtccaaatnnaaggngatggcnacaatta

SEQ ID NO: 98103 - DNA, 252 bp, Triticum aestivum
  unsure (1)..(252): unsure at all n locations
  Clone ID: PAT_TA_98103
gatcagccgtgtaaggaatacaacggagcttctcgcacgatcattttgaatgggcgtattggtggatctcccctaaagaccgcgacttgccgccgaaactgtggagttttgagttctttcctgatcggattgaggaagatgggttggctctgctgttcgggaaggcttgcgctgggatccttgtcgtcttcggatcaagaaacctctgcttgccatgaggaggagggggagganaacnatctnccgcntcac

SEQ ID NO: 98104 - DNA, 426 bp, Triticum aestivum
  unsure (1)..(426): unsure at all n locations
  Clone ID: PAT_TA_98104
attcagtgcagctaagaatcatacgcagggtaactacaaaaagaaagataaaaagaaaggggggcaaaatagagatgagaatgctcgcaagcaagtcataggaaaaaaaggggacattcatttggcgttcgtccgatgggtagtgagttagagttctcttttgagaaagaaatggatagctatgagcgcatattatatggcgatgtaaccgcctcttccaagcgggtgtgcattgggcagaagttgaagtagtccaggacgaggagggtggggttacacaatgttgcaaaagggagactgacgagaaggaggaaagagtatattccgcaaggggtggaatcngttggngaaagagaaaagacgaagaatggcacatcgggcaagccctcccgagggagggaggacccgcccggccaaattgaaaan

SEQ ID NO: 98105 - DNA, 414 bp, Triticum aestivum
  unsure (1)..(414): unsure at all n locations
  Clone ID: PAT_TA_98105
ggaagacggttaccctcatcggtgacgacaatgaggatcttgaaaaatcgtgctcaaggaaggagaaggctgcgagcgccccaacgatggggcagttgtcagnntgggactnatcngnaagttggncnatggnactgtnttcactaanaaaggacatgaatggcgacnaaccattccagttcaagacggacgaggagcangtcatccaagggcngganacaanngttctcaccatgaagaaangagaagtggcgtcagnttnaanaccacctgaacatgcgttcggntncaccnagacnaaacttgattttgccgtgggtccctcctcaaagnangggtcctnttataaaaattggggccctgttttcctttcncnaaagaggaaaaaatccttgggacttttttnaaaaaatt

SEQ ID NO: 98106 - DNA, 413 bp, Triticum aestivum
  unsure (1)..(413): unsure at all n locations
  Clone ID: PAT_TA_98106
gcccagtacctcgccgagccccaatcccgagagcggcagctcttcttcgagatggcacttgaccgcgccgacaaggagaatttgccgccggcggccgccgtcgcccgtcctcatggcgtggttgtcaggagctgcaagctgaagcggctcgggaggtcgcggaggcgggtgccgctcagggacatcaccaacctcttcgccgtggagtcaacggttgcccaagtggcagcaggccctgctccagcggccgcagccgcacgaggggtcgggcgacggcngagccggncgtgaagaacgggctggncggtgctgtgctnaaggccggcanatactctctccggaaggagtttaagatagctactaaccgattatatatggattatacttttcatttcatttgtccaaatgattca

SEQ ID NO: 98107 - DNA, 433 bp, Triticum aestivum
  unsure (1)..(433): unsure at all n locations
  Clone ID: PAT_TA_98107
cccaaacccaccaccggcggcggcgcggcgcagctcgaggaaggaggctcaanatggtnaaagttcttgaagcccggcaaggnngtgatcctgctgcagggcangtacgccgggaagaaggcggtgatcgtgcgcntgttcgangagggcacccgcgaccgcccctacgggcactgcctcgtcnccggcctggccaagtacccgaanaaggtgatccgcaaggactcggccaagaagacgggcaagaagtcccgcgtcaaggtgttcctcaagctcgtcaacttcacccacctcatgcccaacccgctacncccctccgaacgtcnacctcaaaggagggtggncctccggggggcgccccgaactcccctcaactccaagggacaaagaaaggtggggcgcaagccaaanggccggccaagggccaaagctg

SEQ ID NO: 98108 - DNA, 331 bp, Triticum aestivum
  unsure (1)..(331): unsure at all n locations
  Clone ID: PAT_TA_98108
accaagcacannggcaacangggcagcaactagcacaagggcaacanagggcaagcatccaagcacaagtgcaacaagggcagcggccagcacaagggcaacaaggtcancagccaggacaagggcaacaaggtcagcagctaggacaagggcaacaangtcagcagccaggacaagggcaacaagggcagcaancagcacatgggcaacaaangtcagcaaccaaggacaanggcaacaaggtcaagcnagcccangacangggcaaacaaggtcaagcaagccaagggaccagggggcaagcaacccnggggacaaangggcaagccat

SEQ ID NO: 98109 - DNA, 446 bp, Triticum aestivum
  unsure (1)..(446): unsure at all n locations
  Clone ID: PAT_TA_98109
ctgnanncgcaacaaccattcccccagcaaccagaacaaataatatcccagcaaccccaacaactattttctcagtcacaacaaccatttccccagcaaccccaacaaccatttcccctgcaaccgcaacaaccatttccccaacaaccagcacaaataattgctcagcaacctcaacaaccatcccctctgcaaccacaacaaccgttcctccggcaaccacaacaatcgttcctccagcaaccacaacaaccatttccccaaccccaacaagtagtacaaantaaattcccaggcaacccccaacaaccattttccccaagtcacgacaaccattttccccaaggaatcccaaacaaccatttcccactggcaacccgnaaacaatcatttccccccagcaantcagncaacaaaattatttcctcaagnaacccccaaacnag

SEQ ID NO: 98110 - DNA, 465 bp, Triticum aestivum
  unsure (1)..(465): unsure at all n locations
  Clone ID: PAT_TA_98110
ctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcatccgcctgttcgccaagaaggagatgcggatcctgatggtgggtctcgacgcccccggaaagaccancatccttctacaagctcanagctcggcgaagatcgtcaccaccatccccaccaatcgggtttaatgttgaaactgtgngagtaacaaagaaccatcagcttcacttgtctggggatntctggcggtccaggnanaaagattcagggccanctggngggagggatttnctttccaanaacaccaaaangggtcctcnaanccttttgttnggtgngnccaagncaacngnttnggggaancgtg

SEQ ID NO: 98111 - DNA, 430 bp, Triticum aestivum
  unsure (1)..(430): unsure at all n locations
  Clone ID: PAT_TA_98111
cccaaccgccgcccgccgccgccgcagaggggagaggccgccgccgcccgccgccgcccccgcgcccccgccggccgggtttgatcccatggcgtccaagaggatcctcaaggagctcaaggacctgcagaaggaccctcccacctcgtgcagcgcaggtcctgtaggtgaggacatgttccactggcaggccactatcatgggaccctcggacagcccgttcaccggtggcctatttttggtgaacattcatttcccaccggattaccccttcaagcccccgaaggtctctttccgcaccaaggtgttccacccaaacatcaacaagcaacggcagcattttgccttgacattctcaaggaacagtggatcccggctttgaccattatcaaaaggtcctgctgtcaaatcctggttcnttgcttaacng

SEQ ID NO: 98112 - DNA, 434 bp, Triticum aestivum
  unsure (1)..(434): unsure at all n locations
  Clone ID: PAT_TA_98112
agcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttaaccattanacctatttnaaagagggttccgttactaaaaaggttactttcaatggtanggtaacgtaatttggttcaaaagcctacgtgctcctacgttttgggagggatctacaaatttccccctaacntnattcaaaaacctttcaa

SEQ ID NO: 98113 - DNA, 409 bp, Triticum aestivum
  unsure (1)..(409): unsure at all n locations
  Clone ID: PAT_TA_98113
ccaacacatacccaacctcccttctcccacgacccaacccacctccaccatcttcctcctgcctcgtccccaacatcctccccaacccgccccgcacctgtgctccaccccgagccgccgcccttaccatcccaccttctccgacgcacgcacccacccccaccctccccaccgtctccggcgcggtgcggcccaccccgagccgccatcccaccctccccaccgtctccggcgcggcgcggnccaccccgaagccgccgtcccacnctccacaccatctccggcgtggcggggcccatcccgagccaccgtccccacangcnaccangncacnctccccancttctccgggtgnaggcccngccncanctgagccgtncgtcccaaccgtccncaacnttctcccggg

SEQ ID NO: 98114 - DNA, 429 bp, Triticum aestivum
  unsure (1)..(429): unsure at all n locations
  Clone ID: PAT_TA_98114
gcgccgtgcccaacaactgcaagagggtcagcgagagggggccagccattcctctcttctctaccacctactcccctctctctcctccccttctctctaggatcgccagccagccagccagcgccagccaatcgcgcacccacagcgcgcgcgcctcccaactgagccccgagaaagaagaagaagaagaagcagaggaacagagacagagaaagagcaatcactcgtcagaaagtgaagaacaagtgttcttggcctccgctcctctccgcccgccatgtccattggtaacccgtcttcttcctcctccgccgccctcctccaaactgctttcctccctgcggnggnaactctgcttttccggtccccttccaatttcgtcgctngcatctctgcctccatttcccttgttaaatctcctttgatggg

SEQ ID NO: 98115 - DNA, 430 bp, Triticum aestivum
  unsure (1)..(430): unsure at all n locations
  Clone ID: PAT_TA_98115
acctcctccgccgncgccgccatggtaggagnaggagtcnggggncgnaaggctcgcaactttgcgacctttcgcctattcccccgcgacggngncgccnaccccaacgaccgcgtcttcgtccgcgtcgacaataacgcctacaccatccccggcttcggcgacgacgaagacccttccctctcgcccancgncggcgncgaccaattcccttcctccanctctgggnccctccccgaccangtncgccagcaaatncttgagctcgggctccccgacgatgggtaaaactnccttctccaactccgngnggtgngggcctcccgatgttggctcctcctttgtaccanncatacggcccgccaaangnaattttccctgnacgngaaaggctaataatgcaaaccaagggggnggggttgctttgggg

SEQ ID NO: 98116 - DNA, 442 bp, Triticum aestivum
  unsure (1)..(442): unsure at all n locations
  Clone ID: PAT_TA_98116
agatctgatcacccataagctagctagctagcagcttaaggaactagcttgcagctaccgatcgatggctcgtctcaacancaaggctgtggtggccgccgtggtcctggcggcggtggtgctgatgatggccggcagggaggcctcggcggcgctgtcgtgcgggcaggtggactccaagctcgcgccgtgcgtggcgtaagtnacgggganggcgtcctcnatnaacaaagagtgctgctccngggtgcaagggctgaacggnatggccgcaacaactcggaccgcaaaataacgttcaagtgcctcaaaaancccccccaccaacattaagttcattaaaaattgggcaanggctcccggggtgncccggcaaatttcgggggtcaaatttttccctttcccaanaaaaaatnttcaaanaaattgggnaaantttnaa

SEQ ID NO: 98117 - DNA, 168 bp, Triticum aestivum
  unsure (1)..(168): unsure at all n locations
  Clone ID: PAT_TA_98117
acctcctccgccgccgccgccatggnaggancangagtcggcggccgcaaggctcgcaactttgcgacctttcgcctattcccccgcgacggtgccgccgacccnaacgaccgngtcttcgtccgcgtcgacaacaacgcctacaccatccccggcttcggcgacaga

SEQ ID NO: 98118 - DNA, 446 bp, Triticum aestivum
  unsure (1)..(446): unsure at all n locations
  Clone ID: PAT_TA_98118
cctcacctcacctctcaccgcgctccggcgatcgagcttggccagcttagcgatggaggcagggacgtgggcggtggtggtggcggcggcggccgcgtacctggcgtggttctggcggatgtcgcgcgggctcagcgggccccgggtgtggccgctggtgggcagcctgccggggctgctgcagcacgcggaggacatgcacgagtggatcgtcggcaacctgcgccgcaccgggggcacctaccagacctgcatcttcgcggtgcccggcgtggcccgccgcggcgggctggtcacggtcacgtgcgaccccaggaacctggagcacgtcctcaaaggcgngcttcgacaactaccccaaggggnccccttctgggcacgggcgtctttaagcgaaccctggctcgggggaacggnaatcttnnacctcccgacnggcgnancan

SEQ ID NO: 98119 - DNA, 460 bp, Triticum aestivum
  unsure (1)..(460): unsure at all n locations
  Clone ID: PAT_TA_98119
ttcaaaccctagacggccagggcccccgtacggccggatcttctcggccacggccgcccgtgctcgaccatcgccgcctcatcgacactcccccgcggncacacaacacccccttgttcgcacaaccgcttctctgcggcttttcggcgtccatgcctcctccgccgccgccgcacgaccctcgcgctggatacggcgtggagtcttccagcgtcgtgacggngccccgatcgccacatgagtcgcgggaaccccttcccggaggcccctctggccacngtgaatggccccgacatttcgccccgagccgtcgccgnttctcccatccaagacaaggggggaaaggtacggcgaagcancaataccaaccggngcttcgtgaccaaaaggaagnccctngcttncaactcgccggtggcanggggaatccgaaatcaaccggccgtctgtctttccaaag

SEQ ID NO: 98120 - DNA, 423 bp, Triticum aestivum
  Clone ID: PAT_TA_98120
gatgaacacagctgttccatcatgccatttaccagtgcctaccattatctagagaatttttctgaataatctccaaaatcatttgtgtacatgctctagtgctctagttagcaaattaaccgaagcggatgaacagttgaactattaattcagagacaagatgccaattactacttggaaacgacgggccaaggcacgtctgatcaacgtgctcaatgcgcactctgaccagcctacaacgaacgagctaatcaatcagtagcaatttgattccaaatcggagcactaataattcagtaagcaccgcccggaacagagcagctgctgctaatttgattccagttgattttcattttaggtaagaccttccttccagttccaagagcgcgcaatcatggcggaacatggcctcgcctccccaac

SEQ ID NO: 98121 - DNA, 453 bp, Triticum aestivum
  unsure (1)..(453): unsure at all n locations
  Clone ID: PAT_TA_98121
gcaacaaggtcaacagccaggacaagggcatcaaccaggacaaggacaacaaggtcaacagccaggacaagggcaacaaccaggacaagggcaacaaggtcagcagctcggacaaggacaacaagggtactacccancttctctgcaacagtcgggacangggcaaccagggtactacccaacttctctgcagcagctaggacaagggcaatcagggtantacccaacttctccgcaagcaaccaggacaagggcagcagccaggacaattgcaacanccagcacaagggcagcanccangacatggggcaacatggtcancagncaggacaagggcaacnnagggccagtcagccaagtacanggggcagcancccggggaccaangggccacccanggggttactacccaaccttctcccgcaatcangttcngngaccaaggggcanacn

SEQ ID NO: 98122 - DNA, 202 bp, Triticum aestivum
  unsure (1)..(202): unsure at all n locations
  Clone ID: PAT_TA_98122
aagaactctagtactagatatatgaaacaccgtgttcttaagtccatggtttggtcgttgtaccgttnaaaatataaggtgacatgcactatcatgtaagaacccgaactatactagttcaaacttgggaaataaaagacaaacacatgtcttgtcctgcanaagaatggttaatttgagttccaatcccggggcccaattc

SEQ ID NO: 98123 - DNA, 407 bp, Triticum aestivum
  unsure (1)..(407): unsure at all n locations
  Clone ID: PAT_TA_98123
gttaacaccaatccaccatgaagaccttcctcgtctttgccctcctcgccgttgcggcgacaagtgcaattgcgcagatggagactagatgcatccctggtttggagagaccatggcagcagcaaccattacaccacaacaggncatttccacaaacanccactattttcacaacaacaacaactatttcctcaacaaccatcattttcgcagcaacaaccaccattttggcagcaacaaccaccattttctcagcancaaccaattctaccacagcanccaccattttcgcagcaacaacaactaagttctaccgcaacaaccaccattttcacanggaacaaaaaccaggttttaccctcacaaaaaatncaccntttttccacaatcagacaacnaacaaccca

SEQ ID NO: 98124 - DNA, 445 bp, Triticum aestivum
  unsure (1)..(445): unsure at all n locations
  Clone ID: PAT_TA_98124
cccggttgttgcccttgtcctgactgttgcggagaagttgggtagtacccttgttgtccttgtcctgattgttgtccttgtcctgactgctgtggagaagttgggtagtaccctggttgcccttgtcccagttgttgcccttgtcctgactgttgcggagaagttgggtagtacccttgttgtccttgtcctggttgttttccttgtcctggctgctgcccttgttccgactgctgcgaaagttgggtaagtaccctggttgcccttgtcccagttgttgcccttgtcctgggctgtttgcaagagaagttggggtaagtaanccnttgttggtccttgtcctgaattggtttgtcccnttgtccctggctgcctgaacctttgtttncccttggtcctggtttgctggccctttngtcctggnttgctggcaattgtcctggct
